US010858665B2

(12) United States Patent
Dangoor et al.

(10) Patent No.: US 10,858,665 B2
(45) Date of Patent: Dec. 8, 2020

(54) ISOLATED POLYNUCLEOTIDES, POLYPEPTIDES AND METHODS OF USING SAME FOR INCREASING ABIOTIC STRESS TOLERANCE, BIOMASS AND YIELD OF PLANTS

(71) Applicant: Evogene Ltd., Rehovot (IL)

(72) Inventors: Inbal Nurith Dangoor, Gedera (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 0 days.

(21) Appl. No.: 15/847,948

(22) Filed: Dec. 20, 2017

(65) Prior Publication Data

US 2018/0105830 A1    Apr. 19, 2018

Related U.S. Application Data

(62) Division of application No. 14/423,793, filed as application No. PCT/IL2013/050725 on Aug. 26, 2013, now abandoned.

(60) Provisional application No. 61/754,587, filed on Jan. 20, 2013, provisional application No. 61/693,392, filed on Aug. 27, 2012.

(51) Int. Cl.
  *C12N 15/82* (2006.01)
  *C07K 14/415* (2006.01)

(52) U.S. Cl.
  CPC ........ *C12N 15/8271* (2013.01); *C07K 14/415* (2013.01); *C12N 15/8247* (2013.01); *C12N 15/8255* (2013.01); *C12N 15/8261* (2013.01); *C12N 15/8273* (2013.01); *Y02A 40/146* (2018.01)

(58) Field of Classification Search
  None
  See application file for complete search history.

(56) References Cited

U.S. PATENT DOCUMENTS

| 6,084,153 | A | 7/2000 | Good et al. |
|---|---|---|---|
| 2002/0046419 | A1 | 4/2002 | Choo et al. |
| 2005/0108791 | A1 | 5/2005 | Edgerton |
| 2006/0123505 | A1 | 6/2006 | Kikuchi et al. |
| 2006/0179511 | A1 | 8/2006 | Chomet et al. |
| 2007/0044171 | A1* | 2/2007 | Kovalic ............ A01G 22/00 800/278 |
| 2007/0209085 | A1 | 9/2007 | Wu et al. |
| 2007/0277269 | A1 | 11/2007 | Alexandrov et al. |
| 2008/0148432 | A1* | 6/2008 | Abad ............ C07K 14/415 800/279 |
| 2009/0094717 | A1 | 4/2009 | Troukhan et al. |
| 2011/0209246 | A1 | 8/2011 | Kovalic et al. |
| 2011/0277190 | A1 | 11/2011 | Abad |
| 2015/0267218 | A1 | 9/2015 | Dangoor et al. |

FOREIGN PATENT DOCUMENTS

| WO | WO 2004/081173 | 9/2004 |
|---|---|---|
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |

(Continued)

OTHER PUBLICATIONS

*Hordeum vulgare* subsp. *vulgare* mRNA for predicted protein, clone NIASHv1022K03, GenBank accession No. AK355560 (version AK355560.1), published May 20, 2011.*
Keskin et al., 2004, Protein Science 13: 1043-1055.*
Guo et al., 2004, Proceedings of the National Academy of Sciences USA 101: 9205-9210.*
Thornton et al., 2000, Nature Structural Biology, structural genomic supplement, Nov. 2000: 991-994.*
Tester and Bacic, 2005, Abiotic Stress Tolerance in Grasses. From Model Plants to Crop Plants, Plant Physiology 137: 791-793.*
Matsumoto et al., 2011, Comprehensive Sequence Analysis of 24,783 Barley Full-Length cDNAs Derived from 12 Clone Libraries, Plant Physiology 156: 20-28.*
Examination Report dated Apr. 29, 2018 From the Australian Government, IP Australia Re. Application No. 2013310979. (4 Pages).

(Continued)

Primary Examiner — Bratislav Stankovic

(57) ABSTRACT

Provided are isolated polypeptides which are at least 80% homologous to SEQ ID NOs: 529, 475-528, 530-770, 6179-9796, 9798-10421, isolated polynucleotides which are at least 80% identical to SEQ ID NOs: 314, 1-313, 315-474, 771-6178, nucleic acid constructs comprising same, transgenic cells expressing same, transgenic plants expressing same and method of using same for increasing abiotic stress tolerance, yield, growth rate, biomass, vigor, oil content, photosynthetic capacity, seed yield, fiber yield, fiber quality, fiber length, and/or nitrogen use efficiency of a plant.

16 Claims, 8 Drawing Sheets

Specification includes a Sequence Listing.

(56) References Cited

FOREIGN PATENT DOCUMENTS

| WO | WO 2014/102774 | 7/2014 |
|---|---|---|
| WO | WO 2014/188428 | 11/2014 |
| WO | WO 2015/029031 | 3/2015 |
| WO | WO 2015/181823 | 12/2015 |
| WO | WO 2016/030885 | 3/2016 |
| WO | WO 2017/115353 | 7/2017 |

OTHER PUBLICATIONS

Examination Report dated Jun. 12, 2017 From the Instituto Mexicano de la Propiedad Industrial, Direccion Divisional de Patentes, IMPI Re. Application No. MX/a/2015/002423 and Its Translation Into English. (6 Pages).

Examination Report dated Jan. 16, 2017 From the Instituto Mexicano de la Propiedad Industrial Re. Application No. MX/a/2015/002423 and Its Translation Into English. (6 Pages).

Examination Report dated Jul. 27, 2016 From the Instituto Mexicano de la Propiedad Industrial Re. Application No. MX/a/2015/002423 and Its Translation Into English.

International Preliminary Report on Patentability dated Mar. 12, 2015 From the International Bureau of WIPO Re. Application No. PCT/IL2013/050725.

International Search Report and the Written Opinion dated Nov. 19, 2013 From the International Searching Authority Re. Application No. PCT/IL2013/050725.

Invitation to Pay Additional Fees dated Oct. 16, 2013 From the International Searching Authority Re. Application No. PCT/IL2013/050725.

Official Action dated Jan. 19, 2017 From the US Patent and Trademark Office Re. U.S. Appl. No. 14/423,793. (39 pages).

Official Action dated Jun. 23, 2017 From the US Patent and Trademark Office Re. U.S. Appl. No. 14/423,793. (12 pages).

Restriction Official Action dated Oct. 24, 2016 From the US Patent and Trademark Office Re. U.S. Appl. No. 14/423,793.

Good et al. "Can Less Yield More? is Reducing Nutrient Input Into the Environment Compatible With Maintaining Crop Production?", Trends in Plant Science, 9(12): 597-605, Dec. 2004.

Good et al. "Engineering Nitrogen Use Efficiency With Alanine Aminotransferase", Canadian Journal of Botany, 85: 252-262, 2007.

NCBI "Predicted: Setaria italica Uncharacterized Protein At2g33490-Like (LOC101778068), Transcript Variant X2, mRNA", Database GenBank on NCBI, National Center for Biotechnology Information, Accession No. XM_13134957248.3, 2 Pages, Nov. 30, 2015.

Showalter et al. "A Bioinformatics Approach to the Identification, Classification, and Analysis of Hydroxyproline-Rich Glycoproteins", Plant Physiology,153: 485-513, Jun. 2010.

Showalter et al. "Bioinformatic Identification and Analysis of Hydroxyproline-Rich Glycoproteins in Populus Trichocarpa", BMC Plant Biology, 16: 229, pp. 1-34, 2016.

Tester et al. "Abiotic Stress Tolerance in Grasses. From Model Plants to Crop Plants", Plant Physiology,137: 791-793, Mar. 2005.

Velasquez et al. "0-Giycosylated Cell Wall Proteins are Essential in Root Hair Growth", Science, 332: 1401-1403, Jun. 17, 2011.

Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Yu et al. "Cell Cycle Checkpoint Protein MAD2 Homolog [Zea Mays]", Database NCBI [Online], GenBank: AAD30555.1, GenBank Accession No. AAD30555, May 17, 1999.

Zhang et al. "Genome Sequence of Foxtail Millet (*Setaria italica*) Provides Insights into Grass Evolution and Biofuel Potential", Nature Biotechnology, 30(6): 549-554, Jun. 2012.

Zhang et al. "Isolation and Characterization of Yield Heterosis Related Genes in Maize [Zea Mays]", GenBank FJ9413679.1, Accession No. FJ9413679, Defination, Zea Mays HRGP mRNA, Complete cds, 2 Pages, Jul. 30, 2010.

Examination Report dated Aug. 6, 2018 From the Australian Government, IP Australia Re. Application No. 2013310979. (11 Pages).

Matsumoto et al. "*Hordeum vulgare* Subsp. *vulgare* mRNA for Predicted Protein, Complete CDS, Clone: NIASHv1022K03," GenBank: AK355560.1, published May 20, 2011, 2 pages.

Requisition by the Examiner dated Jun. 19, 2019 From the Innovation, Science and Economic Development Canada, Canadian Intellectual Property Office Re. Application No. 2,881,623. (4 Pages).

Clarifications Prior to Substantive Examination dated Sep. 13, 2019 from Argentinean Industrial Property National Institute Re. Application No. P20130103018 and Its English Summary. (6 pages).

Search Report dated Sep. 12, 2019 from National Institute of Industrial Property of Brazil Re. Application No. BR 11 2015 004552 9 and its Summary in English. (5 pages).

* cited by examiner pQYN_6669 pQFN, pQFNc

Normal conditions

Osmotic stress (15 % PEG)

Nitrogen limiting conditions pQNa_RP

ISOLATED POLYNUCLEOTIDES, POLYPEPTIDES AND METHODS OF USING SAME FOR INCREASING ABIOTIC STRESS TOLERANCE, BIOMASS AND YIELD OF PLANTS

RELATED APPLICATIONS

This application is a division of U.S. patent application Ser. No. 14/423,793 filed on Feb. 25, 2015, which is a National Phase of PCT Patent Application No. PCT/IL2013/050725 having International filing date of Aug. 26, 2013, which claims the benefit of priority under 35 USC § 119(e) of U.S. Provisional Patent Application Nos. 61/693,392 filed on Aug. 27, 2012 and 61/754,587 filed on Jan. 20, 2013.

The contents of the above applications are all incorporated by reference as if fully set forth herein in their entirety.

SEQUENCE LISTING STATEMENT

The ASCII file, entitled 71838SequenceListing.txt, created on Dec. 20, 2017, comprising 23,496,391 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic plants expressing same and methods of using same for increasing abiotic stress tolerance (ABST), water use efficiency (WUE), yield (e.g., grain quantity and/or quality), fiber yield, fiber quality, biomass, oil content, growth rate, vigor, nitrogen use efficiency (NUE) and/or fertilizer use efficiency (FUE) of a plant.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied.

Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. Publication No. 20020046419 (U.S. Pat. No. 7,262,055 to Choo, et al.); U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; *Arabidopsis* Information Resource (TAIR; Hypertext Transfer Protocol://World Wide Web (dot) arabidopsis (dot) org/), TAIR No. AT2G43710)], OleosinA (TAIR No. AT3G01570) or FAD3 (TAIR No. AT2G29980), and various transcription factors and activators such as Led 1 [TAR No. AT1G21970, Lotan et al. 1998. Cell. 26; 93(7):1195-205], Lec2 [TAIR No. AT1G28300, Santos Mendoza et al. 2005, FEBS Lett. 579(20:4666-70], Fus3 (TAIR No. AT3G26790), ABI3 [TAR No. AT3G24650, Lara et al. 2003. J Biol Chem. 278(23): 21003-11] and Wri1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using *Arabidopsis* FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. Nos. 5,981,834, 5,597,718, 5,620,882, 5,521,708 and 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency.

WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

SUMMARY OF THE INVENTION

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide at least 80% identical to SEQ ID NO: 475-770, 6179-9796, 9798-10420 or 10421, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide selected from the group consisting of SEQ ID NOs: 475-770 and 6179-10421, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide comprising a nucleic acid sequence encoding a polypeptide at least 80% homologous to the amino acid sequence selected from the group consisting of SEQ ID NOs: 475-770, 6179-9796, and 9798-10421, wherein the crop plant is derived from plants selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence at least 80% identical to SEQ ID NO: 1-474, 771-6177 or 6178, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising the nucleic acid sequence selected from the group consisting of SEQ ID NOs:1-474 and 771-6178, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NOs:1-474 and 771-6178, wherein the crop plant is derived from plants selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO:475-770, 6179-9796, 9798-10420 or 10421, wherein said amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 475-770 and 6179-10421.

According to an aspect of some embodiments of the present invention there is provided an isolated polynucleotide comprising a nucleic acid sequence at least 80% identical to SEQ ID NOs: 1-474 and 771-6178, wherein said nucleic acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising the nucleic acid sequence selected from the group consisting of SEQ ID NOs: 1-474 and 771-6178.

According to an aspect of some embodiments of the present invention there is provided a nucleic acid construct comprising the isolated polynucleotide of some embodiments of the invention, and a promoter for directing transcription of said nucleic acid sequence in a host cell.

According to an aspect of some embodiments of the present invention there is provided an isolated polypeptide comprising an amino acid sequence at least 80% homologous to SEQ ID NO: 475-770, 6179-9796, 9798-10420 or 10421, wherein said amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polypeptide comprising the amino acid sequence selected from the group consisting of SEQ ID NOs: 475-770 and 6179-10421.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence encodes an amino acid sequence selected from the group consisting of SEQ ID NOs: 475-770 and 6179-10421.

According to some embodiments of the invention, the nucleic acid sequence is selected from the group consisting of SEQ ID NOs: 1-474 and 771-6178.

According to some embodiments of the invention, the polynucleotide consists of the nucleic acid sequence selected from the group consisting of SEQ ID NOs: 1-474 and 771-6178.

According to some embodiments of the invention, the nucleic acid sequence encodes the amino acid sequence selected from the group consisting of SEQ ID NOs: 475-770 and 6179-10421.

According to some embodiments of the invention, the plant cell forms part of a plant.

According to some embodiments of the invention, the method further comprising growing the plant expressing said exogenous polynucleotide under the abiotic stress.

According to some embodiments of the invention, the abiotic stress is selected from the group consisting of salinity, drought, osmotic stress, water deprivation, flood, low temperature, high temperature, heavy metal toxicity, anaerobiosis, nutrient deficiency, nitrogen deficiency, nutrient excess, atmospheric pollution and UV irradiation.

According to some embodiments of the invention, the yield comprises seed yield or oil yield.

According to an aspect of some embodiments of the present invention there is provided a transgenic plant comprising the nucleic acid construct of some embodiments of the invention or the plant cell of some embodiments of the invention.

According to some embodiments of the invention, the method further comprising growing the plant expressing said exogenous polynucleotide under nitrogen-limiting conditions.

According to some embodiments of the invention, the promoter is heterologous to said isolated polynucleotide and/or to said host cell.

According to an aspect of some embodiments of the present invention there is provided a method of growing a crop, the method comprising seeding seeds and/or planting plantlets of a plant transformed with the isolated polynucleotide of some embodiments of the invention, or with the nucleic acid construct of some embodiments of the invention, wherein the plant is derived from plants selected for at least one trait selected from the group consisting of: increased nitrogen use efficiency, increased photosynthetic capacity, increased abiotic stress tolerance, increased biomass, increased growth rate, increased vigor, increased yield, increased fiber yield, increased fiber quality, increased fiber length, and increased oil content as compared to a non-transformed plant, thereby growing the crop.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

According to an aspect of some embodiments of the present invention there is provided a method of producing a crop comprising growing a crop of a plant transformed with an exogenous polynucleotide encoding a polypeptide at least 80% homologous to the amino acid sequence selected from the group consisting of SEQ ID NOs: 475-770, 6179-9796, 9798-10420 or 10421, wherein the crop plant is derived from plants selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided a method of producing a crop comprising growing a crop of a plant transformed with an exogenous polynucleotide encoding the polypeptide selected from the group consisting of SEQ ID NOs: 475-770 and 6179-10421, wherein the crop plant is derived from plants selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided a method of growing a crop, the method comprising seeding seeds and/or planting plantlets of a plant transformed with the isolated polynucleotide of some embodiments of the invention, or the nucleic acid construct of some embodiments of the invention, wherein the plant is derived from plants selected for at least one trait selected from the group consisting of: increased nitrogen use efficiency, increased photosynthetic capacity, increased abiotic stress tolerance, increased biomass, increased growth rate, increased vigor, increased yield, increased fiber yield, increased fiber quality, increased fiber length, and increased oil content as compared to a non-transformed plant, thereby growing the crop.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
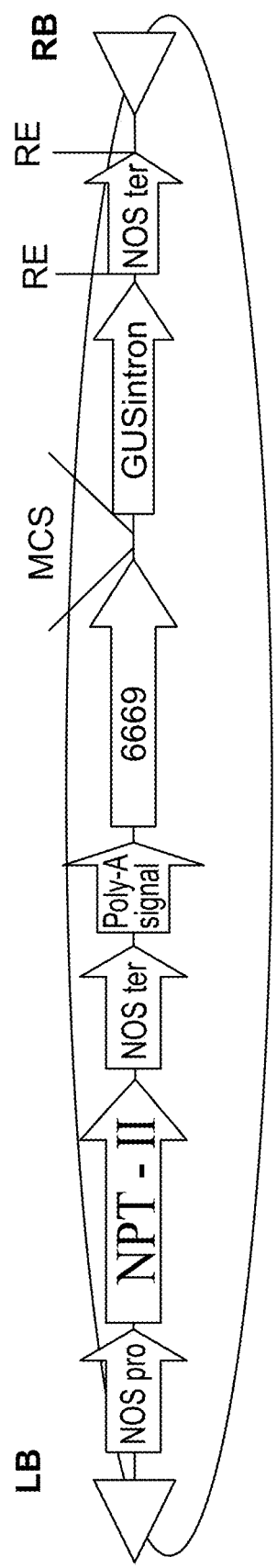
FIG. 1 is a schematic illustration of the modified pGI binary plasmid containing the new At6669 promoter (SEQ ID NO: 10446) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
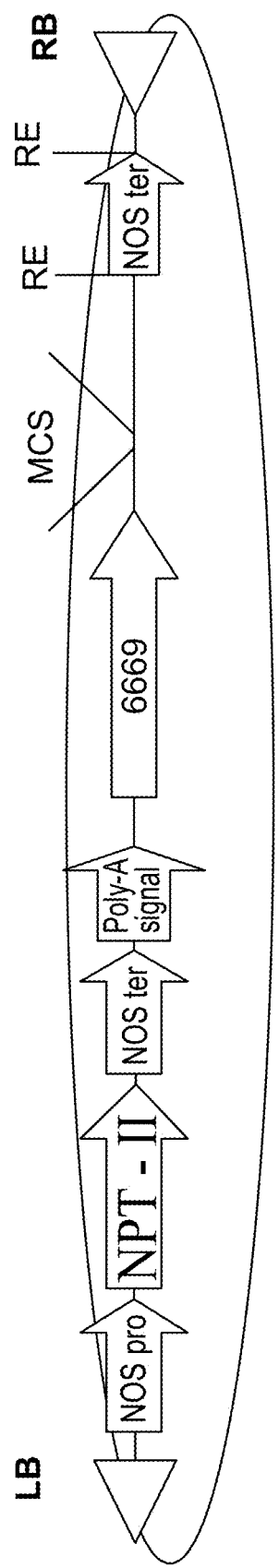
FIG. 2 is a schematic illustration of the modified pGI binary plasmid containing the new At6669 promoter (SEQ ID NO: 10446) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter (SEQ ID NO:10457); NPT-II=neomycin phosphotransferase gene; NOS ter=nopaline synthase terminator; Poly-A signal (polyadenylation signal); The isolated polynucleotide sequences of the invention were cloned into the MCS of the vector.

The present invention, in some embodiments thereof, relates to isolated polypeptides and polynucleotides, nucleic acid constructs comprising the isolated polypeptides, transgenic plants expressing same and methods of using same for increasing abiotic stress tolerance (ABST), water use efficiency (WUE), yield (e.g., grain quantity and/or quality), fiber yield, fiber quality, biomass, oil content, growth rate, photosynthetic capacity, vigor, nitrogen use efficiency (NUE) and/or fertilizer use efficiency (FUE) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to generate nucleic acid constructs and transgenic plants and to increase abiotic stress tolerance, water use efficiency, yield (e.g., seed yield), growth rate, photosynthetic capacity, vigor, biomass, oil content, fiber yield, fiber quality, fiber length, nitrogen use efficiency, and/or fertilizer use efficiency of a plant.

As shown in the Examples section which follows, the present inventors have utilized bioinformatics tools to identify polynucleotides and polypeptides which enhance abiotic stress tolerance, yield (e.g., seed yield, oil yield, oil content), photosynthetic capacity, growth rate, biomass, vigor, fiber quality and yield and/or fertilizer (e.g., nitrogen) use efficiency of a plant. Genes which affect the trait-of-interest were identified (SEQ ID NOs: 475-770 for polypeptides; and SEQ ID NOs: 1-474 for polynucleotides) based on expression profiles of genes of several Sorghum varieties (Examples 2-5 in the Examples section which follows), Maize hybrids (Examples 6-9 in the Examples section which follows), Foxtail Millet varieties (Example 10 in the Examples section which follows), Barley accessions (Examples 11-12 in the Examples section which follows), tomato varieties (Example 13 in the Examples section which follows), Soybean varieties (Example 14 in the Examples section which follows), Cotton lines (Example 15 in the Examples section which follows), and Arabidopsis ecotypes and tissues (Examples 16 and 17 in the Examples section which follows), homology with genes known to affect the trait-of-interest and using digital expression profile in specific tissues and conditions (Tables 1-151, Examples 1-18 in the Examples section which follows). Homologous (e.g., orthologs) polypeptides and polynucleotides having the same function were also identified (SEQ ID NOs: 6179-10421 for polypeptides, and SEQ ID NOs: 771-6178 for polynucleotides; Table 152, Example 19 in the Examples section which follows). Transgenic plants over-expressing the identified polynucleotides and polypeptides were generated (Examples 20-22 in the Examples section which follows) and were found to exhibit increased tolerance to abiotic stress conditions (e.g., drought stress, salinity stress, osmotic stress), increased yield (e.g., seed yield, weight of 1000 seeds, harvest index), increased biomass (e.g., fresh and dry weight, rosette area), increased vigor and growth rate (e.g., relative growth rate), increased photosynthetic capacity (e.g., leaf area, leaves number), drought avoidance (e.g., early flowering and inflorescence emergence), and increased nitrogen use efficiency (Tables 154-181, Examples 23-25 in the Examples section which follows) as compared to control plants grown under the same growth conditions. Altogether, these results suggest the use of the novel polynucleotides and polypeptides of the invention [e.g., SEQ ID NOs:475-770 and 6179-10421 (for polypeptides) and SEQ ID NOs: 1-474 and 771-6178 (for polynucleotides)] for increasing yield (e.g., oil yield, seed yield and oil content), growth rate, biomass, vigor, fiber yield, fiber quality, fiber length, photosynthetic capacity, nitrogen use efficiency, fertilizer use efficiency, water use efficiency and/or abiotic stress tolerance of a plant.

Thus, according to an aspect of some embodiments of the invention, there is provided method of increasing abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 475-770 and 6179-10421, thereby increasing the abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence, seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day or cm/day).

As used herein the phrase "photosynthetic capacity" (also known as "$A_{max}$") refers to a measure of the maximum rate at which leaves are able to fix carbon during photosynthesis. It is typically measured as the amount of carbon dioxide that is fixed per square meter per second, for example as µmol $m^{-2}$ $sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (Zea mays L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The Arabidopsis rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In Mesembryanthemum crystallinum (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, Spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in abiotic stress tolerance, water use efficiency, yield (e.g., seed yield), growth rate, vigor, biomass, oil content, fiber yield, fiber quality, fiber length, photosynthetic capacity, nitrogen use efficiency, and/or fertilizer use efficiency of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs:475-770 and 6179-10421.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y (Sequence-Evolution-Function: Computational Approaches in Comparative Genomics. Boston: Kluwer Academic; 2003. Chapter 2, Evolutionary Concept in Genetics and Genomics. Available from: ncbi(dot)nlm(dot)nih (dot)gov/books/NBK20255) and therefore have great likelihood of having the same function.

One option to identify orthologues in monocot plant species is by performing a reciprocal Basic Local Alignment Search Tool (BLAST)® (The National Library of Medicine) search. This may be done by a first BLAST® involving BLAST® ing the sequence-of-interest against any sequence database, such as the publicly available NCBI database which may be found at: ncbi (dot) nlm (dot) nih (dot) gov. If orthologues in rice were sought, the sequence-of-interest would be BLAST® ed against, for example, the 28,469 full-length cDNA clones from *Oryza sativa* Nipponbare available at NCBI. The BLAST® results may be filtered. The full-length sequences of either the filtered results or the non-filtered results are then BLAST® ed back (second BLAST®) against the sequences of the organism from which the sequence-of-interest is derived. The results of the first and second BLAST® s are then compared. An orthologue is identified when the sequence resulting in the highest score (best hit) in the first BLAST® identifies in the second BLAST® the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

Homology (e.g., percent homology, identity+similarity) can be determined using any homology comparison software computing a pairwise sequence alignment.

Identity (e.g., percent homology) can be determined using any homology comparison software, including for example, the BLASTN® software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from http://biocceleration(dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from http://emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST® software with the BLASTP® and TBLASTN® algorithms as filters for the first stage, and the needle (EMBOSS package) or Frame+ algorithm alignment for the second stage. Local identity (BLAST® alignments) is defined with a very permissive cutoff—60% Identity on a span of 60% of the sequences lengths because it is used only as a filter for the global alignment stage. In this specific embodiment (when the local identity is used), the default filtering of the BLAST® package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the BLASTP® Filter):

EMBOSS-6.0.1 Needleman-Wunsch algorithm with the following modified parameters: gapopen=8 gapextend=2. The rest of the parameters are unchanged from the default options listed here:

Standard (Mandatory) Qualifiers:

```
[-asequence]    sequence    Sequence filename and optional format,
or reference (input USA)
[-bsequence]    seqall      Sequence(s) filename and optional format,
or reference (input USA)
```

-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)

-gapextend float [0.5 for any sequence]. The gap extension penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)

```
[-outfile]    align    [* .needle] Output alignment file name
```

Additional (Optional) Qualifiers:

-datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.

Advanced (Unprompted) Qualifiers:

```
-[no]brief    boolean    [Y] Brief identity and similarity
```

Associated Qualifiers:

```
"-asequence" associated qualifiers
  -sbegin1       integer   Start of the sequence to be used
  -send1         integer   End of the sequence to be used
  -sreverse1     boolean   Reverse (if DNA)
  -sask1         boolean   Ask for begin/end/reverse
  -snucleotide1  boolean   Sequence is nucleotide
  -sprotein1     boolean   Sequence is protein
  -slower1       boolean   Make lower case
  -supper1       boolean   Make upper case
  -sformat1      string    Input sequence format
  -sdbname1      string    Database name
  -sid1          string    Entryname
  -ufo1          string    UFO features
  -fformat1      string    Features format
  -fopenfile1    string    Features file name
"-bsequence" associated qualifiers
  -sbegin2       integer   Start of each sequence to be used
  -send2         integer   End of each sequence to be used
  -sreverse2     boolean   Reverse (if DNA)
  -sask2         boolean   Ask for begin/end/reverse
  -snucleotide2  boolean   Sequence is nucleotide
  -sprotein2     boolean   Sequence is protein
  -slower2       boolean   Make lower case
  -supper2       boolean   Make upper case
  -sformat2      string    Inputsequence format
  -sdbname2      string    Database name
  -sid2          string    Entryname
  -ufo2          string    UFO features
  -fformat2      string    Features format
  -fopenfile2    string    Features file name
"-outfile" associated qualifiers
  -aformat3      string    Alignment format
  -aextension3   string    File name extension
  -adirectory3   string    Output directory
  -aname3        string    Base file name
  -awidth3       integer   Alignment width
  -aaccshow3     boolean   Show accession number in the header
  -adesshow3     boolean   Show description in the header
  -ausashow3     boolean   Show the full USA in the alignment
  -aglobal3      boolean   Show the full sequence in alignment
```

General Qualifiers:

```
-auto        boolean   Turn off prompts
-stdout      boolean   Write first file to standard output
-filter      boolean   Read first file from standard input, write
                        first file to standard output
-options     boolean   Prompt for standard and additional values
-debug       boolean   Write debug output to program.dbg
-verbose     boolean   Report some/full command line options
-help        boolean   Report command line options. More
information on associated and general qualifiers can be
found with -help -verbose
-warning     boolean   Report warnings
-error       boolean   Report errors
-fatal       boolean   Report fatal errors
-die         boolean   Report dying program messages
```

2. Between a Protein Sequence and a Nucleotide Sequence (Following the TBLASTN® Filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:

Usage:

om -model=<model_fname>[-q=]query [-db=]database [options]

-model=<model_fname> Specifies the model that you want to run. All models supplied by Compugen are located in the directory $CGNROOT/models/.

Valid Command Line Parameters:

-dev=<dev_name> Selects the device to be used by the application.

Valid devices are:

bic—Bioccelerator (valid for SW, XSW, FRAME_N2P, and FRAME_P2N models).

xlg—BioXL/G (valid for all models except XSW).

xlp—BioXL/P (valid for SW, FRAME+_N2P, and FRAME_P2N models).

xlh—BioXL/H (valid for SW, FRAME+_N2P, and FRAME_P2N models).

soft—Software device (for all models).

-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.

-qacc Add this parameter to the command line if you specify query using accession numbers.

-dacc Add this parameter to the command line if you specify a database using accession numbers.

-dfmt/-qfmt=<format_type> Chooses the database/query format type. Possible formats are:
    fasta—fasta with seq type auto-detected.
    fastap—fasta protein seq.
    fastan—fasta nucleic seq.
    gcg—gcg format, type is auto-detected.
    gcg9seq—gcg9 format, type is auto-detected.
    gcg9seqp—gcg9 format protein seq.
    gcg9seqn—gcg9 format nucleic seq.
    nbrf—nbrf seq, type is auto-detected.
    nbrfp—nbrf protein seq.
    nbrfn—nbrf nucleic seq.
    embl—embl and swissprot format.
    genbank—genbank format (nucleic).
    BLAST®—BLAST® format.
    nbrf_gcg—nbrf-gcg seq, type is auto-detected.
    nbrf_gcgp—nbrf-gcg protein seq.
    nbrf_gcgn—nbrf-gcg nucleic seq.
    raw—raw ascii sequence, type is auto-detected.
    rawp—raw ascii protein sequence.
    rawn—raw ascii nucleic sequence.
    pir—pir codata format, type is auto-detected.
    profile—gcg profile (valid only for -qfmt
    in SW, XSW, FRAME_P2N, and FRAME+_P2N).

-out=<out_fname> The name of the output file.

-suffix=<name> The output file name suffix.

-gapop=<n> Gap open penalty. This parameter is not valid for FRAME+. For FrameSearch the default is 12.0. For other searches the default is 10.0.

-gapext=<n> Gap extend penalty. This parameter is not valid for FRAME+. For FrameSearch the default is 4.0. For other models: the default for protein searches is 0.05, and the default for nucleic searches is 1.0.

qgapop=<n> The penalty for opening a gap in the query sequence. The default is 10.0. Valid for XSW.

-qgapext=<n> The penalty for extending a gap in the query sequence. The default is 0.05. Valid for XSW.

-start=<n> The position in the query sequence to begin the search.

-end=<n> The position in the query sequence to stop the search.

-qtrans Performs a translated search, relevant for a nucleic query against a protein database. The nucleic query is translated to six reading frames and a result is given for each frame.
    Valid for SW and XSW.

-dtrans Performs a translated search, relevant for a protein query against a DNA database. Each database entry is translated to six reading frames and a result is given for each frame.
    Valid for SW and XSW.

Note: "-qtrans" and "-dtrans" options are mutually exclusive.

-matrix=<matrix_file> Specifies the comparison matrix to be used in the search. The matrix must be in the BLAST® format. If the matrix file is not located in $CGNROOT/tables/matrix, specify the full path as the value of the -matrix parameter.

-trans=<transtab_name> Translation table. The default location for the table is $CGNROOT/tables/trans.

-onestrand Restricts the search to just the top strand of the query/database nucleic sequence.

-list=<n> The maximum size of the output hit list. The default is 50.

-docalign=<n> The number of documentation lines preceding each alignment. The default is 10.

-thr_score=<score_name> The score that places limits on the display of results. Scores that are smaller than -thr_min value or larger than -thr_max value are not shown. Valid options are: quality.
    zscore.
    escore.

-thr_max=<n> The score upper threshold. Results that are larger than -thr_max value are not shown.

-thr_min=<n> The score lower threshold. Results that are lower than -thr_min value are not shown.

-align=<n> The number of alignments reported in the output file.

-noalign Do not display alignment.

Note: "-align" and "-noalign" parameters are mutually exclusive.

-outfmt=<format_name> Specifies the output format type. The default format is PFS.
Possible values are:
    PFS—PFS text format
    FASTA—FASTA text format
    BLAST®—BLAST® text format -nonorm Do not perform score normalization.

-norm=<norm_name> Specifies the normalization method. Valid options are:
    log—logarithm normalization.
    std—standard normalization.
    stat—Pearson statistical method.

Note: "-nonorm" and "-norm" parameters cannot be used together.

Note: Parameters -xgapop, -xgapext, -fgapop, -fgapext, -ygapop, -ygapext, -delop, and -delext apply only to FRAME+.

-xgapop=<n> The penalty for opening a gap when inserting a codon (triplet). The default is 12.0.

-xgapext=<n> The penalty for extending a gap when inserting a codon (triplet). The default is 4.0.

-ygapop=<n> The penalty for opening a gap when deleting an amino acid. The default is 12.0.

-ygapext=<n> The penalty for extending a gap when deleting an amino acid. The default is 4.0.

-fgapop=<n> The penalty for opening a gap when inserting a DNA base. The default is 6.0.

-fgapext=<n> The penalty for extending a gap when inserting a DNA base. The default is 7.0.

-delop=<n> The penalty for opening a gap when deleting a DNA base. The default is 6.0.

-delext=<n> The penalty for extending a gap when deleting a DNA base. The default is 7.0.

-silent No screen output is produced.

-host=<host_name> The name of the host on which the server runs. By default, the application uses the host specified in the file $CGNROOT/cgnhosts.

-wait Do not go to the background when the device is busy. This option is not relevant for the Parseq or Soft pseudo device.

batch Run the job in the background. When this option is specified, the file "$CGNROOT/defaults/batch.defaults" is used for choosing the batch command. If this file does not exist, the command "at now" is used to run the job.

Note: "-batch" and "-wait" parameters are mutually exclusive.

-version Prints the software version number.
-help Displays this help message. To get more specific help type:
"om -model=<model_fname>-help".

According to some embodiments the homology is a local homology or a local identity.

Local alignments tools include, but are not limited to the BLASTP®, BLASTN®, BLASTX® or TBLASTN® software of the National Center of Biotechnology Information (NCBI), FASTA, and the Smith-Waterman algorithm.

A TBLASTN® search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST® databases EST and HTGs, respectively.

Default parameters for BLASTP® include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX® algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 475-770 and 6179-10421.

According to some embodiments of the invention, the method of increasing abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of a plant is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 475-770 and 6179-10421, thereby increasing the abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of the plant.

According to some embodiments of the invention, the exogenous polynucleotide encodes a polypeptide consisting of the amino acid sequence set forth by SEQ ID NO: 475-770, 6179-10420 or 10421.

According to an aspect of some embodiments of the invention, the method of increasing abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of a plant, is effected by expressing within the plant an exogenous polynucleotide comprising a nucleic acid sequence encoding a polypeptide comprising an amino acid sequence selected from the group consisting of SEQ ID NOs: 475-770 and 6179-10421, thereby increasing the abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of the plant.

According to an aspect of some embodiments of the invention, there is provided a method of increasing abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of a plant, comprising expressing within the plant an exogenous polynucleotide comprising a nucleic acid sequence encoding a polypeptide selected from the group consisting of SEQ ID NOs: 475-770 and 6179-10421, thereby increasing the abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of the plant.

According to some embodiments of the invention, the exogenous polynucleotide encodes a polypeptide consisting of the amino acid sequence set forth by SEQ ID NO: 475-770 and 6179-10421.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-474 and 771-6178.

According to an aspect of some embodiments of the invention, there is provided a method of increasing abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-474 and 771-6178, thereby increasing the abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-474 and 771-6178.

According to some embodiments of the invention the exogenous polynucleotide is set forth by SEQ ID NO: 1-474, 771-6177 or 6178.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example WO publication 93/07278 (Koziel M., et al.).

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 217, 218, 261, 262, 473, 474, 2066, 2827, 2886, 3165, 3166, 3167, 3168, 3180, 3181, 3213, 3215, 5247, 6108, 6163.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-474 and 771-6178.

According to some embodiments of the invention the nucleic acid sequence is capable of increasing abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of a plant.

According to some embodiments of the invention the isolated polynucleotide comprising the nucleic acid sequence selected from the group consisting of SEQ ID NOs: 1-474 and 771-6178.

According to some embodiments of the invention the isolated polynucleotide is set forth by SEQ ID NO: 1-474, 771-6177 or 6178.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 475-770, 6179-10420 or 10421.

According to some embodiments of the invention the amino acid sequence is capable of increasing abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency) of a plant.

The invention provides an isolated polynucleotide comprising a nucleic acid sequence encoding a polypeptide which comprises the amino acid sequence selected from the group consisting of SEQ ID NOs: 475-770 and 6179-10421.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 475-770 and 6179-10421.

According to some embodiments of the invention, the polypeptide comprising an amino acid sequence selected from the group consisting of SEQ ID NOs: 475-770 and 6179-10421.

According to some embodiments of the invention, the polypeptide is set forth by SEQ ID NO: 475-770 and 6179-10421.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficil-*

*lata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp., *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the some embodiments of invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 10422; Albani et al, Plant Cell, 9: 171-184, 1997, which is fully incorporated herein by reference), wheat LMW (SEQ ID NO: 10423 (longer LMW promoter), and SEQ ID NO: 10424 (LMW promoter) and HMW glutenin-1 (SEQ ID NO: 10425 (Wheat HMW glutenin-1 longer promoter); and SEQ ID NO: 10426 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 10427 (wheat alpha gliadin, B genome promoter); SEQ ID NO: 10428 (wheat gamma gliadin promoter); EMBO 3:1409-15, 1984, which is fully incorporated herein by reference], wheat TdPR60 [SEQ ID NO:10429 (wheat TdPR60 longer promoter) or SEQ ID NO:10430 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO:10431); GenBank: DQ141598.1; Taylor et al., Plant Cell Rep 1993 12: 491-495, which is fully incorporated herein by reference; and cultivar B73 (SEQ ID NO:10432); Christensen, A H, et al. Plant Mol. Biol. 18 (4), 675-689 (1992), which is fully incorporated herein by reference]; rice actin 1 (SEQ ID NO:10433; Mc Elroy et al. 1990, The Plant Cell, Vol. 2, 163-171, which is fully incorporated herein by reference), rice GOS2 [SEQ ID NO: 10434 (rice GOS2 longer promoter) and SEQ ID NO: 10435 (rice GOS2 Promoter); De Pater et al. Plant J. 1992; 2: 837-44, which is fully incorporated herein by reference], *Arabidopsis* Pho1 [SEQ ID NO: 10436 (*Arabidopsis* Pho1 Promoter); Hamburger et al., Plant Cell. 2002; 14: 889-902, which is fully incorporated herein by reference], ExpansinB promoters, e.g., rice ExpB5 [SEQ ID NO:10437 (rice ExpB5 longer promoter) and SEQ ID NO: 10438 (rice ExpB5 promoter)] and Barley ExpB1 [SEQ ID NO: 10439 (barley ExpB1 Promoter), Won et al. Mol Cells. 2010; 30:369-76, which is fully incorporated herein by reference], barley SS2 (sucrose synthase 2) [(SEQ ID NO: 10440), Guerin and Carbonero, *Plant Physiology May* 1997 vol. 114 no. 1 55-62, which is fully incorporated herein by reference], and rice PG5a [SEQ ID NO:10441, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 10442 (CaMV 35S (QFNC) Promoter); SEQ ID NO: 10443 (PJJ 35S from Brachypodium); SEQ ID NO: 10444 (CaMV 35S (OLD) Promoter) (Odell et al., Nature 313:810-812, 1985)], *Arabidopsis* At6669 promoter (SEQ ID NO: 10445 (*Arabidopsis* At6669 (OLD) Promoter); see PCT Publication No. WO04081173A2 or the new At6669 promoter (SEQ ID NO: 10446 (*Arabidopsis* At6669 (NEW) Promoter)); maize Ub1

Promoter [cultivar Nongda 105 (SEQ ID NO:10431); GenBank: DQ141598.1; Taylor et al., Plant Cell Rep 1993 12: 491-495, which is fully incorporated herein by reference; and cultivar B73 (SEQ ID NO:10432); Christensen, A H, et al. Plant Mol. Biol. 18 (4), 675-689 (1992), which is fully incorporated herein by reference]; rice actin 1 (SEQ ID NO: 10433, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 10434 (rice GOS2 longer Promoter) and SEQ ID NO: 10435 (rice GOS2 Promoter), de Pater et al, Plant J November; 2(6):837-44, 1992]; RBCS promoter (SEQ ID NO:10447); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 10448), AT5G61520 (AtSTP3) (low expression, SEQ ID NO: 10449) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 10450 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 10441; U.S. Pat. No. 7,700,835), early seed development *Arabidopsis* BAN (AT1G61720) (SEQ ID NO: 10451, US 2009/0031450 A1), late seed development *Arabidopsis* ABI3 (AT3G24650) (SEQ ID NO: 10452, *Arabidopsis* ABI3 (AT3G24650) longer Promoter) or SEQ ID NO: 10453 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143).323-32 1990), napA (Stalberg, et al, Planta 199: 515-519, 1996), Wheat SPA (SEQ ID NO:10422; Albani et al, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 10423 (Wheat LMW Longer Promoter), and SEQ ID NO: 10424 (Wheat LMW Promoter) and HMW glutenin-1 [(SEQ ID NO: 10425 (Wheat HMW glutenin-1 longer Promoter)); and SEQ ID NO: 10426 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 10427 (wheat alpha gliadin (B genome) promoter); SEQ ID NO: 10428 (wheat gamma gliadin promoter); EMBO 3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 10440 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis apetala*-3 (Tilly et al., Development. 125:1647-57, 1998), *Arabidopsis APETALA* 1 (AT1G69120, AP1) (SEQ ID NO: 10454 (*Arabidopsis* (AT1G69120) *APETALA* 1)) (Hempel et al., Development 124:3845-3853, 1997)], and root promoters [e.g., the ROOTP promoter [SEQ ID NO: 10455]; rice ExpB5 (SEQ ID NO:10438 (rice ExpB5 Promoter); or SEQ ID NO: 10437 (rice ExpB5 longer Promoter)) and barley ExpB1 promoters (SEQ ID NO:10439) (Won et al. Mol. Cells 30: 369-376, 2010); *Arabidopsis* ATTPS-CIN (AT3G25820) promoter (SEQ ID NO: 10456; Chen et al., Plant Phys 135:1956-66, 2004); *Arabidopsis* Pho1 promoter (SEQ ID NO: 10436, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, N.Y.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase nitrogen use efficiency, fertilizer use efficiency, oil content, yield, seed yield, fiber yield, fiber quality, fiber length, growth rate, photosynthetic capacity, biomass, vigor, water use efficiency, and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, fertilizer use efficiency, oil content, yield, seed yield, fiber yield, fiber quality, fiber length, growth rate, photosynthetic capacity, biomass, vigor, water use efficiency, and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest [e.g., abiotic stress tolerance, water use efficiency, growth rate, vigor, biomass, oil content, yield, seed yield, fiber yield, fiber quality, fiber length, photosynthetic capacity, and/or fertilizer use efficiency (e.g., nitrogen use efficiency)]. Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 475-770 and 6179-10421, wherein said plant is derived from a plant selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 475-770 and 6179-10421, wherein the crop plant is derived from plants selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-474 and 771-6178, wherein said plant is derived from a plant selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 1-474 and 771-6178, wherein the crop plant is derived from plants selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence set forth in SEQ ID NO: 475-770 and 6179-10421, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence set forth in SEQ ID NO: 1-474 and 771-6178, wherein the plant is derived from plants selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

The effect of the transgene (the exogenous polynucleotide encoding the polypeptide) on abiotic stress tolerance can be determined using known methods such as detailed below and in the Examples section which follows.

Abiotic Stress Tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought Tolerance Assay/Osmoticum Assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control Arabidopsis plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

The maintenance of a phenotype under drought condition as compared to normal conditions can be determined as the "RATIO Drought/Normal", which represents ratio for the specified parameter of Drought condition results (measured parameter under Drought) divided by measured parameter under Normal conditions.

Cold Stress Tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \quad \text{Formula I}$$

Fertilizer Use Efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency Assay Using Plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5× MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen Determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination Tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant Vigor—The plant vigor can be calculated by the increase in growth parameters such as leaf area, fiber length, rosette diameter, plant fresh weight and the like per time.

Growth Rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area (RGR) can be calculated using Formula II.

$$\text{Relative growth rate area}=\text{Regression coefficient of area along time course} \quad \text{Formula II:}$$

Thus, the relative growth area rate is in units of area units (e.g., $mm^2$/day or $cm^2$/day) and the length growth rate is in units of length units (e.g., cm/day or mm/day).

For example, RGR can be determined for plant height (Formula IX), SPAD (Formula XIII), Number of tillers (Formula XIV), root length (Formula XVII), vegetative growth (Formula XVII), leaf number (Formula XXI), rosette area (Formula XXII), rosette diameter (Formula XXIII), plot coverage (Formula XXIV), leaf blade area (Formula XX), and leaf area (Formula XXVI).

Relative growth rate of Plant height=Regression coefficient of Plant height along time course (measured in cm/day).      Formula IX:

Relative growth rate of SPAD=Regression coefficient of SPAD measurements along time course.      Formula XIII:

Relative growth rate of Number of tillers=Regression coefficient of Number of tillers along time course (measured in units of "number of tillers/day").      Formula XIV:

Relative growth rate of root length=Regression coefficient of root length along time course (measured in cm per day).      Formula XVII:

Vegetative growth rate analysis—was calculated according to Formula XVII below.

Relative growth rate of vegetative growth=Regression coefficient of leaf area along time course (measured in $cm^2$ per day).      Formula XVII:

Relative growth rate of leaf number=Regression coefficient of leaf number along time course (measured in number per day).      Formula XXI:

Relative growth rate of rosette area=Regression coefficient of rosette area along time course (measured in $cm^2$ per day).      Formula XXII:

Relative growth rate of rosette diameter=Regression coefficient of rosette diameter along time course (measured in cm per day).      Formula XXIII:

Relative growth rate of plot coverage=Regression coefficient of plot (measured in $cm^2$ per day).      Formula XXIV:

Relative growth rate of leaf blade area=Regression coefficient of leaf area along time course (measured in $cm^2$ per day).      Formula XX:

Relative growth rate of leaf area=Regression coefficient of leaf area along time course (measured in $cm^2$ per day).      Formula XXVI:

Seed Yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000      Formula III:

The Harvest Index can be calculated using Formulas IV, V, VIII and XI below.

Harvest Index (seed)=Average seed yield per plant/Average dry weight      Formula IV:

Harvest Index (*Sorghum*)=Average grain dry weight per Head/(Average vegetative dry weight per Head+Average Head dry weight)      Formula V:

Harvest Index (Maize)=Average grain weight per plant/(Average vegetative dry weight per plant plus Average grain weight per plant)      Formula VIII:

Harvest Index (for barley)—The harvest index is calculated using Formula XI.

Harvest Index (barley)=Average spike dry weight per plant/(Average vegetative dry weight per plant+Average spike dry weight per plant)      Formula XI:

Following is a non-limited list of additional parameters which can be detected in order to show the effect of the transgene on the desired plant's traits.

Grain circularity=4×3.14 (grain area/$perimeter^2$)      Formula VI:

internode volume=3.14×$(d/2)^2$×1      Formula VII:

Normalized ear weight per plant+vegetative dry weight.      Formula X:

Root/Shoot Ratio=total weight of the root at harvest/total weight of the vegetative portion above ground at harvest.      Formula XII:

Ratio of the number of pods per node on main stem at pod set=Total number of pods on main stem/Total number of nodes on main stem, average of three plants per plot.      Formula XV:

Ratio of total number of seeds in main stem to number of seeds on lateral branches=Total number of seeds on main stem at pod set/Total number of seeds on lateral branches at pod set.      Formula XVI:

Petiole Relative Area=(Petiol area)/Rosette area (measured in %).      Formula XXV:

Grain Protein Concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber Length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/Classification-ofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil Content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Seed Oil yield can be calculated as follows: Seed yield per plant (gr.)*Oil % in seed.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptom which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Bio-Informatics Tools for Identification of Genes which Increase Abiotic Stress Tolerance, Yield and Agronomical Important Traits in Plants The present inventors have identified polynucleotides which upregulation of expression thereof can increase abiotic stress tolerance (ABST), water use efficiency (WUE), yield, oil content, growth rate, vigor, biomass, fiber yield and quality, nitrogen use efficiency (NUE), and fertilizer use efficiency (FUE) of a plant.

All nucleotide sequence datasets used here were originated from publicly available databases or from performing sequencing using the Solexa technology (e.g. Barley and

*Sorghum*). Sequence data from 100 different plant species was introduced into a single, comprehensive database. Other information on gene expression, protein annotation, enzymes and pathways were also incorporated. Major databases used include:

Genomes

*Arabidopsis* genome [TAIR genome version 6 (Hypertext Transfer Protocol://World Wide Web (dot) arabidopsis (dot) org/)]

Rice genome [IRGSP build 4.0 (Hypertext Transfer Protocol://rgp (dot) dna (dot) affrc (dot) go (dot) jp/IR-GSP/)].

Poplar [*Populus trichocarpa* release 1.1 from JGI (assembly release v1.0) (Hypertext Transfer Protocol://World Wide Web (dot) genome (dot) jgi-psf (dot) org/)]

Brachypodium [JGI 4× assembly, Hypertext Transfer Protocol://World Wide Web (dot) brachpodium (dot) org)]

Soybean [DOE-JGI SCP, version Glyma0 (Hypertext Transfer Protocol://World Wide Web (dot) phytozome (dot) net/)]

Grape [French-Italian Public Consortium for Grapevine Genome Characterization grapevine genome (Hypertext Transfer Protocol:// World Wide Web (dot) genoscope (dot) cns (dot) fr/)]

Castobean [TIGR/J Craig Venter Institute 4× assembly [(Hypertext Transfer Protocol://msc (dot) jcvi (dot) org/r_communis]

*Sorghum* [DOE-JGI SCP, version Sbi1 [Hypertext Transfer Protocol://World Wide Web (dot) phytozome (dot) net/)].

Partially assembled genome of Maize [Hypertext Transfer Protocol://maizesequence (dot) org/]

Expressed EST and mRNA Sequences were Extracted from the Following Databases:

GenBank versions 154, 157, 160, 161, 164, 165, 166 and 168 (Hypertext Transfer Protocol://World Wide Web (dot) ncbi (dot) nlm (dot) nih (dot) gov/dbEST/)

RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) arabidopsis (dot) org/).

Protein and Pathway Databases

Uniprot [Hypertext Transfer Protocol://World Wide Web (dot) uniprot (dot) orga

AraCyc [Hypertext Transfer Protocol://World Wide Web (dot) arabidopsis (dot) org/biocyc/index (dot) jsp].

ENZYME [Hypertext Transfer Protocol://expasy (dot) org/enzyme/].

Microarray Datasets were Downloaded from:

GEO (Hypertext Transfer Protocol://World Wide Web (dot)ncbi(dot)nlm(dot)nih(dot)gov/geo/)

TAR (Hypertext Transfer Protocol://World Wide Web (dot)arabidopsis(dot)org/).

Proprietary microarray data (WO2008/122980 and Example 2 below).

QTL and SNPs Information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*Arabidopsis*, rice, castorbean, grape, brachypodium, poplar, soybean, *Sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

BLAST® search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

BLAST® against proteins from AraCyc and ENZYME databases was used to map the predicted transcripts to AraCyc pathways.

Predicted proteins from different species were compared using BLAST® algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for AB ST, increased yield, growth rate, vigor, biomass, oil content, WUE, NUE and FUE of a plant.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Example 2

Production of Sorghum Transcriptom and High Throughput Correlation Analysis with Yield, NUE, and ABST Related Parameters Measured in Fields Using 44K Sorghum Oligonucleotide Micro-Arrays In order to produce a high throughput correlation analysis between plant phenotype and gene expression level, the present inventors utilized a Sorghum oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Sorghum genes and transcripts. In order to define correlations between the levels of RNA expression with ABST, yield and NUE components or vigor related parameters, various plant characteristics of 17 different Sorghum hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Sorghum Varieties Across Ecotypes Grown Under Regular Growth Conditions, Severe Drought Conditions and Low Nitrogen Conditions Experimental Procedures 17 Sorghum varieties were grown in 3 repetitive plots, in field. Briefly, the growing protocol was as follows:

1. Regular growth conditions: Sorghum plants were grown in the field using commercial fertilization and irrigation protocols, which include 370 m$^3$ water per dunam (1000 m$^2$) per entire growth period and fertilization of 14 units of URAN® 21% (Nitrogen Fertilizer Solution; PCS Sales, Northbrook, Ill., USA) (normal growth conditions).

2. Drought conditions: Sorghum seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: Sorghum plants were fertilized with 50% less amount of nitrogen in the field than the amount of nitrogen applied in the regular growth treatment. All the fertilizer was applied before flowering.

Analyzed sorghum tissues—All 10 selected Sorghum hybrids were sample per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 1 below.

TABLE 1

Sorghum transcriptom expression sets in field experiments

| Expression Set | Set ID |
|---|---|
| Sorghum field/flag leaf/Drought | 1 |
| Sorghum field/flag leaf/Low N | 2 |
| Sorghum field/flag leaf/Normal | 3 |
| Sorghum field/flower meristem/Drought | 4 |
| Sorghum field/flower meristem/Low N | 5 |
| Sorghum field/flower meristem/Normal | 6 |
| Sorghum field/flower/Drought | 7 |
| Sorghum field/flower/Low N | 8 |
| Sorghum field/flower/Normal | 9 |

Table 1: Provided are the sorghum transcriptom expression sets.
Flag leaf = the leaf below the flower;
Flower meristem = Apical meristem following panicle initiation;
Flower = the flower at the anthesis day.

The following parameters were collected using digital imaging system:

Average grain area (cm$^2$)—At the end of the growing period the grains were separated from the Plant 'Head'. A sample of ~200 grains were weighted, photographed and images were processed using the below described image processing system. The grain area was measured from those images and was divided by the number of grains.

Upper and lower ratio average of grain area, width, length, diameter and perimeter—Grain projection of area, width, length, diameter and perimeter were extracted from the digital images using open source package imagej (nih). Seed data was analyzed in plot average levels as follows:

Average of all seeds.

Average of upper 20% fraction—contained upper 20% fraction of seeds.

Average of lower 20% fraction—contained lower 20% fraction of seeds.

Further on, ratio between each fraction and the plot average was calculated for each of the data parameters.

At the end of the growing period 5 'Heads' were, photographed and images were processed using the below described image processing system.

Average grain length (cm)—At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Head average area (cm$^2$)—At the end of the growing period 5 'Heads' were photographed and images were processed using the below described image processing system. The 'Head' area was measured from those images and was divided by the number of 'Heads'.

Head average length (cm)—At the end of the growing period 5 'Heads' were photographed and images were processed using the below described image processing system. The 'Head' length (longest axis) was measured from those images and was divided by the number of 'Heads'.

Head average width (cm)—At the end of the growing period 5 'Heads' were photographed and images were processed using the below described image processing system. The 'Head' width was measured from those images and was divided by the number of 'Heads'.

Head average perimeter (cm)—At the end of the growing period 5 'Heads' were photographed and images were processed using the below described image processing system. The 'Head' perimeter was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total seed weight per head (Grain yield) (gr.)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW (fresh weight) head per plant (gr.)—At the end of the experiment (when heads were harvested) total heads and 5 selected heads per plots within blocks A-C were collected separately. The heads (total and 5) were weighted (gr.) separately, and the average fresh weight per plant was calculated for total (FW Head/Plant gr. based on plot) and for 5 heads (FW Head/Plant gr. based on 5 plants).

Plant height—Plants were characterized for height during growing period at 5 time points. In each measure, plants were measured for their height using a measuring tape. Height was measured from ground level to top of the longest leaf.

Plant leaf number—Plants were characterized for leaf number during growing period at 5 time points. In each measure, plants were measured for their leaf number by counting all the leaves of 3 selected plants per plot.

SPAD [SPAD unit]—Chlorophyll content was determined using a Minolta SPAD 502 chlorophyll meter and measurement was performed 64 days post sowing. SPAD meter readings were done on young fully developed leaves. Three measurements per leaf were taken per plot.

Vegetative fresh weight and heads—At the end of the experiment (when inflorescence were dry) all inflorescence and vegetative material from plots within blocks A-C were collected. The biomass and heads weight of each plot was separated, measured and divided by the number of heads.

Plant biomass (fresh weight)—At the end of the experiment (when inflorescence were dry) the vegetative material from plots within blocks A-C were collected. The plants biomass without the inflorescence were measured and divided by the number of plants.

FW (fresh weight) heads/(FW Heads+FW Plants)—The total fresh weight of heads and their respective plant biomass were measured at the harvest day. The heads weight was divided by the sum of weights of heads and plants.

Dry weight=total weight of the vegetative portion above ground (excluding roots) after drying at 70° C. in oven for 48 hours;

Harvest Index (HI) (*Sorghum*)—The harvest index was calculated using Formula V.

Harvest Index (*Sorghum*)=Average grain dry weight per Head/(Average vegetative dry weight per Head+Average Head dry weight)   Formula V Data parameters collected are summarized in Table 2, herein below

TABLE 2

*Sorghum* correlated parameters (vectors)

| Correlated parameter with | Correlation ID |
|---|---|
| Average Grain Area (cm$^2$), Drought | 1 |
| Average Grain Area (cm$^2$), Low Nitrogen (N) | 2 |
| Average Grain Area (cm$^2$), Normal | 3 |
| FW - Head/Plant (gr.) (based on plot), Drought | 4 |
| FW - Head/Plant (gr.) (based on plot), Low N | 5 |
| FW - Head/Plant (gr.) (based on plot), Normal | 6 |
| FW - Head/Plant (gr.) (based on 5 plants), Low N | 7 |
| FW - Head/Plant (gr.) (based on 5 plants), Normal | 8 |
| FW Heads/(FW Heads + FW Plants) (all plot), Drought | 9 |
| FW Heads/(FW Heads + FW Plants) (all plot), Low N | 10 |
| FW Heads/(FW Heads + FW Plants) (all plot), Normal | 11 |
| FW/Plant gr (based on plot), Drought | 12 |
| FW/Plant gr (based on plot), Low N | 13 |
| FW/Plant gr (based on plot), Normal | 14 |
| Final Plant Height (cm), Drought | 15 |
| Final Plant Height (cm), Low N | 16 |
| Final Plant Height (cm), Normal | 17 |
| Head Average Area (cm$^2$), Drought | 18 |
| Head Average Area (cm$^2$), Low N | 19 |
| Head Average Area (cm$^2$), Normal | 20 |
| Head Average Length (cm), Drought | 21 |
| Head Average Length (cm), Low N | 22 |
| Head Average Length (cm), Normal | 23 |
| Head Average Perimeter (cm), Drought | 24 |
| Head Average Perimeter (cm), Low N | 25 |
| Head Average Perimeter (cm), Normal | 26 |
| Head Average Width (cm), Drought | 27 |
| Head Average Width (cm), Low N | 28 |
| Head Average Width (cm), Normal | 29 |
| Leaf 64 DPS (Days Post Sowing), Drought (SPAD unit) | 30 |
| Leaf SPAD 64 DPS (Days Post Sowing), Low N (SPAD unit) | 31 |
| Leaf SPAD 64 DPS (Days Post Sowing), Normal (SPAD unit) | 32 |
| Lower Ratio Average Grain Area, Low N | 33 |
| Lower Ratio Average Grain Area, Normal | 34 |
| Lower Ratio Average Grain Length, Low N | 35 |
| Lower Ratio Average Grain Length, Normal | 36 |
| Lower Ratio Average Grain Perimeter, Low N | 37 |
| Lower Ratio Average Grain Perimeter, Normal | 38 |
| Lower Ratio Average Grain Width, Low N | 39 |
| Lower Ratio Average Grain Width, Normal | 40 |
| Total grain weight/Head (based on plot) (gr.), Low N | 41 |
| Total grain weight/Head (based on 5 heads) (gr.), Low N | 42 |

TABLE 2-continued

Sorghum correlated parameters (vectors)

| Correlated parameter with | Correlation ID |
|---|---|
| Total grain weight/Head (based on 5 heads) (gr.), Normal | 43 |
| Total grain weight/Head (based on plot) (gr.), Normal | 44 |
| Total grain weight/Head (based on plot) (gr.) Drought | 45 |
| Upper Ratio Average Grain Area, Drought | 46 |
| Upper Ratio Average Grain Area, Low N | 47 |
| Upper Ratio Average Grain Area, Normal | 48 |
| [Grain Yield + plant biomass/SPAD 64 DPS], Normal | 49 |
| [Grain Yield + plant biomass/SPAD 64 DPS], Low N | 50 |
| [Grain yield/SPAD 64 DPS], Low N | 51 |
| [Grain yield/SPAD 64 DPS], Normal | 52 |
| [Plant biomass (FW)/SPAD 64 DPS], Drought | 53 |
| [Plant biomass (FW)/SPAD 64 DPS], Low N | 54 |
| [Plant biomass (FW)/SPAD 64 DPS], Normal | 55 |

Table 2. Provided are the Sorghum correlated parameters (vectors).
"gr." = grams;
"SPAD" = chlorophyll levels;
"FW" = Plant Fresh weight;
"DW" = Plant Dry weight;
"normal" = standard growth conditions;
"DPS" = days post-sowing;
"Low N" = Low Nitrogen conditions;
"Head FW" = fresh weight of the harvested heads was divided by the number of heads that were phenotyped;
"Lower Ratio Average Grain Area" = grain area of the lower fraction of grains.

Experimental Results 17 different Sorghum hybrids were grown and characterized for different parameters (Table 2). The average for each of the measured parameter was calculated using the JMP software (Tables 3-8) and a subsequent correlation analysis was performed (Table 9). Results were then integrated to the database.

TABLE 3

Measured parameters in Sorghum accessions under normal conditions

| Line | Corr. ID 3 | 6 | 8 | 11 | 14 | 17 | 20 | 23 | 26 | 29 | 32 |
|---|---|---|---|---|---|---|---|---|---|---|---|
| Line-1 | 0.10 | 175.15 | 406.50 | 0.51 | 162.56 | 95.25 | 120.14 | 25.58 | 61.22 | 5.97 | 43.01 |
| Line-2 | 0.11 | 223.49 | 518.00 | 0.51 | 212.59 | 79.20 | 167.60 | 26.84 | 67.90 | 7.92 | . |
| Line-3 | 0.13 | 56.40 | 148.00 | 0.12 | 334.83 | 197.85 | 85.14 | 21.02 | 56.26 | 4.87 | 43.26 |
| Line-4 | 0.13 | 111.62 | 423.00 | 0.26 | 313.46 | 234.20 | 157.26 | 26.84 | 65.38 | 7.43 | 44.74 |
| Line-5 | 0.14 | 67.34 | 92.00 | 0.12 | 462.28 | 189.40 | 104.00 | 23.14 | 67.46 | 5.58 | 45.76 |
| Line-6 | 0.14 | 66.90 | 101.33 | 0.18 | 318.26 | 194.67 | 102.48 | 21.82 | 67.46 | 5.88 | 41.61 |
| Line-7 | 0.11 | 126.18 | 423.50 | 0.46 | 151.13 | 117.25 | 168.54 | 31.33 | 74.35 | 6.78 | 45.21 |
| Line-8 | 0.11 | 107.74 | 386.50 | 0.43 | 137.60 | 92.80 | 109.32 | 23.18 | 56.16 | 5.99 | 45.14 |
| Line-9 | 0.10 | 123.86 | 409.50 | 0.42 | 167.98 | 112.65 | 135.13 | 25.70 | 61.64 | 6.62 | 43.03 |
| Line-10 | 0.12 | 102.75 | 328.95 | 0.44 | 128.97 | 97.50 | 169.03 | 28.82 | 71.40 | 7.42 | 45.59 |
| Line-11 | 0.12 | 82.33 | 391.00 | 0.46 | 97.62 | 98.00 | 156.10 | 28.13 | 68.56 | 6.98 | 44.83 |
| Line-12 | 0.11 | 77.59 | 435.75 | 0.45 | 99.32 | 100.00 | 112.14 | 22.97 | 56.44 | 6.19 | 45.33 |
| Line-13 | 0.12 | 91.17 | 429.50 | 0.45 | 112.24 | 105.60 | 154.74 | 28.09 | 67.79 | 7.02 | 46.54 |
| Line-14 | 0.11 | 150.44 | 441.00 | 0.51 | 157.42 | 151.15 | 171.70 | 30.00 | 71.54 | 7.18 | 43.99 |
| Line-15 | 0.10 | 109.10 | 415.75 | 0.46 | 130.55 | 117.10 | 168.51 | 30.54 | 78.94 | 7.00 | 45.09 |
| Line-16 | 0.11 | 107.58 | 429.50 | 0.44 | 135.66 | 124.45 | 162.51 | 27.17 | 67.03 | 7.39 | 45.14 |
| Line-17 | 0.11 | 130.88 | 428.50 | 0.39 | 209.21 | 126.50 | 170.46 | 29.26 | 74.11 | 7.35 | 43.13 |

Table 3: Provided are the values of each of the parameters (as described above) measured in Sorghum accessions (Seed ID) under normal conditions. Growth conditions are specified in the experimental procedure section.

TABLE 4

Additional measured parameters in Sorghum accessions under normal growth conditions

| Line | Corr. ID 34 | 36 | 38 | 40 | 43 | 44 | 48 | 49 | 52 | 55 |
|---|---|---|---|---|---|---|---|---|---|---|
| Line-1 | 0.83 | 0.91 | 0.91 | 0.91 | 47.40 | 31.12 | 1.22 | 4.50 | 3.78 | 0.72 |
| Line-2 | 0.74 | 0.88 | 0.87 | 0.83 | 46.30 | 26.35 | 1.30 | 8.17 | 7.74 | 0.43 |
| Line-3 | 0.78 | 0.92 | 0.91 | 0.85 | 28.37 | 18.72 | 1.13 | 7.87 | 7.01 | 0.86 |
| Line-4 | 0.80 | 0.91 | 0.95 | 0.87 | 70.40 | 38.38 | 1.14 | 10.68 | 10.10 | 0.58 |
| Line-5 | 0.70 | 0.89 | 0.90 | 0.79 | 32.15 | 26.67 | 1.16 | 8.34 | 7.65 | 0.69 |
| Line-6 | 0.70 | 0.88 | 0.91 | 0.80 | 49.23 | 28.84 | 1.15 | 4.40 | 3.34 | 1.05 |
| Line-7 | 0.83 | 0.91 | 0.91 | 0.90 | 63.45 | 47.67 | 1.19 | 3.74 | 3.05 | 0.69 |
| Line-8 | 0.81 | 0.90 | 0.91 | 0.89 | 44.45 | 31.00 | 1.23 | 4.83 | 3.90 | 0.93 |
| Line-9 | 0.84 | 0.92 | 0.92 | 0.91 | 56.65 | 39.99 | 1.25 | 3.67 | 2.83 | 0.84 |
| Line-10 | 0.79 | 0.92 | 0.93 | 0.85 | 60.00 | 38.36 | 1.24 | 2.89 | 2.18 | 0.72 |
| Line-11 | 0.77 | 0.89 | 0.91 | 0.86 | 45.45 | 32.10 | 1.32 | 2.91 | 2.19 | 0.72 |
| Line-12 | 0.80 | 0.91 | 0.92 | 0.88 | 58.19 | 32.69 | 1.22 | 3.12 | 2.41 | 0.70 |
| Line-13 | 0.81 | 0.91 | 0.90 | 0.90 | 70.60 | 32.79 | 1.18 | 4.75 | 3.58 | 1.17 |
| Line-14 | 0.82 | 0.91 | 0.91 | 0.90 | 70.10 | 51.53 | 1.18 | 3.69 | 2.90 | 0.79 |
| Line-15 | 0.81 | 0.90 | 0.90 | 0.91 | 53.95 | 35.71 | 1.22 | 3.85 | 3.01 | 0.85 |

TABLE 4-continued

Additional measured parameters in *Sorghum* accessions under normal growth conditions

| Line | \multicolumn{10}{c}{Corr. ID} | | | | | | | | | |
|---|---|---|---|---|---|---|---|---|---|---|
|  | 34 | 36 | 38 | 40 | 43 | 44 | 48 | 49 | 52 | 55 |
| Line-16 | 0.82 | 0.90 | 0.91 | 0.90 | 59.87 | 38.31 | 1.25 | 5.84 | 4.85 | 0.98 |
| Line-17 | 0.82 | 0.91 | 0.91 | 0.90 | 52.65 | 42.44 | 1.22 | | | |

Table 4: Provided are the values of each of the parameters (as described above) measured in *Sorghum* accessions (Seed ID) under normal conditions. Growth conditions are specified in the experimental procedure section.

TABLE 5

Measured parameters in *Sorghum* accessions under low nitrogen conditions

| Line | \multicolumn{11}{c}{Corr. ID} | | | | | | | | | | |
|---|---|---|---|---|---|---|---|---|---|---|---|
|  | 2 | 5 | 7 | 10 | 13 | 16 | 19 | 22 | 25 | 28 | 31 |
| Line-1 | 0.11 | 214.78 | 388 | 0.51 | 204.78 | 104 | 96.24 | 23.22 | 56.32 | 5.26 | 38.33 |
| Line-2 | 0.11 | 205.05 | 428.67 | 0.51 | 199.64 | 80.93 | 214.72 | 25.58 | 79.20 | 10.41 | 38.98 |
| Line-3 | 0.14 | 73.49 | 297.67 | 0.17 | 340.51 | 204.73 | 98.59 | 20.93 | 53.25 | 5.93 | 42.33 |
| Line-4 | 0.12 | 122.96 | 280.00 | 0.39 | 240.60 | 125.40 | 182.83 | 28.43 | 76.21 | 8.25 | 40.90 |
| Line-5 | 0.14 | 153.07 | 208.33 | 0.21 | 537.78 | 225.40 | 119.64 | 24.32 | 67.27 | 6.19 | 43.15 |
| Line-6 | 0.13 | 93.23 | 303.67 | 0.19 | 359.40 | 208.07 | 110.19 | 22.63 | 59.49 | 6.12 | 39.85 |
| Line-7 | 0.12 | 134.11 | 436.00 | 0.48 | 149.20 | 121.40 | 172.36 | 32.11 | 79.28 | 6.80 | 42.68 |
| Line-8 | 0.12 | 77.43 | 376.33 | 0.37 | 129.06 | 100.27 | 84.81 | 20.38 | 51.52 | 5.25 | 43.31 |
| Line-9 | 0.12 | 129.63 | 474.67 | 0.42 | 178.71 | 121.13 | 156.25 | 26.69 | 69.88 | 7.52 | 39.01 |
| Line-10 | 0.13 | 99.83 | 437.67 | 0.44 | 124.27 | 94.53 | 136.71 | 26.31 | 66.17 | 6.59 | 42.71 |
| Line-11 | 0.13 | 76.95 | 383.00 | 0.43 | 101.33 | 110.00 | 137.70 | 25.43 | 67.37 | 6.85 | 40.08 |
| Line-12 | 0.12 | 84.25 | 375.00 | 0.39 | 132.12 | 115.07 | 96.54 | 23.11 | 57.90 | 5.32 | 43.98 |
| Line-13 | 0.12 | 92.24 | 425.00 | 0.44 | 117.90 | 104.73 | 158.19 | 27.87 | 70.61 | 7.25 | 45.44 |
| Line-14 | 0.11 | 138.83 | 434.00 | 0.44 | 176.99 | 173.67 | 163.95 | 28.88 | 73.76 | 7.19 | 44.75 |
| Line-15 | 0.11 | 113.32 | 408.67 | 0.44 | 143.67 | 115.60 | 138.39 | 27.64 | 66.87 | 6.27 | 42.58 |
| Line-16 | 0.12 | 95.50 | 378.50 | 0.43 | 126.98 | 138.80 | 135.46 | 25.52 | 65.40 | 6.57 | 43.81 |
| Line-17 | 0.11 | 129.49 | 432.00 | 0.42 | 180.45 | 144.40 | 165.64 | 30.33 | 75.97 | 6.82 | 46.73 |

Table 5: Provided are the values of each of the parameters (as described above) measured in *Sorghum* accessions (Seed ID) under low nitrogen conditions. Growth conditions are specified in the experimental procedure section.

TABLE 6

Additional measured parameters in *Sorghum* accessions under low nitrogen growth conditions

| Line | \multicolumn{10}{c}{Corr. ID} | | | | | | | | | |
|---|---|---|---|---|---|---|---|---|---|---|
|  | 33 | 35 | 37 | 39 | 41 | 42 | 47 | 50 | 51 | 54 |
| Line-1 | 0.82 | 0.91 | 0.90 | 0.90 | 25.95 | 50.27 | 1.18 | 6.02 | 0.68 | 5.34 |
| Line-2 | 0.77 | 0.90 | 0.88 | 0.85 | 30.57 | 50.93 | 1.31 | 5.91 | 0.78 | 5.12 |
| Line-3 | 0.81 | 0.92 | 0.92 | 0.89 | 19.37 | 36.13 | 1.11 | 8.50 | 0.46 | 8.05 |
| Line-4 | 0.79 | 0.90 | 0.90 | 0.88 | 35.62 | 73.10 | 1.21 | 6.75 | 0.87 | 5.88 |
| Line-5 | 0.78 | 0.91 | 0.92 | 0.86 | 25.18 | 37.87 | 1.19 | 13.05 | 0.58 | 12.46 |
| Line-6 | 0.80 | 0.93 | 0.92 | 0.87 | 22.18 | 36.40 | 1.18 | 9.58 | 0.56 | 9.02 |
| Line-7 | 0.83 | 0.92 | 0.92 | 0.91 | 49.96 | 71.67 | 1.16 | 4.67 | 1.17 | 3.50 |
| Line-8 | 0.79 | 0.89 | 0.89 | 0.89 | 27.48 | 35.00 | 1.23 | 3.61 | 0.63 | 2.98 |
| Line-9 | 0.81 | 0.90 | 0.90 | 0.90 | 51.12 | 76.73 | 1.17 | 5.89 | 1.31 | 4.58 |
| Line-10 | 0.77 | 0.91 | 0.91 | 0.86 | 36.84 | 57.58 | 1.22 | 3.77 | 0.86 | 2.91 |
| Line-11 | 0.74 | 0.89 | 0.89 | 0.84 | 29.45 | 42.93 | 1.24 | 3.26 | 0.73 | 2.53 |
| Line-12 | 0.80 | 0.90 | 0.90 | 0.90 | 26.70 | 36.47 | 1.19 | 3.61 | 0.61 | 3.00 |
| Line-13 | 0.79 | 0.89 | 0.90 | 0.89 | 29.42 | 68.60 | 1.23 | 3.24 | 0.65 | 2.60 |
| Line-14 | 0.82 | 0.91 | 0.91 | 0.91 | 51.12 | 71.80 | 1.16 | 5.10 | 1.14 | 3.96 |
| Line-15 | 0.80 | 0.89 | 0.89 | 0.90 | 37.04 | 49.27 | 1.34 | 4.25 | 0.87 | 3.38 |
| Line-16 | 0.81 | 0.89 | 0.90 | 0.90 | 39.85 | 43.87 | 1.21 | 3.81 | 0.91 | 2.90 |
| Line-17 | 0.81 | 0.90 | 0.90 | 0.90 | 41.78 | 52.07 | 1.21 | 4.76 | 0.89 | 3.86 |

Table 6: Provided are the values of each of the parameters (as described above) measured in *Sorghum* accessions (Seed ID) under low nitrogen conditions. Growth conditions are specified in the experimental procedure section.

TABLE 7

Measured parameters in *Sorghum* accessions under drought conditions

| | Corr. ID | | | | | | | | |
|---|---|---|---|---|---|---|---|---|---|
| Line | 1 | 4 | 9 | 12 | 15 | 18 | 21 | 24 | 27 |
| Line-1 | 0.10 | 154.90 | 0.42 | 207.99 | 89.40 | 83.14 | 21.63 | 52.78 | 4.83 |
| Line-2 | 0.11 | 122.02 | 0.47 | 138.02 | 75.73 | 107.79 | 21.94 | 64.49 | 6.31 |
| Line-3 | 0.11 | 130.51 | 0.42 | 255.41 | 92.10 | 88.68 | 21.57 | 56.59 | 5.16 |
| Line-4 | 0.09 | 241.11 | 0.37 | 402.22 | 94.30 | 135.91 | 22.01 | 64.37 | 7.78 |
| Line-5 | 0.09 | 69.03 | 0.23 | 233.55 | 150.80 | 90.76 | 20.99 | 53.21 | 5.28 |
| Line-6 | 0.11 | 186.41 | 0.31 | 391.75 | 110.73 | 123.95 | 28.60 | 71.66 | 5.49 |
| Line-7 | | 62.11 | 0.41 | 89.31 | 99.20 | 86.06 | 21.35 | 55.61 | 5.04 |
| Line-8 | | 39.02 | 0.44 | 50.61 | 84.00 | 85.20 | 20.81 | 52.96 | 5.07 |
| Line-9 | | 58.94 | 0.40 | 87.02 | 99.00 | 113.10 | 24.68 | 69.83 | 5.77 |
| Line-10 | | 76.37 | 0.44 | 120.43 | 92.20 | 100.79 | 24.28 | 65.14 | 5.37 |
| Line-11 | | 33.47 | 0.47 | 37.21 | 81.93 | 80.41 | 21.95 | 55.27 | 4.66 |
| Line-12 | | 42.20 | 0.47 | 48.18 | 98.80 | 126.89 | 24.98 | 69.06 | 6.35 |
| Line-13 | | 41.53 | 0.48 | 44.20 | 86.47 | 86.41 | 19.49 | 53.32 | 5.58 |
| Line-14 | | 131.67 | 0.35 | 231.60 | 99.60 | 92.29 | 20.42 | 56.29 | 5.76 |
| Line-15 | | 60.84 | 0.35 | 116.01 | 83.00 | 77.89 | 16.81 | 49.12 | 5.86 |
| Line-16 | | 44.33 | 0.23 | 123.08 | 83.53 | 76.93 | 18.88 | 51.88 | 5.10 |
| Line-17 | | 185.44 | 0.33 | 342.50 | 92.30 | | | | |

Table 7: Provided are the values of each of the parameters (as described above) measured in *Sorghum* accessions (Seed ID) under drought conditions. Growth conditions are specified in the experimental procedure section.

TABLE 8

Additional measured parameters in *Sorghum* accessions under drought growth conditions

| | Correlation ID | | | |
|---|---|---|---|---|
| Line | 30 | 45 | 46 | 53 |
| Line-1 | 40.58 | 22.11 | 1.31 | 5.13 |
| Line-2 | 40.88 | 16.77 | 1.19 | 3.38 |
| Line-3 | 45.01 | 9.19 | 1.29 | 5.67 |
| Line-4 | 42.30 | 104.44 | 1.46 | 9.51 |
| Line-5 | 45.24 | 3.24 | 1.21 | 5.16 |
| Line-6 | 40.56 | 22.00 | 1.21 | 9.66 |
| Line-7 | 44.80 | 9.97 | | 1.99 |
| Line-8 | 45.07 | 18.58 | | 1.12 |
| Line-9 | 40.65 | 29.27 | | 2.14 |
| Line-10 | 45.43 | 10.45 | | 2.65 |
| Line-11 | 42.58 | 14.77 | | 0.87 |
| Line-12 | 44.18 | 12.86 | | 1.09 |
| Line-13 | 44.60 | 18.24 | | 0.99 |
| Line-14 | 42.41 | 11.60 | | 5.46 |
| Line-15 | 43.25 | 18.65 | | 2.68 |
| Line-16 | 40.30 | 16.36 | | 3.05 |
| Line-17 | 40.75 | | | 8.40 |

Table 8: Provided are the values of each of the parameters (as described above) measured in *Sorghum* accessions (Seed ID) under drought conditions. Growth conditions are specified in the experimental procedure section.

TABLE 9

Correlation between the expression level of selected LAB genes of some embodiments of the invention in various tissues and the phenotypic performance under low nitrogen, normal or drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB740 | 0.76 | 1.14E−02 | 3 | 48 | LAB741 | 0.70 | 2.31E−02 | 8 | 16 |
| LAB741 | 0.75 | 2.02E−02 | 3 | 52 | LAB741 | 0.76 | 1.76E−02 | 3 | 49 |
| LAB742 | 0.87 | 1.14E−03 | 5 | 2 | LAB744 | 0.86 | 1.53E−03 | 6 | 17 |
| LAB744 | 0.72 | 1.93E−02 | 6 | 44 | LAB744 | 0.97 | 6.12E−06 | 4 | 53 |
| LAB744 | 0.91 | 3.04E−04 | 4 | 4 | LAB744 | 0.97 | 5.61E−06 | 4 | 12 |
| LAB744 | 0.81 | 8.34E−03 | 7 | 18 | LAB744 | 0.90 | 8.98E−04 | 7 | 27 |
| LAB744 | 0.73 | 2.68E−02 | 7 | 24 | LAB745 | 0.78 | 1.39E−02 | 4 | 18 |
| LAB745 | 0.72 | 2.93E−02 | 4 | 24 | LAB745 | 0.82 | 7.22E−03 | 4 | 21 |
| LAB746 | 0.74 | 1.42E−02 | 9 | 48 | LAB746 | 0.78 | 8.00E−03 | 9 | 3 |
| LAB746 | 0.95 | 3.22E−05 | 2 | 47 | LAB746 | 0.93 | 9.99E−05 | 8 | 47 |
| LAB746 | 0.89 | 6.63E−04 | 5 | 47 | LAB748 | 0.82 | 3.53E−03 | 6 | 44 |
| LAB748 | 0.74 | 1.46E−02 | 6 | 36 | LAB748 | 0.70 | 2.39E−02 | 9 | 3 |
| LAB748 | 0.71 | 2.24E−02 | 4 | 15 | LAB748 | 0.75 | 1.16E−02 | 5 | 41 |
| LAB748 | 0.76 | 1.08E−02 | 5 | 51 | LAB748 | 0.74 | 1.47E−02 | 5 | 16 |
| LAB748 | 0.72 | 1.79E−02 | 1 | 53 | LAB748 | 0.73 | 1.76E−02 | 1 | 12 |
| LAB749 | 0.80 | 4.97E−03 | 6 | 52 | LAB749 | 0.79 | 7.07E−03 | 6 | 49 |
| LAB750 | 0.80 | 5.37E−03 | 6 | 48 | LAB750 | 0.74 | 1.44E−02 | 6 | 3 |
| LAB750 | 0.77 | 9.90E−03 | 2 | 47 | LAB750 | 0.79 | 6.31E−03 | 5 | 2 |

TABLE 9-continued

Correlation between the expression level of selected LAB genes of some embodiments of the invention in various tissues and the phenotypic performance under low nitrogen, normal or drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB751 | 0.82 | 3.77E−03 | 6 | 17 | LAB751 | 0.73 | 1.68E−02 | 9 | 17 |
| LAB751 | 0.72 | 1.82E−02 | 2 | 33 | LAB751 | 0.77 | 8.76E−03 | 2 | 41 |
| LAB751 | 0.76 | 1.04E−02 | 2 | 35 | LAB751 | 0.80 | 5.82E−03 | 2 | 51 |
| LAB751 | 0.83 | 2.68E−03 | 2 | 37 | LAB751 | 0.74 | 2.35E−02 | 7 | 18 |
| LAB751 | 0.71 | 3.09E−02 | 7 | 24 | LAB752 | 0.73 | 1.68E−02 | 6 | 17 |
| LAB752 | 0.86 | 1.50E−03 | 6 | 44 | LAB752 | 0.78 | 7.54E−03 | 9 | 8 |
| LAB752 | 0.88 | 6.79E−04 | 4 | 53 | LAB752 | 0.74 | 1.42E−02 | 4 | 4 |
| LAB752 | 0.89 | 6.10E−04 | 4 | 12 | LAB752 | 0.71 | 2.10E−02 | 5 | 50 |
| LAB752 | 0.71 | 2.04E−02 | 5 | 13 | LAB753 | 0.82 | 3.94E−03 | 6 | 17 |
| LAB753 | 0.75 | 1.29E−02 | 9 | 23 | LAB753 | 0.75 | 1.34E−02 | 2 | 42 |
| LAB753 | 0.72 | 1.86E−02 | 8 | 37 | LAB753 | 0.71 | 2.22E−02 | 8 | 16 |
| LAB754 | 0.77 | 9.07E−03 | 6 | 52 | LAB754 | 0.77 | 8.88E−03 | 6 | 49 |
| LAB754 | 0.77 | 9.14E−03 | 2 | 47 | LAB754 | 0.75 | 1.20E−02 | 2 | 28 |
| LAB754 | 0.72 | 1.89E−02 | 8 | 41 | LAB754 | 0.82 | 4.01E−03 | 8 | 42 |
| LAB754 | 0.74 | 1.46E−02 | 8 | 51 | LAB755 | 0.72 | 1.96E−02 | 9 | 40 |
| LAB755 | 0.78 | 1.25E−02 | 3 | 55 | LAB757 | 0.82 | 3.87E−03 | 9 | 48 |
| LAB757 | 0.73 | 1.68E−02 | 9 | 3 | LAB757 | 0.71 | 3.29E−02 | 4 | 27 |
| LAB757 | 0.84 | 2.21E−03 | 4 | 53 | LAB757 | 0.76 | 1.14E−02 | 4 | 4 |
| LAB757 | 0.86 | 1.58E−03 | 4 | 12 | LAB757 | 0.85 | 1.64E−03 | 5 | 28 |
| LAB758 | 0.71 | 2.27E−02 | 6 | 17 | LAB758 | 0.71 | 2.19E−02 | 6 | 11 |
| LAB758 | 0.73 | 2.70E−02 | 9 | 49 | LAB758 | 0.80 | 5.87E−03 | 4 | 53 |
| LAB758 | 0.78 | 7.49E−03 | 4 | 4 | LAB758 | 0.81 | 4.67E−03 | 4 | 12 |
| LAB758 | 0.74 | 1.45E−02 | 5 | 13 | LAB759 | 0.90 | 4.66E−04 | 6 | 17 |
| LAB759 | 0.83 | 2.71E−03 | 6 | 44 | LAB759 | 0.92 | 1.42E−04 | 4 | 53 |
| LAB759 | 0.87 | 1.06E−03 | 4 | 4 | LAB759 | 0.92 | 1.43E−04 | 4 | 12 |
| LAB759 | 0.76 | 1.65E−02 | 7 | 18 | LAB759 | 0.71 | 3.27E−02 | 7 | 21 |
| LAB760 | 0.75 | 1.23E−02 | 6 | 48 | LAB760 | 0.79 | 6.38E−03 | 8 | 5 |
| LAB760 | 0.77 | 9.22E−03 | 8 | 50 | LAB760 | 0.80 | 5.30E−03 | 8 | 54 |
| LAB760 | 0.72 | 1.84E−02 | 8 | 13 | LAB760 | 0.74 | 1.49E−02 | 3 | 3 |
| LAB760 | 0.85 | 4.07E−03 | 7 | 27 | LAB760 | 0.71 | 3.12E−02 | 7 | 24 |
| LAB761 | 0.73 | 1.56E−02 | 2 | 41 | LAB761 | 0.70 | 2.30E−02 | 2 | 51 |
| LAB761 | 0.78 | 8.11E−03 | 2 | 16 | LAB761 | 0.76 | 9.97E−03 | 3 | 17 |
| LAB761 | 0.71 | 2.25E−02 | 3 | 44 | LAB761 | 0.75 | 1.20E−02 | 7 | 4 |
| LAB762 | 0.78 | 8.29E−03 | 8 | 35 | LAB762 | 0.74 | 2.32E−02 | 7 | 18 |
| LAB762 | 0.74 | 2.18E−02 | 7 | 24 | LAB762 | 0.86 | 3.11E−03 | 7 | 21 |
| LAB763 | 0.75 | 1.30E−02 | 6 | 17 | LAB763 | 0.79 | 6.61E−03 | 2 | 47 |
| LAB763 | 0.85 | 1.72E−03 | 4 | 53 | LAB763 | 0.74 | 1.45E−02 | 4 | 4 |
| LAB763 | 0.86 | 1.43E−03 | 4 | 12 | LAB763 | 0.71 | 2.18E−02 | 5 | 5 |
| LAB763 | 0.77 | 8.52E−03 | 5 | 50 | LAB763 | 0.73 | 1.57E−02 | 5 | 54 |
| LAB763 | 0.85 | 1.93E−03 | 5 | 13 | LAB763 | 0.80 | 1.04E−02 | 3 | 52 |
| LAB763 | 0.80 | 9.24E−03 | 3 | 49 | LAB763 | 0.72 | 1.87E−02 | 7 | 30 |
| LAB764 | 0.71 | 2.14E−02 | 2 | 42 | LAB764 | 0.76 | 1.07E−02 | 2 | 37 |
| LAB764 | 0.75 | 1.22E−02 | 1 | 15 | LAB765 | 0.74 | 2.24E−02 | 9 | 52 |
| LAB765 | 0.75 | 1.93E−02 | 9 | 49 | LAB765 | 0.71 | 3.17E−02 | 4 | 27 |
| LAB765 | 0.71 | 3.33E−02 | 4 | 24 | LAB765 | 0.79 | 6.67E−03 | 8 | 47 |
| LAB765 | 0.74 | 1.47E−02 | 1 | 53 | LAB765 | 0.74 | 1.47E−02 | 1 | 12 |
| LAB768 | 0.72 | 1.98E−02 | 6 | 48 | LAB768 | 0.80 | 5.64E−03 | 6 | 3 |
| LAB768 | 0.76 | 1.14E−02 | 5 | 2 | LAB768 | 0.78 | 7.25E−03 | 7 | 9 |
| LAB769 | 0.76 | 1.08E−02 | 9 | 17 | LAB769 | 0.70 | 2.35E−02 | 5 | 16 |
| LAB769 | 0.79 | 1.22E−02 | 3 | 52 | LAB769 | 0.74 | 1.41E−02 | 3 | 48 |
| LAB769 | 0.74 | 2.14E−02 | 3 | 49 | LAB769 | 0.70 | 3.52E−02 | 7 | 18 |
| LAB769 | 0.86 | 3.03E−03 | 7 | 27 | LAB770 | 0.71 | 3.13E−02 | 4 | 45 |
| LAB770 | 0.75 | 1.96E−02 | 3 | 52 | LAB770 | 0.80 | 1.03E−02 | 3 | 49 |
| LAB770 | 0.76 | 1.76E−02 | 7 | 45 | LAB771 | 0.73 | 1.73E−02 | 6 | 17 |
| LAB771 | 0.78 | 7.16E−03 | 6 | 44 | LAB771 | 0.78 | 7.98E−03 | 2 | 47 |
| LAB771 | 0.84 | 2.54E−03 | 4 | 53 | LAB771 | 0.78 | 8.35E−03 | 4 | 4 |
| LAB771 | 0.85 | 1.94E−03 | 4 | 12 | LAB771 | 0.79 | 6.53E−03 | 5 | 41 |
| LAB771 | 0.79 | 6.27E−03 | 5 | 51 | LAB771 | 0.74 | 2.30E−02 | 3 | 52 |
| LAB771 | 0.75 | 2.01E−02 | 3 | 49 | LAB772 | 0.81 | 4.32E−03 | 6 | 17 |
| LAB772 | 0.78 | 7.81E−03 | 6 | 44 | LAB772 | 0.70 | 2.29E−02 | 2 | 33 |
| LAB772 | 0.90 | 4.60E−04 | 2 | 41 | LAB772 | 0.89 | 6.39E−04 | 2 | 22 |
| LAB772 | 0.74 | 1.43E−02 | 2 | 42 | LAB772 | 0.86 | 1.41E−03 | 2 | 51 |
| LAB772 | 0.87 | 9.89E−04 | 2 | 16 | LAB772 | 0.83 | 2.66E−03 | 4 | 53 |
| LAB772 | 0.80 | 5.63E−03 | 4 | 4 | LAB772 | 0.85 | 2.04E−03 | 4 | 12 |
| LAB772 | 0.77 | 9.58E−03 | 5 | 41 | LAB772 | 0.71 | 2.19E−02 | 5 | 13 |
| LAB772 | 0.74 | 1.38E−02 | 5 | 51 | LAB773 | 0.77 | 9.30E−03 | 6 | 17 |
| LAB773 | 0.71 | 2.15E−02 | 9 | 8 | LAB773 | 0.84 | 2.54E−03 | 4 | 53 |
| LAB773 | 0.81 | 4.69E−03 | 4 | 4 | LAB773 | 0.85 | 1.88E−03 | 4 | 12 |
| LAB773 | 0.72 | 1.92E−02 | 5 | 13 | LAB774 | 0.74 | 1.52E−02 | 9 | 17 |
| LAB774 | 0.72 | 1.98E−02 | 2 | 47 | LAB774 | 0.81 | 4.73E−03 | 2 | 28 |
| LAB774 | 0.82 | 7.26E−03 | 4 | 18 | LAB774 | 0.73 | 2.66E−02 | 4 | 24 |
| LAB775 | 0.74 | 1.54E−02 | 6 | 17 | LAB775 | 0.78 | 7.21E−03 | 6 | 44 |

TABLE 9-continued

Correlation between the expression level of selected LAB genes of some embodiments of the invention in various tissues and the phenotypic performance under low nitrogen, normal or drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB775 | 0.78 | 7.93E−03 | 2 | 37 | LAB775 | 0.98 | 8.19E−07 | 4 | 53 |
| LAB775 | 0.96 | 1.13E−05 | 4 | 4 | LAB775 | 0.98 | 3.93E−07 | 4 | 12 |
| LAB775 | 0.73 | 1.72E−02 | 5 | 5 | LAB775 | 0.79 | 6.49E−03 | 5 | 50 |
| LAB775 | 0.73 | 1.61E−02 | 5 | 54 | LAB775 | 0.84 | 2.53E−03 | 5 | 13 |
| LAB775 | 0.91 | 2.28E−04 | 7 | 30 | LAB775 | 0.91 | 3.11E−04 | 1 | 15 |
| LAB776 | 0.75 | 1.31E−02 | 6 | 3 | LAB776 | 0.71 | 2.03E−02 | 9 | 44 |
| LAB776 | 0.75 | 1.28E−02 | 4 | 30 | LAB776 | 0.76 | 1.06E−02 | 5 | 2 |
| LAB777 | 0.80 | 5.08E−03 | 2 | 41 | LAB777 | 0.79 | 6.63E−03 | 2 | 51 |
| LAB777 | 0.77 | 9.42E−03 | 2 | 37 | LAB777 | 0.85 | 1.68E−03 | 5 | 41 |
| LAB777 | 0.84 | 2.11E−03 | 5 | 51 | LAB777 | 0.71 | 2.04E−02 | 5 | 16 |
| LAB777 | 0.77 | 8.69E−03 | 3 | 44 | LAB778 | 0.94 | 7.00E−05 | 9 | 3 |
| LAB778 | 0.78 | 7.49E−03 | 8 | 2 | LAB778 | 0.71 | 3.18E−02 | 3 | 55 |
| LAB779 | 0.75 | 1.93E−02 | 7 | 45 | LAB779 | 0.77 | 1.53E−02 | 1 | 27 |
| LAB780 | 0.74 | 1.39E−02 | 6 | 29 | LAB780 | 0.77 | 8.58E−03 | 6 | 17 |
| LAB780 | 0.78 | 7.79E−03 | 6 | 20 | LAB780 | 0.83 | 3.10E−03 | 4 | 53 |
| LAB780 | 0.84 | 2.13E−03 | 4 | 4 | LAB780 | 0.82 | 3.35E−03 | 4 | 12 |
| LAB780 | 0.71 | 2.10E−02 | 8 | 37 | LAB780 | 0.74 | 1.40E−02 | 3 | 3 |
| LAB780 | 0.80 | 1.01E−02 | 7 | 27 | LAB781 | 0.81 | 4.08E−03 | 6 | 3 |
| LAB781 | 0.75 | 1.32E−02 | 5 | 2 | LAB781 | 0.90 | 4.08E−04 | 1 | 53 |
| LAB781 | 0.79 | 6.44E−03 | 1 | 4 | LAB781 | 0.90 | 3.55E−04 | 1 | 12 |
| LAB782 | 0.72 | 1.91E−02 | 9 | 6 | LAB783 | 0.88 | 8.55E−04 | 6 | 17 |
| LAB783 | 0.78 | 7.57E−03 | 6 | 44 | LAB783 | 0.78 | 7.96E−03 | 4 | 53 |
| LAB783 | 0.72 | 1.86E−02 | 4 | 4 | LAB783 | 0.79 | 7.14E−03 | 4 | 12 |
| LAB784 | 0.88 | 8.40E−04 | 6 | 52 | LAB784 | 0.87 | 9.73E−04 | 6 | 49 |
| LAB784 | 0.88 | 8.07E−04 | 9 | 48 | LAB784 | 0.72 | 1.82E−02 | 9 | 3 |
| LAB784 | 0.82 | 3.79E−03 | 5 | 2 | LAB784 | 0.87 | 1.19E−03 | 3 | 48 |
| LAB785 | 0.75 | 1.23E−02 | 6 | 17 | LAB785 | 0.71 | 2.03E−02 | 2 | 7 |
| LAB785 | 0.74 | 1.39E−02 | 4 | 53 | LAB785 | 0.74 | 1.50E−02 | 4 | 4 |
| LAB785 | 0.75 | 1.29E−02 | 4 | 12 | LAB785 | 0.83 | 5.94E−03 | 3 | 52 |
| LAB785 | 0.84 | 2.45E−03 | 3 | 6 | LAB785 | 0.79 | 1.05E−02 | 3 | 49 |
| LAB785 | 0.78 | 8.32E−03 | 3 | 8 | LAB786 | 0.83 | 2.73E−03 | 6 | 3 |
| LAB786 | 0.71 | 2.14E−02 | 9 | 8 | LAB787 | 0.83 | 3.19E−03 | 6 | 52 |
| LAB787 | 0.88 | 8.30E−04 | 6 | 6 | LAB787 | 0.83 | 2.90E−03 | 6 | 14 |
| LAB787 | 0.79 | 6.02E−03 | 6 | 49 | LAB787 | 0.78 | 7.78E−03 | 2 | 10 |
| LAB788 | 0.74 | 1.43E−02 | 6 | 48 | LAB788 | 0.82 | 3.40E−03 | 6 | 3 |
| LAB788 | 0.74 | 1.52E−02 | 4 | 30 | LAB788 | 0.78 | 7.80E−03 | 5 | 2 |
| LAB788 | 0.80 | 5.56E−03 | 1 | 30 | LAB789 | 0.74 | 1.43E−02 | 6 | 11 |
| LAB789 | 0.73 | 2.50E−02 | 9 | 52 | LAB789 | 0.75 | 2.02E−02 | 9 | 49 |
| LAB789 | 0.89 | 5.77E−04 | 4 | 53 | LAB789 | 0.87 | 1.11E−03 | 4 | 4 |
| LAB789 | 0.88 | 7.77E−04 | 4 | 12 | LAB789 | 0.80 | 5.83E−03 | 5 | 5 |
| LAB789 | 0.85 | 1.90E−03 | 5 | 50 | LAB789 | 0.81 | 4.25E−03 | 5 | 54 |
| LAB789 | 0.89 | 5.59E−04 | 5 | 13 | LAB790 | 0.70 | 2.30E−02 | 6 | 52 |
| LAB790 | 0.72 | 1.79E−02 | 6 | 49 | LAB790 | 0.71 | 2.26E−02 | 2 | 47 |
| LAB790 | 0.73 | 2.70E−02 | 4 | 21 | LAB791 | 0.78 | 7.61E−03 | 8 | 10 |
| LAB791 | 0.79 | 6.94E−03 | 8 | 42 | LAB792 | 0.72 | 1.89E−02 | 5 | 2 |
| LAB793 | 0.79 | 6.56E−03 | 5 | 2 | LAB794 | 0.75 | 1.29E−02 | 6 | 3 |
| LAB794 | 0.81 | 4.14E−03 | 2 | 41 | LAB794 | 0.80 | 5.35E−03 | 2 | 22 |
| LAB794 | 0.74 | 1.48E−02 | 2 | 42 | LAB794 | 0.76 | 1.02E−02 | 2 | 51 |
| LAB794 | 0.71 | 2.03E−02 | 2 | 16 | LAB794 | 0.75 | 1.22E−02 | 8 | 16 |
| LAB794 | 0.79 | 6.69E−03 | 5 | 2 | LAB794 | 0.83 | 5.96E−03 | 3 | 52 |
| LAB794 | 0.84 | 2.29E−03 | 3 | 6 | LAB794 | 0.83 | 2.94E−03 | 3 | 14 |
| LAB794 | 0.79 | 1.12E−02 | 3 | 49 | LAB794 | 0.76 | 1.15E−02 | 1 | 53 |
| LAB794 | 0.79 | 6.99E−03 | 1 | 4 | LAB794 | 0.75 | 1.30E−02 | 1 | 12 |
| LAB796 | 0.80 | 5.65E−03 | 6 | 48 | LAB797 | 0.85 | 1.65E−03 | 6 | 17 |
| LAB797 | 0.82 | 4.04E−03 | 6 | 44 | LAB797 | 0.82 | 3.33E−03 | 4 | 53 |
| LAB797 | 0.77 | 8.61E−03 | 4 | 4 | LAB797 | 0.83 | 2.89E−03 | 4 | 12 |
| LAB797 | 0.72 | 1.79E−02 | 5 | 5 | LAB797 | 0.79 | 6.57E−03 | 5 | 50 |
| LAB797 | 0.71 | 2.20E−02 | 5 | 54 | LAB797 | 0.79 | 6.65E−03 | 5 | 13 |
| LAB797 | 0.71 | 3.38E−02 | 3 | 55 | LAB798 | 0.89 | 6.03E−04 | 6 | 17 |
| LAB798 | 0.70 | 2.33E−02 | 6 | 40 | LAB798 | 0.81 | 4.62E−03 | 6 | 44 |
| LAB798 | 0.70 | 2.31E−02 | 6 | 36 | LAB798 | 0.71 | 2.19E−02 | 6 | 34 |
| LAB798 | 0.85 | 2.04E−03 | 4 | 53 | LAB798 | 0.85 | 1.92E−03 | 4 | 12 |
| LAB798 | 0.74 | 1.42E−02 | 5 | 16 | LAB798 | 0.76 | 1.81E−02 | 3 | 52 |
| LAB798 | 0.77 | 9.69E−03 | 3 | 6 | LAB798 | 0.74 | 1.41E−02 | 3 | 14 |
| LAB798 | 0.77 | 1.45E−02 | 3 | 49 | LAB799 | 0.89 | 4.88E−04 | 6 | 17 |
| LAB799 | 0.86 | 1.48E−03 | 6 | 44 | LAB799 | 0.87 | 9.38E−04 | 4 | 53 |
| LAB799 | 0.89 | 5.21E−04 | 4 | 4 | LAB799 | 0.88 | 8.64E−04 | 4 | 12 |

TABLE 9-continued

Correlation between the expression level of selected LAB genes of some embodiments of the invention in various tissues and the phenotypic performance under low nitrogen, normal or drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB799 | 0.74 | 1.53E−02 | 5 | 5 | LAB799 | 0.80 | 5.13E−03 | 5 | 50 |
| LAB799 | 0.74 | 1.53E−02 | 5 | 54 | LAB799 | 0.79 | 6.90E−03 | 5 | 13 |

Table 9. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 3

Production of *Sorghum* Transcriptom and High Throughput Correlation Analysis with Yield and Drought Related Parameters Measured in Fields Using 65K Sorghum Oligonucleotide Micro-Arrays In order to produce a high throughput correlation analysis between plant phenotype and gene expression level, the present inventors utilized a *Sorghum* oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 65,000 *Sorghum* genes and transcripts. In order to define correlations between the levels of RNA expression with ABST, drought and yield components or vigor related parameters, various plant characteristics of 12 different *Sorghum* hybrids were analyzed. Among them, 8 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

12 *Sorghum* varieties were grown in 6 repetitive plots, in field. Briefly, the growing protocol was as follows:

1. Regular growth conditions: *Sorghum* plants were grown in the field using commercial fertilization and irrigation protocols, which include 452 m$^3$ water per dunam (1000 square meters) per entire growth period and fertilization of 14 units of URAN® 21% (Nitrogen Fertilizer Solution; PCS Sales, Northbrook, Ill., USA) (normal growth conditions).

2. Drought conditions: *Sorghum* seeds were sown in soil and grown under normal condition until flowering stage (59 days from sowing), drought treatment was imposed by irrigating plants with 50% water relative to the normal treatment from this stage [309 m$^3$ water per dunam (1000 square meters) per entire growth period].

Analyzed *Sorghum* tissues—All 12 selected *Sorghum* hybrids were sample per each treatment. Tissues [Flag leaf, upper stem, lower stem, flower, grain] representing different plant characteristics, from plants growing under normal conditions and drought stress conditions were sampled and RNA was extracted as described above. Each micro-array expression information tissue type has received a Set ID as summarized in Table 10 below.

TABLE 10

*Sorghum* transcriptom expression sets in field experiment

| Expression Set | Set ID |
|---|---|
| *Sorghum*/flag leaf/Drought/flowering | 1 |
| *Sorghum*/flag leaf/Drought/grain filling | 2 |

Table 10: Provided are the *sorghum* transcriptom expression sets. Flag leaf = the leaf below the flower.

*Sorghum* yield components and vigor related parameters assessment—Plants were phenotyped as shown in Tables 11-12 below. The following parameters were collected using digital imaging system:

Average grain area (cm$^2$)—At the end of the growing period the grains were separated from the Plant 'Head'. A sample of ~200 grains were weighted, photographed and images were processed using the below described image processing system. The grain area was measured from those images and was divided by the number of grains.

Average grain length (cm)—At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Average grain width (cm)—At the end of the growing period the grains were separated from the Plant 'Head'. A sample of ~200 grains were weighted, photographed and images were processed using the below described image processing system. The sum of grain width (longest axis) was measured from those images and was divided by the number of grains.

Average grain perimeter (cm)—At the end of the growing period the grains were separated from the Plant 'Head'. A sample of ~200 grains were weighted, photographed and images were processed using the below described image processing system. The sum of grain perimeter was measured from those images and was divided by the number of grains.

Grain circularity—At the end of the growing period the grains were separated from the Plant 'Head'. A sample of ~200 grains were weighted, photographed and images were processed using the below described image processing system. The circularity of the grains was calculated based on Formula VI.

$$\text{Grain circularity} = 4 \times 3.14 \text{ (grain area/perimeter}^2\text{)} \quad \text{Formula VI:}$$

Head average area (cm$^2$)—At the end of the growing period 8 'Heads' were photographed and images were processed using the below described image processing system. The 'Head' area was measured from those images and was divided by the number of 'Heads'.

Head average length (cm)—At the end of the growing period 8 'Heads' were photographed and images were processed using the below described image processing system. The 'Head' length (longest axis) was measured from those images and was divided by the number of 'Heads'.

Head average width (cm)—At the end of the growing period 8 'Heads' were photographed and images were processed using the below described image processing system. The 'Head' width (longest axis) was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 8 plants per plot or by measuring the parameter across all the plants within the plot.

Head dry weight at grain filling (gr.)—5 heads per plot were collected at the grain filling stage (R2-R3) and weighted after oven dry (dry weight).

Head dry weights at harvest (gr.)—At the end of the growing period heads were collected (harvest stage), either from 8 plants per plot or from the rest of the plants in the plot. Heads were weighted after oven dry (dry weight), and average head weight per plant or per plot were calculated.

Total seed yield (gr.)—At the end of the growing period heads were collected (harvest stage). 8 heads were separately threshed and grains were weighted. The average grain weight per plant was calculated by dividing the total grain weight by the number of plants.

1000 Seeds weight [gr]—weight of 1000 seeds per plot.

Grain number (num.)—was calculated by dividing seed yield by 1000 seed weight.

Plant height (cm.)—Plants were characterized for height during growing period at 6 time points (including at harvest). In each measure, plants were measured for their height using a measuring tape. Height was measured from ground level to top of the longest leaf.

SPAD—Chlorophyll content was determined using a Minolta SPAD 502 chlorophyll meter and measurement was performed at early grain filling (SPAD_earlyGF) and late grain filling (SPAD_lateGF). SPAD meter readings were done on fully developed leaf. Three measurements per leaf were taken per plant.

Vegetative fresh and dry weight per plant (gr.)—At the end of the growing period all vegetative material (excluding roots) from plots were collected and weighted before (fresh weight) and after (dry weight) oven dry. The biomass per plant was calculated by dividing total biomass by the number of plants.

Relative water content (RWC, %)—at grain filling stage, leaves were collected from 5 plants per plot. Measurements of relative water content was done as follows: fresh weight (FW) was recorded immediately after leaf sampling; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I (above).

Specific leaf area (SLA)—at grain filling stage, leaves were collected from 5 plants per plot. Leaves were scanned to obtain leaf area per plant, and then leaves were dried in an oven to obtain the leaves dry weight per plan. Specific leaf area was calculated by the leaf area divided by leaf dry weight.

Stomatal conductance (F) (GF) (mmol m$^{-2}$ s$^{-1}$)—plants were evaluated for their stomata conductance using SC-1 Leaf Porometer (Decagon devices) at flowering (F) and at grain filling (GF) stages. Stomata conductance readings were done on fully developed leaf, for 2 leaves and 2 plants per plot.

Upper internode length (cm), width (cm) and volume (cm$^3$)—Upper internodes from at least 5 plants per plot were separated from the plant at flowering (F) and at harvest (H). Internodes were measured for their length (1) and width (d) using a ruler and a caliber. The internode volume was calculated using Formula VII.

$$\text{internode volume} = 3.14 \times (d/2)^2 \times 1 \qquad \text{Formula VII:}$$

Upper internode fresh and dry density (F) and (H) (gr/cm$^3$)—These parameters were measured at two time points during the course of the experiment: at flowering (F) and at harvest (H). Upper internodes from at least 5 plants per plot were separated from the plant and weighted (fresh and dry weight). To obtain stem density, stem weight (either fresh or dry) was divided by the stem volume (see above).

Lower internode length (cm), width (cm) and volume (cm$^3$)—Lower internodes from at least 5 plants per plot were separated from the plant at flowering (F) and at harvest (H). Internodes were measured for their length (1) and width (d) using a ruler and a caliber. The internode volume was calculated using Formula VII above.

Lower internode fresh and dry density (F) and (H) (gr/cm$^3$)—These parameters were measured at two time points during the course of the experiment: at flowering (F) and at harvest (H). Lower internodes from at least 5 plants per plot were separated from the plant and weighted (fresh and dry weight). To obtain stem density, stem weight (either fresh or dry) was divided by the stem volume (see above).

Number of days to heading [num]—Calculated as the number of days from sowing till 50% of the plot arrives heading.

Number of days to maturity [num]—Calculated as the number of days from sowing till 50% of the plot arrives seed maturation.

Maintenance of performance under drought conditions: Represent ratio for the specified parameter of Drought condition results divided by Normal conditions results (maintenance of phenotype under drought in comparison to normal conditions).

Data parameters collected are summarized in Tables 11-12, herein below.

TABLE 11

*Sorghum* correlated parameters under drought conditions (vectors)

| Correlated parameter with | Correlation ID |
|---|---|
| % Canopy coverage (GF) under drought | 1 |
| 1000 seed weight under drought [gr] | 2 |
| Grain Circularity under drought [grain area/perimeter$^2$] | 3 |
| Grain Perimeter under drought [cm] | 4 |

TABLE 11-continued

*Sorghum* correlated parameters under drought conditions (vectors)

| Correlated parameter with | Correlation ID |
|---|---|
| Grain area under drought [$cm^2$] | 5 |
| Grain length under drought [cm] | 6 |
| Grain width under drought [cm] | 7 |
| Grain number under drought [num] | 8 |
| Total seed yield per plant under drought [gr] | 9 |
| Head DW (GF) under drought [gr] | 10 |
| Heads DW at harvest per plant under drought [gr] | 11 |
| Lower Stem dry density (H) under drought [$gr/cm^3$] | 12 |
| Lower Stem fresh density (F) under drought [$gr/cm^3$] | 13 |
| Lower Stem width (F) under drought [cm] | 14 |
| Main Head Area under drought [$cm^2$] | 15 |
| Main Head Width under drought [cm] | 16 |
| Main Head length under drought [cm] | 17 |
| Number Days to heading (field) under drought [num] | 18 |
| Number days to maturity under drought [num] | 19 |
| Plant height under drought [cm] | 20 |
| RWC 2 under drought [%] | 21 |
| early GF under drought (SPAD unit) | 22 |
| SPAD late GF under drought (SPAD unit) | 23 |
| Specific leaf area (GF) under drought ($cm^2/gr$) | 24 |
| Stomatal conductance (F) under drought [mmol $m^{-2}$ $s^{-1}$] | 25 |
| Stomatal conductance (GF) under drought [mmol $m^{-2}$ $s^{-1}$] | 26 |
| Upper internode dry density (H) under drought [$gr/cm^3$] | 27 |
| Upper internode fresh density (H) under drought [$gr/cm^3$] | 28 |
| Upper internode length (H) under drought [cm] | 29 |
| Upper internode volume (H) under drought [$cm^2$] | 30 |
| Upper internode width (H) under drought [cm] | 31 |
| Vegetative DW per plant under drought [gr] | 32 |
| Vegetative FW per plant under drought [gr] | 33 |

Table 11. Provided are the *Sorghum* correlated parameters (vectors).
"gr." = grams;
"SPAD" = chlorophyll levels;
"FW" = Plant Fresh weight;
"DW" = Plant Dry weight;
"GF" = grain filling growth stage;
"F" = flowering stage;
"H" = harvest stage.

TABLE 12

*Sorghum* correlated parameters for maintenance under drought conditions (vectors)

| Correlated parameter with | Correlation ID |
|---|---|
| 1000 grains weight D/N | 1 |
| Grain Perimeter D/N | 2 |
| Grain area D/N | 3 |
| Grain length D/N | 4 |
| Grain width D/N | 5 |
| Grains num (SP) D/N | 6 |
| Grains weight per plant D/N | 7 |
| Head DW (GF) D/N | 8 |
| Heads weight per plant (RP) D/N | 9 |
| Lower Stem width (F) D/N | 10 |
| Lower stem dry density (H) D/N | 11 |
| Lower stem fresh density (F) D/N | 12 |
| Main Head Area D/N | 13 |
| Main Head Width D/N | 14 |
| Main Head length D/N | 15 |
| Plant height D/N | 16 |
| RWC_2 D/N | 17 |
| SPAD_2 D/N | 18 |
| SPAD_3 D/N | 19 |
| Specific leaf area (GF) D/N | 20 |
| Stomatal conductance (F) D/N | 21 |
| Stomatal conductance (GF) D/N | 22 |
| Upper Stem length (h) D/N | 23 |
| Upper Stem width (h) D/N | 24 |
| Upper stem dry density (H) D/N | 25 |
| Upper stem fresh density (H) D/N | 26 |
| Upper stem volume (H) D/N | 27 |
| Vegetative DW per plant D/N | 28 |
| Vegetative FW per plant D/N | 29 |

Table 12. Provided are the *Sorghum* correlated parameters (vectors).
"gr." = grams;
"SPAD" = chlorophyll levels;
"FW" = Plant Fresh weight;
"DW" = Plant Dry weight;
"Maintenance under drought" = calculated % of change under drought vs. normal growth conditions.
"GF" = grain filling growth stage;
"F" = flowering stage;
"H" = harvest stage.
"D/N" = ratio for the specified parameter of Drought condition results divided by Normal conditions results (maintenance of phenotype under drought in comparison to normal conditions).

Experimental Results

Twelve different *Sorghum* hybrids were grown and characterized for different parameters (Tables 11-12). The average for each of the measured parameter was calculated using the JMP software (Tables 13-18) and a subsequent correlation analysis was performed (Tables 19-20). Results were then integrated to the database.

TABLE 13

Measured parameters in *Sorghum* accessions under drought conditions

| Line | Corr. ID |  |  |  |  |  |  |  |  |  |  |
|---|---|---|---|---|---|---|---|---|---|---|---|
|  | 1 | 2 | 3 | 4 | 5 | 6 | 7 | 8 | 9 | 10 | 11 |
| Line-1 | 70.80 | 13.30 | 0.88 | 1.20 | 0.10 | 0.39 | 0.33 | 17494.21 | 29.22 | 19.29 | 0.04 |
| Line-2 | 64.11 | 17.88 | 0.90 | 1.22 | 0.11 | 0.40 | 0.34 | 14526.20 | 31.74 | 33.15 | 0.04 |
| Line-3 | 75.68 | 20.24 | 0.90 | 1.28 | 0.12 | 0.41 | 0.36 | 15728.96 | 40.21 | 27.31 | 0.05 |
| Line-4 | 87.17 | 17.95 | 0.89 | 1.30 | 0.12 | 0.42 | 0.36 | 13808.50 | 29.52 | 50.38 | 0.03 |
| Line-5 | 77.78 | 14.64 | 0.88 | 1.27 | 0.11 | 0.42 | 0.34 | 9838.55 | 18.23 | 37.04 | 0.02 |
| Line-6 | 80.38 | 20.83 | 0.89 | 1.36 | 0.13 | 0.45 | 0.37 | 12402.52 | 34.43 | 11.72 | 0.02 |
| Line-7 | 64.25 | 15.43 | 0.89 | 1.24 | 0.11 | 0.40 | 0.34 | 9979.86 | 19.10 | 9.32 | 0.03 |
| Line-8 | 61.34 | 19.80 | 0.87 | 1.28 | 0.11 | 0.41 | 0.35 | 5451.71 | 13.67 | 12.10 | 0.02 |

Table 13:
Provided are the values of each of the parameters (as described above) measured in *Sorghum* accessions (Line) under drought conditions. Growth conditions are specified in the experimental procedure section.

TABLE 14

Additional measured parameters in *Sorghum* accessions under drought growth conditions

| Line | \multicolumn{11}{c}{Corr. ID} | | | | | | | | | | |
|---|---|---|---|---|---|---|---|---|---|---|---|
|  | 12 | 13 | 14 | 15 | 16 | 17 | 18 | 19 | 20 | 21 | 22 |
| Line-1 | 1.71 | 10.36 | 14.90 | 114.58 | 5.02 | 31.12 | 63.00 | 92.00 | 80.92 | 66.87 | 44.66 |
| Line-2 | 1.66 | 11.28 | 13.32 | 94.24 | 5.57 | 22.16 | 56.00 | 92.00 | 93.43 | 68.62 | 51.92 |
| Line-3 | 1.64 | 10.70 | 14.53 | 104.21 | 5.70 | 24.36 | 59.67 | 92.00 | 104.15 | 68.25 | 48.84 |
| Line-4 | 1.60 | 9.68 | 17.27 | 87.37 | 4.77 | 24.76 | 76.67 | 107.00 | 105.63 | 76.33 | 37.60 |
| Line-5 | 2.49 | 10.79 | 18.35 | 55.31 | 3.72 | 19.93 | 74.67 | 107.00 | 69.04 | 54.86 | 38.19 |
| Line-6 | 1.25 | 9.66 | 13.96 | 85.87 | 5.81 | 19.41 | 71.00 | 107.00 | 133.54 | 74.51 | 43.35 |
| Line-7 | 2.38 | 10.87 | 17.19 | 68.68 | 4.62 | 19.90 | 68.33 | 92.00 | 47.82 | 71.70 | 47.58 |
| Line-8 | 1.60 | 10.46 | 16.63 | 96.62 | 5.53 | 24.79 | 66.33 | 92.00 | 83.24 | 78.51 | 46.97 |

Table 14:
Provided are the values of each of the parameters (as described above) measured in *Sorghum* accessions (Seed ID) under drought conditions. Growth conditions are specified in the experimental procedure section.

TABLE 15

Additional measured parameters in *Sorghum* accessions under drought growth conditions

| Line | \multicolumn{11}{c}{Corr. ID} | | | | | | | | | | |
|---|---|---|---|---|---|---|---|---|---|---|---|
|  | 23 | 24 | 25 | 26 | 27 | 28 | 29 | 30 | 31 | 32 | 33 |
| Line-1 | 30.93 | 132.90 | 582.07 | 129.78 | 1.65 | 5.18 | 48.60 | 2865.28 | 8.60 | 0.03 | 0.09 |
| Line-2 | 43.69 | 138.52 | 985.59 | 241.65 | 1.62 | 5.39 | 48.78 | 2857.93 | 8.59 | 0.03 | 0.10 |
| Line-3 | 37.80 | 133.26 | 834.96 | 322.92 | 1.63 | 5.40 | 48.73 | 2955.99 | 8.73 | 0.04 | 0.11 |
| Line-4 | 32.49 | 47.34 | 54.16 | 127.17 | 1.76 | 5.53 | 26.05 | 1288.48 | 7.85 | 0.08 | 0.19 |
| Line-5 | 34.14 | 44.43 | 68.26 | 276.22 | 1.92 | 8.60 | 31.06 | 1128.61 | 6.63 | 0.06 | 0.15 |
| Line-6 | 25.84 | 106.06 | 330.46 | 217.19 | 1.66 | 3.60 | 20.72 | 1724.93 | 10.20 | 0.05 | 0.11 |
| Line-7 | 42.92 | 128.67 | 387.65 | 81.21 | 1.55 | 4.61 | 24.07 | 1507.76 | 8.88 | 0.04 | 0.08 |
| Line-8 | 26.98 | 143.32 | 774.84 | 561.18 | 1.43 | 5.72 | 39.57 | 2524.28 | 8.92 | 0.04 | 0.10 |

Table 15:
Provided are the values of each of the parameters (as described above) measured in *Sorghum* accessions (Seed ID) under drought conditions. Growth conditions are specified in the experimental procedure section.

TABLE 16

Calculated parameters in *Sorghum* accessions under drought conditions
(maintenance of performance under drought vs normal growth conditions)

| Line | \multicolumn{11}{c}{Corr. ID} | | | | | | | | | | |
|---|---|---|---|---|---|---|---|---|---|---|---|
|  | 1 | 2 | 3 | 4 | 5 | 6 | 7 | 8 | 9 | 10 | 11 |
| Line-1 | 0.72 | 0.92 | 0.85 | 0.93 | 0.91 | 0.81 | 0.59 | 0.70 | 0.57 | 0.80 | 0.69 |
| Line-2 | 0.76 | 0.93 | 0.87 | 0.94 | 0.93 | 1.11 | 0.81 | 1.05 | 0.64 | 0.98 | 0.65 |
| Line-3 | 0.78 | 0.95 | 0.90 | 0.95 | 0.95 | 0.93 | 0.73 | 1.06 | 0.70 | 0.97 | 0.66 |
| Line-4 | 0.88 | 0.99 | 0.97 | 0.99 | 0.97 | 0.56 | 0.46 | 0.68 | 0.42 | 1.05 | 0.97 |
| Line-5 | 0.79 | 0.96 | 0.91 | 0.97 | 0.94 | 0.65 | 0.55 | 0.90 | 0.43 | 1.02 | 0.99 |
| Line-6 | 0.77 | 0.94 | 0.88 | 0.93 | 0.94 | 0.71 | 0.57 | 0.77 | 0.36 | 0.87 | 0.70 |
| Line-7 | 0.84 | 0.97 | 0.94 | 0.97 | 0.97 | 0.72 | 0.60 | 0.91 | 0.46 | 0.97 | 0.81 |
| Line-8 | 0.87 | 0.98 | 0.96 | 0.98 | 0.98 | 0.87 | 0.76 | 0.94 | 0.52 | 0.99 | 0.79 |

Table 16:
Provided are the values of each of the parameters (as described above) measured in *sorghum* accessions (line) for maintenance of performance under drought (calculated as % of change under drought vs normal growth conditions). Growth conditions are specified in the experimental procedure section

TABLE 17

Additional calculated parameters in *Sorghum* accessions under drought conditions (maintenance of performance under drought vs normal growth conditions)

| Line | \multicolumn{11}{c|}{Corr. ID} |
|---|---|---|---|---|---|---|---|---|---|---|---|

| Line | 12 | 13 | 14 | 15 | 16 | 17 | 18 | 19 | 20 | 21 | 22 |
|---|---|---|---|---|---|---|---|---|---|---|---|
| Line-1 | 0.96 | 0.82 | 0.79 | 1.01 | 0.85 | 0.74 | 0.83 | 0.74 | 0.62 | 0.73 | 0.15 |
| Line-2 | 1.04 | 0.95 | 0.94 | 0.98 | 0.92 | 0.76 | 0.99 | 0.93 | 0.65 | 1.12 | 0.33 |
| Line-3 | 0.99 | 0.91 | 0.91 | 0.99 | 0.92 | 0.77 | 0.91 | 0.81 | 0.62 | 1.03 | 0.36 |
| Line-4 | 0.92 | 0.59 | 0.75 | 0.81 | 0.64 | 0.93 | 0.85 | 0.81 | 0.70 | 0.09 | 0.33 |
| Line-5 | 0.99 | 0.69 | 0.82 | 0.84 | 0.70 | 0.63 | 0.78 | 0.81 | 0.58 | 0.11 | 0.57 |
| Line-6 | 0.96 | 0.77 | 0.81 | 0.94 | 0.79 | 0.82 | 0.92 | 0.77 | 0.65 | 0.60 | 0.34 |
| Line-7 | 1.02 | 0.80 | 0.85 | 0.93 | 0.87 | 0.81 | 0.91 | 0.86 | 0.66 | 0.82 | 0.17 |
| Line-8 | 0.98 | 1.20 | 1.11 | 1.15 | 0.80 | 0.86 | 0.95 | 0.76 | 0.84 | 0.76 | 0.69 |

Table 17:
Provided are the values of each of the parameters (as described above) measured in *sorghum* accessions (line) for maintenance of performance under drought (calculated as % of change under drought vs normal growth conditions). Growth conditions are specified in the experimental procedure section.

TABLE 18

Additional calculated parameters in *Sorghum* accessions under drought conditions (maintenance of performance under drought vs. normal growth conditions)

| Line | \multicolumn{7}{c|}{Correlation ID} |
|---|---|---|---|---|---|---|---|

| Line | 23 | 24 | 25 | 26 | 27 | 28 | 29 |
|---|---|---|---|---|---|---|---|
| Line-1 | 0.81 | 1.00 | 0.95 | 0.71 | 0.82 | 0.74 | 0.60 |
| Line-2 | 0.94 | 1.01 | 0.91 | 0.68 | 0.98 | 0.71 | 0.69 |
| Line-3 | 0.89 | 0.95 | 0.98 | 0.77 | 0.81 | 0.69 | 0.59 |
| Line-4 | 0.54 | 0.84 | 1.05 | 1.15 | 0.39 | 0.77 | 0.80 |
| Line-5 | 0.59 | 0.86 | 1.05 | 1.04 | 0.46 | 0.82 | 0.68 |
| Line-6 | 0.61 | 1.01 | 0.89 | 0.78 | 0.62 | 0.77 | 0.73 |
| Line-7 | 0.84 | 1.05 | 0.88 | 0.64 | 0.94 | 0.85 | 0.66 |
| Line-8 | 0.88 | 1.20 | 0.81 | 0.64 | 1.16 | 0.78 | 0.69 |

Table 18:
Provided are the values of each of the parameters (as described above) measured in *sorghum* accessions (line) for maintenance of performance under drought (calculated as % of change under drought vs normal growth conditions). Growth conditions are specified in the experimental procedure section.

TABLE 19

Correlation between the expression level of selected LAB genes of some embodiments of the invention in various tissues and the phenotypic performance under drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB740 | 0.73 | 6.52E−02 | 1 | 12 | LAB740 | 0.78 | 3.97E−02 | 1 | 22 |
| LAB740 | 0.87 | 1.09E−02 | 1 | 23 | LAB740 | 0.89 | 7.81E−03 | 1 | 13 |
| LAB741 | 0.86 | 1.39E−02 | 1 | 31 | LAB741 | 0.72 | 6.94E−02 | 1 | 24 |
| LAB741 | 0.78 | 3.98E−02 | 1 | 16 | LAB741 | 0.94 | 1.38E−03 | 2 | 31 |
| LAB744 | 0.86 | 1.29E−02 | 1 | 8 | LAB744 | 0.90 | 5.88E−03 | 1 | 3 |
| LAB744 | 0.74 | 5.54E−02 | 1 | 9 | LAB744 | 0.83 | 1.96E−02 | 1 | 11 |
| LAB744 | 0.81 | 2.78E−02 | 2 | 8 | LAB744 | 0.75 | 5.17E−02 | 2 | 11 |
| LAB745 | 0.87 | 1.15E−02 | 1 | 30 | LAB745 | 0.94 | 1.84E−03 | 1 | 15 |
| LAB745 | 0.77 | 4.35E−02 | 1 | 17 | LAB745 | 0.88 | 8.68E−03 | 1 | 29 |
| LAB745 | 0.75 | 5.16E−02 | 2 | 3 | LAB746 | 0.83 | 1.98E−02 | 1 | 30 |
| LAB746 | 0.79 | 3.57E−02 | 1 | 22 | LAB746 | 0.83 | 1.96E−02 | 1 | 29 |
| LAB746 | 0.92 | 3.14E−03 | 1 | 25 | LAB746 | 0.75 | 5.17E−02 | 1 | 13 |
| LAB746 | 0.75 | 5.31E−02 | 2 | 22 | LAB746 | 0.83 | 2.07E−02 | 2 | 25 |
| LAB746 | 0.73 | 6.03E−02 | 2 | 13 | LAB748 | 0.77 | 4.10E−02 | 1 | 8 |
| LAB748 | 0.90 | 6.41E−03 | 1 | 3 | LAB748 | 0.85 | 1.50E−02 | 1 | 9 |
| LAB748 | 0.97 | 4.04E−04 | 1 | 11 | LAB749 | 0.85 | 1.65E−02 | 1 | 31 |
| LAB749 | 0.72 | 6.77E−02 | 1 | 20 | LAB749 | 0.73 | 6.39E−02 | 1 | 6 |
| LAB749 | 0.71 | 7.42E−02 | 1 | 5 | LAB749 | 0.71 | 7.51E−02 | 2 | 31 |
| LAB749 | 0.77 | 4.29E−02 | 2 | 20 | LAB749 | 0.71 | 7.41E−02 | 2 | 6 |
| LAB750 | 0.93 | 2.69E−03 | 1 | 33 | LAB750 | 0.92 | 2.85E−03 | 1 | 32 |
| LAB750 | 0.81 | 2.77E−02 | 1 | 10 | LAB750 | 0.72 | 7.01E−02 | 1 | 1 |
| LAB750 | 0.71 | 7.54E−02 | 1 | 19 | LAB750 | 0.84 | 1.83E−02 | 2 | 33 |
| LAB750 | 0.87 | 1.07E−02 | 2 | 18 | LAB750 | 0.89 | 6.59E−03 | 2 | 32 |
| LAB750 | 0.94 | 1.53E−03 | 2 | 19 | LAB750 | 0.83 | 2.08E−02 | 2 | 1 |
| LAB751 | 0.72 | 6.58E−02 | 1 | 33 | LAB751 | 0.84 | 1.87E−02 | 1 | 9 |
| LAB751 | 0.82 | 2.52E−02 | 1 | 27 | LAB751 | 0.77 | 4.29E−02 | 1 | 20 |
| LAB751 | 0.95 | 1.16E−03 | 2 | 33 | LAB751 | 0.82 | 2.50E−02 | 1 | 10 |
| LAB751 | 0.98 | 1.19E−04 | 2 | 32 | LAB751 | 0.82 | 2.32E−02 | 1 | 1 |

TABLE 19-continued

Correlation between the expression level of selected LAB genes of some embodiments of the invention in various tissues and the phenotypic performance under drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB751 | 0.82 | 2.48E-02 | 2 | 10 | LAB751 | 0.72 | 6.64E-02 | 2 | 18 |
| LAB751 | 0.90 | 6.33E-03 | 2 | 1 | LAB751 | 0.80 | 3.03E-02 | 2 | 27 |
| LAB752 | 0.80 | 2.90E-02 | 1 | 26 | LAB751 | 0.81 | 2.87E-02 | 2 | 19 |
| LAB752 | 0.84 | 1.87E-02 | 1 | 22 | LAB752 | 0.84 | 1.81E-02 | 1 | 24 |
| LAB752 | 0.80 | 3.25E-02 | 2 | 30 | LAB752 | 0.88 | 8.13E-03 | 1 | 25 |
| LAB753 | 0.94 | 1.84E-03 | 1 | 30 | LAB752 | 0.83 | 1.95E-02 | 2 | 29 |
| LAB753 | 0.70 | 7.72E-02 | 1 | 22 | LAB753 | 0.72 | 6.70E-02 | 1 | 15 |
| LAB753 | 0.82 | 2.40E-02 | 1 | 29 | LAB753 | 0.77 | 4.27E-02 | 1 | 16 |
| LAB753 | 0.72 | 6.59E-02 | 2 | 21 | LAB753 | 0.90 | 5.75E-03 | 1 | 25 |
| LAB754 | 0.93 | 2.11E-03 | 1 | 24 | LAB753 | 0.91 | 4.67E-03 | 2 | 26 |
| LAB754 | 0.78 | 3.75E-02 | 1 | 25 | LAB754 | 0.93 | 2.34E-03 | 1 | 22 |
| LAB754 | 0.75 | 5.04E-02 | 2 | 30 | LAB754 | 0.89 | 7.98E-03 | 1 | 13 |
| LAB754 | 0.98 | 1.80E-04 | 2 | 22 | LAB754 | 0.90 | 5.55E-03 | 2 | 24 |
| LAB754 | 0.89 | 6.68E-03 | 2 | 25 | LAB754 | 0.81 | 2.75E-02 | 2 | 23 |
| LAB755 | 0.71 | 7.47E-02 | 1 | 31 | LAB754 | 0.89 | 7.62E-03 | 2 | 13 |
| LAB755 | 0.92 | 3.81E-03 | 2 | 20 | LAB755 | 0.72 | 6.66E-02 | 2 | 9 |
| LAB756 | 0.87 | 1.18E-02 | 1 | 26 | LAB755 | 0.70 | 7.88E-02 | 2 | 16 |
| LAB756 | 0.94 | 1.77E-03 | 1 | 22 | LAB756 | 0.98 | 1.40E-04 | 1 | 24 |
| LAB756 | 0.78 | 3.68E-02 | 1 | 13 | LAB756 | 0.83 | 1.97E-02 | 1 | 25 |
| LAB757 | 0.73 | 6.15E-02 | 1 | 18 | LAB756 | 0.77 | 4.46E-02 | 2 | 28 |
| LAB757 | 0.75 | 5.45E-02 | 2 | 9 | LAB757 | 0.88 | 8.49E-03 | 2 | 21 |
| LAB758 | 0.78 | 3.90E-02 | 2 | 23 | LAB758 | 0.71 | 7.26E-02 | 1 | 23 |
| LAB759 | 0.79 | 3.50E-02 | 1 | 30 | LAB758 | 0.72 | 6.55E-02 | 2 | 13 |
| LAB759 | 0.93 | 2.15E-03 | 1 | 22 | LAB759 | 0.91 | 4.75E-03 | 1 | 24 |
| LAB759 | 0.89 | 7.44E-03 | 1 | 13 | LAB759 | 0.92 | 2.95E-03 | 1 | 25 |
| LAB759 | 0.72 | 6.71E-02 | 2 | 30 | LAB759 | 0.82 | 2.42E-02 | 2 | 2 |
| LAB759 | 0.92 | 3.75E-03 | 2 | 22 | LAB759 | 0.75 | 5.02E-02 | 2 | 24 |
| LAB759 | 0.93 | 2.41E-03 | 2 | 25 | LAB759 | 0.81 | 2.60E-02 | 2 | 16 |
| LAB760 | 0.87 | 1.18E-02 | 2 | 2 | LAB759 | 0.88 | 9.71E-03 | 2 | 13 |
| LAB760 | 0.74 | 5.60E-02 | 2 | 6 | LAB760 | 0.73 | 6.19E-02 | 2 | 16 |
| LAB760 | 0.80 | 3.12E-02 | 2 | 4 | LAB760 | 0.78 | 3.97E-02 | 2 | 5 |
| LAB761 | 0.87 | 9.98E-03 | 1 | 33 | LAB760 | 0.81 | 2.58E-02 | 2 | 7 |
| LAB761 | 0.77 | 4.30E-02 | 1 | 10 | LAB761 | 0.91 | 4.18E-03 | 1 | 32 |
| LAB761 | 0.78 | 3.95E-02 | 2 | 11 | LAB761 | 0.80 | 3.24E-02 | 2 | 3 |
| LAB762 | 0.80 | 2.99E-02 | 1 | 30 | LAB761 | 0.77 | 4.34E-02 | 2 | 23 |
| LAB762 | 0.88 | 8.21E-03 | 1 | 22 | LAB762 | 0.76 | 4.66E-02 | 1 | 24 |
| LAB762 | 0.95 | 9.59E-04 | 1 | 25 | LAB762 | 0.76 | 4.65E-02 | 1 | 29 |
| LAB762 | 0.73 | 6.14E-02 | 2 | 8 | LAB762 | 0.91 | 4.95E-03 | 1 | 13 |
| LAB762 | 0.88 | 8.68E-03 | 2 | 12 | LAB762 | 0.79 | 3.32E-02 | 2 | 14 |
| LAB763 | 0.80 | 3.16E-02 | 1 | 24 | LAB762 | 0.90 | 5.40E-03 | 2 | 11 |
| LAB763 | 0.76 | 4.67E-02 | 1 | 25 | LAB763 | 0.91 | 4.92E-03 | 1 | 22 |
| LAB763 | 0.97 | 3.53E-04 | 2 | 12 | LAB763 | 0.91 | 4.86E-03 | 1 | 13 |
| LAB764 | 0.74 | 5.89E-02 | 1 | 26 | LAB763 | 0.71 | 7.23E-02 | 2 | 23 |
| LAB764 | 0.74 | 5.79E-02 | 2 | 33 | LAB764 | 0.92 | 3.27E-03 | 2 | 21 |
| LAB764 | 0.83 | 1.94E-02 | 2 | 18 | LAB764 | 0.80 | 3.14E-02 | 2 | 32 |
| LAB764 | 0.77 | 4.38E-02 | 2 | 5 | LAB764 | 0.78 | 3.90E-02 | 2 | 6 |
| LAB764 | 0.81 | 2.57E-02 | 2 | 19 | LAB764 | 0.81 | 2.71E-02 | 2 | 4 |
| LAB765 | 0.72 | 6.87E-02 | 1 | 30 | LAB764 | 0.71 | 7.12E-02 | 2 | 7 |
| LAB765 | 0.73 | 6.32E-02 | 1 | 23 | LAB765 | 0.83 | 2.13E-02 | 1 | 22 |
| LAB765 | 0.84 | 1.76E-02 | 1 | 25 | LAB765 | 0.80 | 3.23E-02 | 1 | 29 |
| LAB765 | 0.78 | 4.04E-02 | 2 | 10 | LAB765 | 0.93 | 2.21E-03 | 1 | 13 |
| LAB767 | 0.86 | 1.38E-02 | 1 | 25 | LAB767 | 0.82 | 2.53E-02 | 1 | 22 |
| LAB767 | 0.70 | 7.75E-02 | 2 | 23 | LAB767 | 0.71 | 7.62E-02 | 2 | 8 |
| LAB768 | 0.95 | 1.04E-03 | 1 | 30 | LAB767 | 0.82 | 2.26E-02 | 2 | 13 |
| LAB768 | 0.76 | 4.77E-02 | 1 | 15 | LAB768 | 0.71 | 7.43E-02 | 1 | 11 |
| LAB768 | 0.90 | 6.02E-03 | 1 | 29 | LAB768 | 0.73 | 6.28E-02 | 1 | 16 |
| LAB768 | 0.71 | 7.48E-02 | 2 | 21 | LAB768 | 0.84 | 1.86E-02 | 1 | 25 |
| LAB768 | 0.90 | 5.54E-03 | 2 | 32 | LAB768 | 0.89 | 7.62E-03 | 2 | 33 |
| LAB768 | 0.78 | 3.84E-02 | 2 | 10 | LAB768 | 0.73 | 6.16E-02 | 2 | 18 |
| LAB769 | 0.81 | 2.65E-02 | 1 | 9 | LAB769 | 0.78 | 3.94E-02 | 1 | 2 |
| LAB769 | 0.73 | 6.46E-02 | 1 | 6 | LAB769 | 0.72 | 6.90E-02 | 1 | 5 |
| LAB769 | 0.75 | 5.20E-02 | 1 | 4 | LAB769 | 0.70 | 7.76E-02 | 1 | 1 |
| LAB769 | 0.72 | 6.96E-02 | 1 | 7 | LAB769 | 0.70 | 7.76E-02 | 2 | 21 |
| LAB769 | 0.93 | 2.14E-03 | 2 | 33 | LAB769 | 0.79 | 3.58E-02 | 2 | 18 |
| LAB769 | 0.97 | 3.62E-04 | 2 | 32 | LAB769 | 0.87 | 1.10E-02 | 2 | 27 |
| LAB769 | 0.76 | 4.90E-02 | 2 | 10 | LAB769 | 0.78 | 3.83E-02 | 2 | 19 |
| LAB769 | 0.89 | 6.94E-03 | 2 | 1 | LAB770 | 0.76 | 4.86E-02 | 1 | 9 |
| LAB770 | 0.91 | 5.01E-03 | 1 | 3 | LAB770 | 0.72 | 7.02E-02 | 1 | 10 |
| LAB770 | 0.72 | 6.79E-02 | 1 | 11 | LAB770 | 0.94 | 1.35E-03 | 2 | 8 |
| LAB770 | 0.83 | 2.06E-02 | 1 | 27 | LAB770 | 0.82 | 2.43E-02 | 2 | 18 |
| LAB770 | 0.77 | 4.27E-02 | 2 | 32 | LAB770 | 0.79 | 3.48E-02 | 2 | 19 |
| LAB770 | 0.80 | 2.94E-02 | 2 | 27 | LAB771 | 0.72 | 6.57E-02 | 1 | 22 |
| LAB771 | 0.92 | 3.42E-03 | 1 | 24 | LAB771 | 0.72 | 6.59E-02 | 2 | 23 |

TABLE 19-continued

Correlation between the expression level of selected LAB genes of some embodiments of the invention in various tissues and the phenotypic performance under drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB771 | 0.90 | 5.99E−03 | 2 | 11 | LAB772 | 0.72 | 6.96E−02 | 1 | 33 |
| LAB771 | 0.72 | 6.70E−02 | 2 | 13 | LAB774 | 0.74 | 5.48E−02 | 1 | 17 |
| LAB772 | 0.77 | 4.45E−02 | 1 | 10 | LAB775 | 0.83 | 2.19E−02 | 1 | 33 |
| LAB774 | 0.82 | 2.52E−02 | 2 | 26 | LAB775 | 0.71 | 7.54E−02 | 1 | 20 |
| LAB775 | 0.73 | 6.50E−02 | 1 | 15 | LAB775 | 0.79 | 3.30E−02 | 1 | 10 |
| LAB775 | 0.72 | 7.01E−02 | 1 | 27 | LAB775 | 0.80 | 3.17E−02 | 1 | 1 |
| LAB775 | 0.83 | 2.19E−02 | 2 | 8 | LAB775 | 0.80 | 3.01E−02 | 2 | 9 |
| LAB775 | 0.70 | 7.97E−02 | 2 | 10 | LAB775 | 0.82 | 2.29E−02 | 2 | 27 |
| LAB775 | 0.74 | 5.59E−02 | 2 | 1 | LAB776 | 0.85 | 1.45E−02 | 1 | 30 |
| LAB776 | 0.82 | 2.54E−02 | 1 | 26 | LAB776 | 0.74 | 5.89E−02 | 1 | 24 |
| LAB776 | 0.78 | 3.96E−02 | 1 | 29 | LAB776 | 0.89 | 7.85E−03 | 1 | 25 |
| LAB776 | 0.87 | 1.12E−02 | 2 | 30 | LAB776 | 0.80 | 3.23E−02 | 2 | 15 |
| LAB776 | 0.77 | 4.38E−02 | 2 | 24 | LAB776 | 0.82 | 2.43E−02 | 2 | 29 |
| LAB776 | 0.73 | 6.23E−02 | 2 | 25 | LAB777 | 0.71 | 7.23E−02 | 1 | 33 |
| LAB777 | 0.78 | 3.83E−02 | 1 | 10 | LAB777 | 0.76 | 4.91E−02 | 1 | 27 |
| LAB777 | 0.71 | 7.66E−02 | 2 | 2 | LAB777 | 0.91 | 3.97E−03 | 2 | 6 |
| LAB777 | 0.87 | 1.13E−02 | 2 | 5 | LAB777 | 0.88 | 9.54E−03 | 2 | 4 |
| LAB777 | 0.78 | 4.00E−02 | 2 | 7 | LAB778 | 0.92 | 3.02E−03 | 1 | 33 |
| LAB778 | 0.92 | 3.36E−03 | 1 | 32 | LAB778 | 0.93 | 2.77E−03 | 1 | 10 |
| LAB778 | 0.76 | 4.62E−02 | 1 | 27 | LAB778 | 0.75 | 5.43E−02 | 1 | 1 |
| LAB778 | 0.83 | 1.94E−02 | 2 | 8 | LAB778 | 0.77 | 4.27E−02 | 2 | 3 |
| LAB778 | 0.75 | 5.05E−02 | 2 | 12 | LAB778 | 0.79 | 3.29E−02 | 2 | 11 |
| LAB779 | 0.85 | 1.52E−02 | 1 | 28 | LAB779 | 0.81 | 2.87E−02 | 1 | 10 |
| LAB779 | 0.75 | 5.10E−02 | 2 | 33 | LAB779 | 0.71 | 7.55E−02 | 2 | 32 |
| LAB779 | 0.77 | 4.51E−02 | 2 | 10 | LAB780 | 0.88 | 9.27E−03 | 1 | 31 |
| LAB780 | 0.88 | 8.94E−03 | 2 | 21 | LAB780 | 0.87 | 1.18E−02 | 2 | 33 |
| LAB780 | 0.79 | 3.63E−02 | 2 | 32 | LAB780 | 0.77 | 4.22E−02 | 2 | 6 |
| LAB780 | 0.71 | 7.31E−02 | 2 | 5 | LAB780 | 0.78 | 3.82E−02 | 2 | 4 |
| LAB781 | 0.89 | 7.09E−03 | 1 | 33 | LAB781 | 0.70 | 7.74E−02 | 1 | 20 |
| LAB781 | 0.78 | 3.88E−02 | 1 | 10 | LAB781 | 0.80 | 3.11E−02 | 1 | 32 |
| LAB781 | 0.78 | 3.71E−02 | 1 | 1 | LAB781 | 0.75 | 5.06E−02 | 1 | 27 |
| LAB781 | 0.91 | 4.22E−03 | 2 | 31 | LAB781 | 0.81 | 2.67E−02 | 1 | 19 |
| LAB781 | 0.89 | 6.90E−03 | 2 | 6 | LAB781 | 0.70 | 7.96E−02 | 2 | 20 |
| LAB781 | 0.87 | 1.15E−02 | 2 | 4 | LAB781 | 0.86 | 1.21E−02 | 2 | 5 |
| LAB783 | 0.77 | 4.51E−02 | 2 | 11 | LAB781 | 0.77 | 4.10E−02 | 2 | 7 |
| LAB784 | 0.86 | 1.34E−02 | 1 | 24 | LAB784 | 0.83 | 2.19E−02 | 1 | 30 |
| LAB784 | 0.71 | 7.51E−02 | 1 | 29 | LAB784 | 0.76 | 4.81E−02 | 1 | 22 |
| LAB784 | 0.93 | 2.83E−03 | 2 | 21 | LAB784 | 0.80 | 2.91E−02 | 1 | 25 |
| LAB784 | 0.85 | 1.53E−02 | 2 | 32 | LAB784 | 0.79 | 3.55E−02 | 2 | 33 |
| LAB784 | 0.72 | 6.98E−02 | 2 | 4 | LAB784 | 0.84 | 1.92E−02 | 2 | 18 |
| LAB785 | 0.72 | 6.78E−02 | 1 | 31 | LAB784 | 0.78 | 4.03E−02 | 2 | 19 |
| LAB785 | 0.70 | 7.85E−02 | 2 | 6 | LAB785 | 0.78 | 3.89E−02 | 2 | 31 |
| LAB786 | 0.80 | 2.90E−02 | 2 | 17 | LAB786 | 0.70 | 7.72E−02 | 1 | 14 |
| LAB787 | 0.79 | 3.55E−02 | 1 | 24 | LAB787 | 0.73 | 6.10E−02 | 1 | 12 |
| LAB787 | 0.84 | 1.68E−02 | 1 | 13 | LAB787 | 0.85 | 1.67E−02 | 1 | 22 |
| LAB789 | 0.80 | 2.90E−02 | 1 | 31 | LAB788 | 0.89 | 6.60E−03 | 2 | 26 |
| LAB789 | 0.84 | 1.81E−02 | 2 | 6 | LAB789 | 0.88 | 8.12E−03 | 2 | 2 |
| LAB789 | 0.88 | 9.25E−03 | 2 | 4 | LAB789 | 0.87 | 1.14E−02 | 2 | 5 |
| LAB790 | 0.88 | 8.23E−03 | 1 | 30 | LAB789 | 0.88 | 8.10E−03 | 2 | 7 |
| LAB790 | 0.82 | 2.40E−02 | 1 | 24 | LAB790 | 0.82 | 2.47E−02 | 1 | 26 |
| LAB790 | 0.70 | 7.97E−02 | 1 | 16 | LAB790 | 0.80 | 3.12E−02 | 1 | 22 |
| LAB790 | 0.95 | 1.02E−03 | 1 | 25 | LAB790 | 0.76 | 4.54E−02 | 1 | 29 |
| LAB790 | 0.93 | 2.44E−03 | 2 | 26 | LAB790 | 0.75 | 5.03E−02 | 2 | 2 |
| LAB792 | 0.76 | 4.66E−02 | 1 | 22 | LAB791 | 0.81 | 2.71E−02 | 1 | 17 |
| LAB792 | 0.74 | 5.47E−02 | 1 | 13 | LAB792 | 0.78 | 3.85E−02 | 1 | 25 |
| LAB792 | 0.80 | 2.90E−02 | 2 | 33 | LAB792 | 0.72 | 6.68E−02 | 2 | 21 |
| LAB792 | 0.71 | 7.31E−02 | 2 | 18 | LAB792 | 0.85 | 1.57E−02 | 2 | 32 |
| LAB793 | 0.89 | 7.98E−03 | 1 | 10 | LAB793 | 0.76 | 4.54E−02 | 1 | 33 |
| LAB793 | 0.77 | 4.10E−02 | 2 | 24 | LAB793 | 0.75 | 5.08E−02 | 2 | 11 |
| LAB793 | 0.84 | 1.84E−02 | 2 | 23 | LAB793 | 0.91 | 4.74E−03 | 2 | 22 |
| LAB793 | 0.82 | 2.31E−02 | 2 | 25 | LAB793 | 0.71 | 7.66E−02 | 2 | 29 |
| LAB794 | 0.94 | 1.67E−03 | 1 | 30 | LAB793 | 0.98 | 8.22E−05 | 2 | 13 |
| LAB794 | 0.70 | 7.99E−02 | 1 | 24 | LAB794 | 0.93 | 2.15E−03 | 1 | 15 |
| LAB794 | 0.96 | 7.10E−04 | 1 | 29 | LAB794 | 0.70 | 7.98E−02 | 1 | 17 |
| LAB794 | 0.71 | 7.23E−02 | 2 | 15 | LAB794 | 0.80 | 3.05E−02 | 1 | 25 |
| LAB795 | 0.74 | 5.92E−02 | 2 | 31 | LAB794 | 0.79 | 3.35E−02 | 2 | 17 |
| LAB796 | 0.86 | 1.24E−02 | 2 | 11 | LAB796 | 0.89 | 7.76E−03 | 2 | 3 |
| LAB797 | 0.91 | 4.11E−03 | 1 | 12 | LAB796 | 0.73 | 6.48E−02 | 2 | 23 |
| LAB798 | 0.73 | 6.24E−02 | 1 | 9 | LAB797 | 0.77 | 4.21E−02 | 2 | 12 |

TABLE 19-continued

Correlation between the expression level of selected LAB genes of some embodiments of the invention in various tissues and the phenotypic performance under drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB799 | 0.79 | 3.28E−02 | 2 | 12 | LAB798 | 0.70 | 7.76E−02 | 1 | 20 |
| LAB799 | 0.92 | 3.04E−03 | 2 | 23 | LAB799 | 0.80 | 3.01E−02 | 1 | 12 |
| LAB799 | 0.91 | 4.50E−03 | 2 | 13 | | | | | |

Table 19.
Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 20

Correlation between the expression level of selected LAB genes of some embodiments of the invention in various tissues and the phenotypic performance of maintenance of performance under drought across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB740 | 0.74 | 5.77E−02 | 1 | 8 | LAB740 | 0.78 | 3.83E−02 | 1 | 23 |
| LAB740 | 0.77 | 4.21E−02 | 1 | 21 | LAB740 | 0.80 | 3.26E−02 | 1 | 12 |
| LAB740 | 0.85 | 1.49E−02 | 1 | 16 | LAB740 | 0.72 | 6.94E−02 | 1 | 9 |
| LAB741 | 0.78 | 3.92E−02 | 1 | 15 | LAB741 | 0.78 | 3.69E−02 | 1 | 13 |
| LAB741 | 0.89 | 7.19E−03 | 1 | 24 | LAB741 | 0.74 | 5.60E−02 | 1 | 27 |
| LAB741 | 0.75 | 5.24E−02 | 1 | 14 | LAB742 | 0.75 | 5.13E−02 | 2 | 19 |
| LAB742 | 0.76 | 4.96E−02 | 2 | 6 | LAB744 | 0.76 | 4.73E−02 | 1 | 19 |
| LAB745 | 0.73 | 6.06E−02 | 2 | 19 | LAB746 | 0.78 | 3.77E−02 | 1 | 8 |
| LAB746 | 0.78 | 3.92E−02 | 1 | 23 | LAB746 | 0.75 | 5.30E−02 | 1 | 21 |
| LAB746 | 0.74 | 5.94E−02 | 1 | 13 | LAB746 | 0.95 | 1.09E−03 | 1 | 6 |
| LAB746 | 0.70 | 7.94E−02 | 1 | 14 | LAB746 | 0.80 | 2.97E−02 | 1 | 9 |
| LAB746 | 0.90 | 5.69E−03 | 1 | 7 | LAB746 | 0.74 | 5.87E−02 | 2 | 8 |
| LAB746 | 0.71 | 7.62E−02 | 2 | 12 | LAB746 | 0.91 | 4.86E−03 | 2 | 6 |
| LAB746 | 0.74 | 5.73E−02 | 2 | 18 | LAB746 | 0.85 | 1.49E−02 | 2 | 7 |
| LAB748 | 0.76 | 4.80E−02 | 1 | 19 | LAB748 | 0.73 | 6.08E−02 | 1 | 6 |
| LAB750 | 0.70 | 7.99E−02 | 1 | 25 | LAB750 | 0.77 | 4.12E−02 | 1 | 29 |
| LAB750 | 0.95 | 1.04E−03 | 1 | 26 | LAB750 | 0.82 | 2.47E−02 | 1 | 11 |
| LAB750 | 0.78 | 3.67E−02 | 1 | 17 | LAB750 | 0.82 | 2.42E−02 | 2 | 29 |
| LAB750 | 0.86 | 1.23E−02 | 2 | 26 | LAB750 | 0.80 | 3.06E−02 | 2 | 17 |
| LAB751 | 0.81 | 2.81E−02 | 1 | 25 | LAB751 | 0.73 | 6.18E−02 | 1 | 26 |
| LAB751 | 0.89 | 7.98E−03 | 2 | 25 | LAB751 | 0.98 | 1.71E−04 | 2 | 26 |
| LAB751 | 0.70 | 7.76E−02 | 2 | 11 | LAB751 | 0.75 | 5.15E−02 | 2 | 17 |
| LAB752 | 0.73 | 6.04E−02 | 1 | 8 | LAB752 | 0.82 | 2.46E−02 | 1 | 23 |
| LAB752 | 0.79 | 3.64E−02 | 1 | 21 | LAB752 | 0.76 | 4.91E−02 | 1 | 12 |
| LAB752 | 0.96 | 5.72E−04 | 1 | 15 | LAB752 | 0.93 | 2.36E−03 | 1 | 13 |
| LAB752 | 0.87 | 9.97E−03 | 1 | 24 | LAB752 | 0.85 | 1.49E−02 | 1 | 6 |
| LAB752 | 0.90 | 5.32E−03 | 1 | 27 | LAB752 | 0.88 | 8.53E−03 | 1 | 14 |
| LAB752 | 0.81 | 2.72E−02 | 1 | 18 | LAB752 | 0.94 | 1.60E−03 | 1 | 7 |
| LAB753 | 0.74 | 5.84E−02 | 1 | 21 | LAB753 | 0.71 | 7.40E−02 | 1 | 13 |
| LAB753 | 0.91 | 4.77E−03 | 1 | 6 | LAB753 | 0.75 | 5.32E−02 | 1 | 9 |
| LAB753 | 0.86 | 1.42E−02 | 1 | 7 | LAB753 | 0.95 | 1.00E−03 | 2 | 22 |
| LAB753 | 0.89 | 7.99E−03 | 2 | 20 | LAB753 | 0.74 | 5.61E−02 | 2 | 14 |
| LAB754 | 0.82 | 2.27E−02 | 1 | 8 | LAB754 | 0.93 | 2.14E−03 | 1 | 23 |
| LAB754 | 0.94 | 1.94E−03 | 1 | 21 | LAB754 | 0.87 | 1.04E−02 | 1 | 12 |
| LAB754 | 0.75 | 5.00E−02 | 1 | 6 | LAB754 | 0.83 | 1.96E−02 | 1 | 27 |
| LAB754 | 0.94 | 1.62E−03 | 1 | 16 | LAB754 | 0.75 | 5.42E−02 | 1 | 7 |
| LAB754 | 0.84 | 1.89E−02 | 2 | 8 | LAB754 | 0.94 | 1.67E−03 | 2 | 23 |
| LAB754 | 0.99 | 5.34E−06 | 2 | 21 | LAB754 | 0.87 | 1.06E−02 | 2 | 12 |
| LAB754 | 0.88 | 8.53E−03 | 2 | 6 | LAB754 | 0.76 | 4.72E−02 | 2 | 27 |
| LAB754 | 0.98 | 1.17E−04 | 2 | 16 | LAB754 | 0.78 | 3.66E−02 | 2 | 9 |
| LAB754 | 0.85 | 1.48E−02 | 2 | 7 | LAB756 | 0.79 | 3.55E−02 | 1 | 8 |
| LAB756 | 0.90 | 5.40E−03 | 1 | 23 | LAB756 | 0.95 | 9.87E−04 | 1 | 21 |
| LAB756 | 0.74 | 5.97E−02 | 1 | 22 | LAB756 | 0.85 | 1.62E−02 | 1 | 12 |
| LAB756 | 0.74 | 5.61E−02 | 1 | 15 | LAB756 | 0.85 | 1.47E−02 | 1 | 13 |
| LAB756 | 0.79 | 3.55E−02 | 1 | 6 | LAB756 | 0.87 | 1.08E−02 | 1 | 27 |
| LAB756 | 0.91 | 4.01E−03 | 1 | 16 | LAB756 | 0.89 | 6.67E−03 | 1 | 14 |
| LAB756 | 0.83 | 2.20E−02 | 1 | 7 | LAB756 | 0.74 | 5.56E−02 | 2 | 22 |
| LAB756 | 0.76 | 4.85E−02 | 2 | 20 | LAB757 | 0.74 | 5.84E−02 | 2 | 29 |
| LAB757 | 0.76 | 4.81E−02 | 2 | 20 | LAB758 | 0.95 | 9.02E−04 | 1 | 19 |
| LAB758 | 0.79 | 3.56E−02 | 1 | 10 | LAB758 | 0.88 | 8.09E−03 | 2 | 19 |
| LAB759 | 0.77 | 4.21E−02 | 1 | 8 | LAB759 | 0.97 | 3.94E−04 | 1 | 23 |

TABLE 20-continued

Correlation between the expression level of selected LAB genes of some embodiments of the invention in various tissues and the phenotypic performance of maintenance of performance under drought across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB759 | 0.89 | 6.53E−03 | 1 | 21 | LAB759 | 0.85 | 1.46E−02 | 1 | 12 |
| LAB759 | 0.76 | 4.96E−02 | 1 | 15 | LAB759 | 0.82 | 2.28E−02 | 1 | 13 |
| LAB759 | 0.90 | 5.81E−03 | 1 | 6 | LAB759 | 0.92 | 2.94E−03 | 1 | 27 |
| LAB759 | 0.90 | 5.80E−03 | 1 | 16 | LAB759 | 0.75 | 5.39E−02 | 1 | 14 |
| LAB759 | 0.70 | 7.74E−02 | 1 | 9 | LAB759 | 0.92 | 3.44E−03 | 1 | 7 |
| LAB759 | 0.82 | 2.46E−02 | 2 | 8 | LAB759 | 0.88 | 9.15E−03 | 2 | 23 |
| LAB759 | 0.86 | 1.28E−02 | 2 | 21 | LAB759 | 0.86 | 1.27E−02 | 2 | 12 |
| LAB759 | 0.72 | 7.09E−02 | 2 | 13 | LAB759 | 0.96 | 4.89E−04 | 2 | 6 |
| LAB759 | 0.77 | 4.13E−02 | 2 | 27 | LAB759 | 0.75 | 5.04E−02 | 2 | 16 |
| LAB759 | 0.76 | 4.53E−02 | 2 | 18 | LAB759 | 0.73 | 6.26E−02 | 2 | 9 |
| LAB759 | 0.94 | 1.50E−03 | 2 | 7 | LAB761 | 0.75 | 5.15E−02 | 1 | 25 |
| LAB761 | 0.92 | 3.47E−03 | 1 | 26 | LAB761 | 0.71 | 7.41E−02 | 1 | 4 |
| LAB761 | 0.86 | 1.20E−02 | 1 | 11 | LAB761 | 0.76 | 4.82E−02 | 1 | 17 |
| LAB762 | 0.92 | 3.15E−03 | 1 | 8 | LAB762 | 0.91 | 4.25E−03 | 1 | 23 |
| LAB762 | 0.87 | 1.02E−02 | 1 | 21 | LAB762 | 0.77 | 4.12E−02 | 1 | 12 |
| LAB762 | 0.76 | 4.73E−02 | 1 | 13 | LAB762 | 0.91 | 4.79E−03 | 1 | 6 |
| LAB762 | 0.75 | 5.19E−02 | 1 | 27 | LAB762 | 0.79 | 3.63E−02 | 1 | 16 |
| LAB762 | 0.74 | 5.64E−02 | 1 | 14 | LAB762 | 0.88 | 9.59E−03 | 1 | 9 |
| LAB762 | 0.95 | 1.02E−03 | 1 | 7 | LAB762 | 0.70 | 7.88E−02 | 2 | 25 |
| LAB763 | 0.92 | 3.57E−03 | 1 | 8 | LAB763 | 0.87 | 1.01E−02 | 1 | 23 |
| LAB763 | 0.82 | 2.42E−02 | 1 | 21 | LAB763 | 0.95 | 1.18E−03 | 1 | 12 |
| LAB763 | 0.71 | 7.28E−02 | 1 | 13 | LAB763 | 0.77 | 4.20E−02 | 1 | 6 |
| LAB763 | 0.89 | 7.20E−03 | 1 | 27 | LAB763 | 0.73 | 6.31E−02 | 1 | 16 |
| LAB763 | 0.77 | 4.32E−02 | 1 | 14 | LAB763 | 0.88 | 8.10E−03 | 1 | 18 |
| LAB763 | 0.86 | 1.30E−02 | 1 | 7 | LAB763 | 0.70 | 7.88E−02 | 2 | 28 |
| LAB764 | 0.80 | 3.00E−02 | 1 | 15 | LAB764 | 0.89 | 7.69E−03 | 1 | 13 |
| LAB764 | 0.80 | 2.92E−02 | 1 | 24 | LAB764 | 0.87 | 1.12E−02 | 1 | 27 |
| LAB764 | 0.74 | 5.47E−02 | 1 | 20 | LAB764 | 0.91 | 4.53E−03 | 1 | 14 |
| LAB764 | 0.75 | 5.36E−02 | 1 | 18 | LAB764 | 0.76 | 4.61E−02 | 1 | 7 |
| LAB764 | 0.70 | 7.88E−02 | 2 | 1 | LAB764 | 0.83 | 2.16E−02 | 2 | 29 |
| LAB764 | 0.92 | 3.42E−03 | 2 | 17 | LAB765 | 0.76 | 4.58E−02 | 1 | 8 |
| LAB765 | 0.87 | 1.08E−02 | 1 | 23 | LAB765 | 0.79 | 3.42E−02 | 1 | 21 |
| LAB765 | 0.76 | 4.66E−02 | 1 | 12 | LAB765 | 0.88 | 9.55E−03 | 1 | 6 |
| LAB765 | 0.76 | 4.95E−02 | 1 | 16 | LAB765 | 0.88 | 8.64E−03 | 1 | 9 |
| LAB765 | 0.79 | 3.36E−02 | 1 | 7 | LAB765 | 0.71 | 7.36E−02 | 2 | 19 |
| LAB765 | 0.79 | 3.50E−02 | 2 | 10 | LAB767 | 0.93 | 2.20E−03 | 1 | 8 |
| LAB767 | 0.70 | 7.78E−02 | 1 | 23 | LAB767 | 0.79 | 3.44E−02 | 1 | 21 |
| LAB767 | 0.72 | 6.96E−02 | 1 | 12 | LAB767 | 0.88 | 9.55E−03 | 1 | 6 |
| LAB767 | 0.78 | 3.83E−02 | 1 | 18 | LAB767 | 0.81 | 2.66E−02 | 1 | 9 |
| LAB767 | 0.90 | 5.14E−03 | 1 | 7 | LAB768 | 0.74 | 5.83E−02 | 1 | 21 |
| LAB768 | 0.86 | 1.38E−02 | 1 | 6 | LAB768 | 0.73 | 6.32E−02 | 1 | 16 |
| LAB768 | 0.82 | 2.52E−02 | 1 | 9 | LAB768 | 0.74 | 5.50E−02 | 2 | 1 |
| LAB768 | 0.82 | 2.49E−02 | 2 | 29 | LAB768 | 0.85 | 1.52E−02 | 2 | 26 |
| LAB768 | 0.77 | 4.36E−02 | 2 | 4 | LAB768 | 0.75 | 5.00E−02 | 2 | 2 |
| LAB768 | 0.71 | 7.44E−02 | 2 | 3 | LAB768 | 0.87 | 1.15E−02 | 2 | 11 |
| LAB768 | 0.93 | 2.37E−03 | 2 | 17 | LAB769 | 0.86 | 1.22E−02 | 2 | 25 |
| LAB769 | 0.79 | 3.55E−02 | 2 | 29 | LAB769 | 0.95 | 1.12E−02 | 2 | 26 |
| LAB769 | 0.73 | 6.15E−02 | 2 | 2 | LAB769 | 0.79 | 3.39E−02 | 2 | 11 |
| LAB769 | 0.93 | 2.41E−03 | 2 | 17 | LAB770 | 0.90 | 6.26E−03 | 1 | 25 |
| LAB770 | 0.70 | 7.81E−02 | 1 | 26 | LAB770 | 0.81 | 2.60E−02 | 2 | 25 |
| LAB770 | 0.71 | 7.22E−02 | 2 | 26 | LAB771 | 0.78 | 3.75E−02 | 1 | 23 |
| LAB771 | 0.80 | 3.10E−02 | 1 | 21 | LAB771 | 0.72 | 6.93E−02 | 1 | 27 |
| LAB771 | 0.85 | 1.55E−02 | 1 | 16 | LAB771 | 0.85 | 1.46E−02 | 2 | 9 |
| LAB772 | 0.77 | 4.10E−02 | 1 | 26 | LAB772 | 0.78 | 3.92E−02 | 1 | 11 |
| LAB774 | 0.76 | 4.72E−02 | 2 | 22 | LAB775 | 0.80 | 3.17E−02 | 1 | 25 |
| LAB775 | 0.81 | 2.80E−02 | 1 | 26 | LAB775 | 0.79 | 3.43E−02 | 2 | 25 |
| LAB776 | 0.75 | 5.38E−02 | 1 | 23 | LAB776 | 0.88 | 8.98E−03 | 1 | 15 |
| LAB776 | 0.90 | 5.90E−03 | 1 | 13 | LAB776 | 0.82 | 2.52E−02 | 1 | 6 |
| LAB776 | 0.77 | 4.42E−02 | 1 | 27 | LAB776 | 0.82 | 2.43E−02 | 1 | 14 |
| LAB776 | 0.86 | 1.21E−02 | 1 | 7 | LAB776 | 0.76 | 4.92E−02 | 2 | 23 |
| LAB776 | 0.72 | 6.63E−02 | 2 | 15 | LAB776 | 0.71 | 7.24E−02 | 2 | 27 |
| LAB777 | 0.73 | 6.32E−02 | 1 | 25 | LAB777 | 0.78 | 3.93E−02 | 1 | 26 |
| LAB778 | 0.79 | 3.42E−02 | 1 | 25 | LAB778 | 0.88 | 8.16E−03 | 1 | 26 |
| LAB778 | 0.73 | 6.44E−02 | 1 | 17 | LAB779 | 0.78 | 3.92E−02 | 2 | 25 |
| LAB779 | 0.75 | 5.11E−02 | 2 | 26 | LAB780 | 0.82 | 2.51E−02 | 1 | 15 |
| LAB780 | 0.82 | 2.27E−02 | 1 | 24 | LAB780 | 0.73 | 6.52E−02 | 2 | 22 |
| LAB780 | 0.78 | 4.05E−02 | 2 | 26 | LAB780 | 0.81 | 2.64E−02 | 2 | 20 |
| LAB780 | 0.70 | 7.95E−02 | 2 | 17 | LAB781 | 0.78 | 3.85E−02 | 1 | 29 |
| LAB781 | 0.85 | 1.48E−02 | 1 | 26 | LAB783 | 0.71 | 7.23E−02 | 1 | 1 |
| LAB783 | 0.75 | 5.09E−02 | 1 | 22 | LAB783 | 0.72 | 6.75E−02 | 1 | 4 |
| LAB783 | 0.79 | 3.40E−02 | 1 | 20 | LAB783 | 0.71 | 7.22E−02 | 1 | 14 |
| LAB783 | 0.84 | 1.75E−02 | 1 | 10 | LAB783 | 0.73 | 6.29E−02 | 2 | 25 |
| LAB784 | 0.72 | 6.68E−02 | 1 | 23 | LAB784 | 0.82 | 2.31E−02 | 1 | 21 |

TABLE 20-continued

Correlation between the expression level of selected LAB genes of some
embodiments of the invention in various tissues and the phenotypic performance
of maintenance of performance under drought across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB784 | 0.93 | 2.83E−03 | 1 | 15 | LAB784 | 0.82 | 2.29E−02 | 1 | 13 |
| LAB784 | 0.71 | 7.64E−02 | 1 | 24 | LAB784 | 0.81 | 2.73E−02 | 1 | 6 |
| LAB784 | 0.78 | 3.86E−02 | 1 | 27 | LAB784 | 0.81 | 2.85E−02 | 1 | 16 |
| LAB784 | 0.70 | 7.83E−02 | 1 | 7 | LAB784 | 0.80 | 3.25E−02 | 2 | 1 |
| LAB784 | 0.87 | 1.08E−02 | 2 | 29 | LAB784 | 0.72 | 7.00E−02 | 2 | 26 |
| LAB784 | 0.73 | 6.15E−02 | 2 | 4 | LAB784 | 0.77 | 4.28E−02 | 2 | 2 |
| LAB784 | 0.73 | 6.41E−02 | 2 | 20 | LAB784 | 0.76 | 4.94E−02 | 2 | 3 |
| LAB784 | 0.79 | 3.33E−02 | 2 | 11 | LAB784 | 0.97 | 3.93E−04 | 2 | 17 |
| LAB784 | 0.71 | 7.57E−02 | 2 | 5 | LAB787 | 0.72 | 7.03E−02 | 1 | 8 |
| LAB787 | 0.80 | 2.98E−02 | 1 | 23 | LAB787 | 0.81 | 2.79E−02 | 1 | 21 |
| LAB787 | 0.89 | 6.49E−03 | 1 | 12 | LAB787 | 0.77 | 4.25E−02 | 1 | 27 |
| LAB787 | 0.81 | 2.62E−02 | 1 | 16 | LAB788 | 0.81 | 2.68E−02 | 2 | 22 |
| LAB788 | 0.72 | 6.92E−02 | 2 | 15 | LAB789 | 0.71 | 7.55E−02 | 1 | 24 |
| LAB790 | 0.78 | 3.98E−02 | 1 | 8 | LAB790 | 0.83 | 2.23E−02 | 1 | 23 |
| LAB790 | 0.83 | 2.16E−02 | 1 | 21 | LAB790 | 0.85 | 1.62E−02 | 1 | 15 |
| LAB790 | 0.95 | 8.48E−04 | 1 | 13 | LAB790 | 0.71 | 7.20E−02 | 1 | 24 |
| LAB790 | 0.87 | 1.02E−02 | 1 | 6 | LAB790 | 0.86 | 1.25E−02 | 1 | 27 |
| LAB790 | 0.73 | 6.48E−02 | 1 | 16 | LAB790 | 0.95 | 1.07E−03 | 1 | 14 |
| LAB790 | 0.78 | 3.82E−02 | 1 | 18 | LAB790 | 0.78 | 3.70E−02 | 1 | 9 |
| LAB790 | 0.95 | 8.94E−04 | 1 | 7 | LAB790 | 0.91 | 4.69E−03 | 2 | 22 |
| LAB790 | 0.72 | 7.03E−02 | 2 | 15 | LAB790 | 0.72 | 6.94E−02 | 2 | 13 |
| LAB790 | 0.71 | 7.39E−02 | 2 | 20 | LAB790 | 0.74 | 5.97E−02 | 2 | 14 |
| LAB792 | 0.92 | 3.53E−03 | 1 | 8 | LAB792 | 0.72 | 6.88E−02 | 1 | 23 |
| LAB792 | 0.73 | 6.08E−02 | 1 | 12 | LAB792 | 0.71 | 7.29E−02 | 1 | 13 |
| LAB792 | 0.78 | 3.76E−02 | 1 | 6 | LAB792 | 0.81 | 2.58E−02 | 1 | 14 |
| LAB792 | 0.88 | 9.19E−03 | 1 | 18 | LAB792 | 0.89 | 8.00E−03 | 1 | 7 |
| LAB792 | 0.73 | 6.15E−02 | 2 | 1 | LAB792 | 0.75 | 5.38E−02 | 2 | 26 |
| LAB792 | 0.73 | 6.04E−02 | 2 | 4 | LAB792 | 0.78 | 4.06E−02 | 2 | 2 |
| LAB792 | 0.73 | 6.03E−02 | 2 | 3 | LAB792 | 0.77 | 4.39E−02 | 2 | 11 |
| LAB792 | 0.88 | 8.35E−03 | 2 | 17 | LAB793 | 0.71 | 7.57E−02 | 1 | 25 |
| LAB793 | 0.71 | 7.59E−02 | 1 | 26 | LAB793 | 0.79 | 3.63E−02 | 2 | 8 |
| LAB793 | 0.95 | 1.12E−03 | 2 | 23 | LAB793 | 0.89 | 7.66E−03 | 2 | 21 |
| LAB793 | 0.85 | 1.53E−02 | 2 | 12 | LAB793 | 0.83 | 2.19E−02 | 2 | 6 |
| LAB793 | 0.73 | 6.37E−02 | 2 | 27 | LAB793 | 0.89 | 7.10E−03 | 2 | 16 |
| LAB793 | 0.83 | 2.20E−02 | 2 | 9 | LAB793 | 0.77 | 4.19E−02 | 2 | 7 |
| LAB794 | 0.73 | 6.24E−02 | 1 | 23 | LAB794 | 0.73 | 6.03E−02 | 1 | 15 |
| LAB794 | 0.75 | 5.16E−02 | 1 | 6 | LAB794 | 0.82 | 2.31E−02 | 1 | 9 |
| LAB796 | 0.86 | 1.37E−02 | 1 | 8 | LAB796 | 0.78 | 4.05E−02 | 1 | 12 |
| LAB796 | 0.70 | 7.83E−02 | 1 | 24 | LAB796 | 0.71 | 7.24E−02 | 1 | 27 |
| LAB796 | 0.76 | 4.79E−02 | 1 | 18 | LAB796 | 0.72 | 6.82E−02 | 2 | 16 |
| LAB799 | 0.74 | 5.81E−02 | 1 | 28 | LAB799 | 0.77 | 4.22E−02 | 1 | 24 |
| LAB799 | 0.76 | 4.58E−02 | 2 | 28 | LAB799 | 0.72 | 6.63E−02 | 2 | 8 |
| LAB799 | 0.78 | 3.91E−02 | 2 | 23 | LAB799 | 0.82 | 2.44E−02 | 2 | 19 |
| LAB799 | 0.72 | 6.64E−02 | 2 | 12 | LAB799 | 0.75 | 5.23E−02 | 2 | 9 |

Table 20.
Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 4

Production of *Sorghum* Transcriptom and High Throughput Correlation Analysis with Biomass, Nue, and Abst Related Parameters Measured in Semi-Hydroponics Conditions Using 44K Sorghum Oligonucleotide Micro-Arrays

*Sorghum* vigor related parameters under high salinity (100 mM NaCl), low temperature (10±2° C.), low nitrogen conditions and normal growth conditions—Ten *Sorghum* hybrids were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to Normal growth conditions (Full Hoagland containing 16 mM Nitrogen solution, at 28±2° C.), high salinity conditions (100 mM NaCl in addition to the Full Hoagland solution), low temperature conditions (10±2° C. in the presence of Full Hoagland solution), or low nitrogen conditions (the amount of total nitrogen was reduced in 90% from the full Hoagland solution (i.e., to a final concentration of 10% from full Hoagland solution, final amount of 1.2 mM Nitrogen). All plants were grown at 28±2° C. except where otherwise indicated (i.e., in the low temperature conditions).

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed *Sorghum* tissues—All 10 selected *Sorghum* hybrids were sampled per each treatment. Three tissues

[leaves, meristems and roots] growing at 100 mM NaCl, low temperature (10±2° C.), low Nitrogen (1.2 mM Nitrogen) or under Normal conditions were sampled and RNA was extracted as described above. Each micro-array expression information tissue type has received a Set ID as summarized in Table 21 below.

TABLE 21

Sorghum transcriptom expression sets under semi hydroponics conditions

| Expression Set | Set ID |
|---|---|
| Sorghum bath/Cold/root | 1 |
| Sorghum bath/Normal/root | 2 |
| Sorghum bath/NUE/root | 3 |
| Sorghum bath/NaCl/root | 4 |
| Sorghum bath/Cold/vegetative meristem | 5 |
| Sorghum bath/NUE/vegetative meristem | 6 |
| Sorghum bath/NaCl/vegetative meristem | 7 |
| Sorghum bath/Normal/vegetative meristem | 8 |

Table 21: Provided are the Sorghum transcriptom expression sets.
Cold conditions = 10 ± 2° C.;
NaCl = 100 mM NaCl;
low nitrogen = 1.2 mM Nitrogen;
Normal conditions = 16 mM Nitrogen.

Sorghum Biomass, Vigor, Nitrogen Use Efficiency and Growth-Related Components

Root DW [gr]—At the end of the experiment, the root material was collected, measured and divided by the number of Plants.

Shoot DW [gr]—At the end of the experiment, the shoot material (without roots) was collected, measured and divided by the number of Plants.

Total biomass [gr]—total biomass including roots and shoots.

Leaf num [num]—number op opened leaves.

RGR Leaf Num—calculated relative growth rate (RGR) of leaf number.

Shoot/Root—biomass of shoot divided by biomass of roots.

NUE per total biomass—nitrogen use efficiency (NUE) of total biomass.

NUE per root biomass—nitrogen use efficiency (NUE) of total biomass.

NUE per shoot biomass—nitrogen use efficiency (NUE) of total biomass.

Percent of reduction of root biomass compared to normal—the difference (reduction in percent) between root biomass under normal and under low nitrogen conditions.

Percent of reduction of shoot biomass compared to normal—the difference (reduction in percent) between shoot biomass under normal and under low nitrogen conditions.

Percent of reduction of total biomass compared to normal—the difference (reduction in percent) between total biomass (shoot and root) under normal and under low nitrogen conditions.

Plant height [cm]—Plants were characterized for height during growing period at 5 time points. In each measure, plants were measured for their height using a measuring tape. Height was measured from ground level to top of the longest leaf.

SPAD [SPAD unit]—Chlorophyll content was determined using a Minolta SPAD 502 chlorophyll meter and measurement was performed 64 days post sowing. SPAD meter readings were done on young fully developed leaf. Three measurements per leaf were taken per plot.

Root Biomass [DW, gr.]/SPAD—root biomass divided by SPAD results.

Shoot Biomass [DW, gr.]/SPAD—shoot biomass divided by SPAD results.

Total Biomass (Root+Shoot) [DW, gr.]/SPAD—total biomass divided by SPAD results.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot.

Experimental Results 10 different Sorghum hybrids were grown and characterized for various biomass and nitrogen use efficiency (NUE) parameters as described in Table 22, below. The average for each of the measured parameter was calculated using the JMP software and values are summarized in Table 23-30 below. Subsequent correlation analysis was performed (Table 31). Results were then integrated to the database.

TABLE 22

Sorghum correlated parameters (vectors)

| Correlated parameter with | Correlation ID |
|---|---|
| Root DW/Plant at 100 mM NaCl [gr] | 1 |
| Root DW/Plant at Cold [gr] | 2 |
| Root DW/Plant at Low Nitrogen [gr] | 3 |
| Root DW/Plant at Normal [gr] | 4 |
| Shoot DW/Plant at Low Nitrogen [gr] | 5 |
| Shoot DW/Plant at 100 mM NaCl [gr] | 6 |
| Shoot DW/Plant at Cold [gr] | 7 |
| Shoot DW/Plant at Normal [gr] | 8 |
| Leaf num TP1 at 100 mM NaCl [num] | 9 |
| Leaf num TP1 at Cold [num] | 10 |
| Leaf num TP1 - Low Nitrogen [num] | 11 |
| Leaf num TP1 - Normal [num] | 12 |
| Leaf num TP2 - 100 mM NaCl [num] | 13 |
| Leaf num TP2 - Cold [num] | 14 |
| Leaf num TP2 - Low Nitrogen [num] | 15 |
| Leaf num TP2 - Normal [num] | 16 |
| Leaf num TP3 - 100 mM NaCl [num] | 17 |
| Leaf num TP3 - Cold [num] | 18 |
| Leaf num TP3 - Low Nitrogen [num] | 19 |
| Leaf num TP3 - Normal [num] | 20 |
| NUE per total biomass - Low N- | 21 |
| Shoot/Root - Low N- | 22 |
| NUE per root biomass Low N-NUE roots | 23 |
| NUE per shoot biomass Low N-NUE shoots | 24 |
| Percent of reduction of root biomass compared to normal - Low N- | 25 |
| Percent of reduction of shoot biomass compared to normal Low N- | 26 |
| Percent of reduction of total biomass compared to normal Low N-percent-total biomass reduction compared to normal | 27 |
| N level/Leaf [Low Nitrogen] | 28 |
| N level/Leaf [100 mM NaCl] | 29 |
| N level/Leaf [Cold] | 30 |
| N level/Leaf [Normal] | 31 |
| Shoot/Root—Normal - Shoot/Root | 32 |
| NUE per root biomass - Normal- | 33 |
| NUE per shoot biomass - Normal- | 34 |
| NUE per total biomass - Normal- | 35 |
| Plant Height TP1 - 100 mM NaCl [cm] | 36 |
| Plant Height TP1 - Cold [cm] | 37 |
| Plant Height TP1 - Low Nitrogen [cm] | 38 |
| Plant Height TP1 - Normal [cm] | 39 |
| Plant Height TP2 - Cold [cm] | 40 |
| Plant Height TP2 - Low Nitrogen [cm] | 41 |
| Plant Height TP2 - Normal [cm] | 42 |
| Plant Height TP2 - 100 mM NaCl [cm] | 43 |
| Plant Height TP3 - 100 mM NaCl [cm] | 44 |
| Plant Height TP3 - Low Nitrogen [cm] | 45 |

TABLE 22-continued

Sorghum correlated parameters (vectors)

| Correlated parameter with | Correlation ID |
|---|---|
| RGR_Leaf_Num_Normal | 46 |
| Root Biomass [DW - gr.]/SPAD [100 mM NaCl] | 47 |
| Root Biomass [DW - gr.]/SPAD [Cold] | 48 |
| Root Biomass [DW - gr.]/SPAD [Low Nitrogen] | 49 |
| Root Biomass [DW - gr.]/SPAD [Normal] | 50 |
| SPAD - Cold (SPAD unit) | 51 |
| SPAD - Low Nitrogen (SPAD unit) | 52 |
| SPAD - Normal (SPAD unit) | 53 |
| SPAD 100 - mM NaCl (SPAD unit) | 54 |
| Shoot Biomass [DW - gr.]/SPAD [100 mM NaCl] | 55 |
| Shoot Biomass [DW - gr.]/SPAD [Cold] | 56 |
| Shoot Biomass [DW - gr.]/SPAD [Low Nitrogen] | 57 |
| Shoot Biomass [DW - gr.]/SPAD [Normal] | 58 |
| Total Biomass-Root + Shoot [DW - gr.]/SPAD [100 mM NaCl] | 59 |
| Total Biomass-Root + Shoot [DW - gr.]/SPAD [Cold] | 60 |
| Total Biomass-Root + Shoot [DW - gr.]/SPAD [Low Nitrogen] | 61 |
| Total Biomass-Root + Shoot[DW - gr.]/SPAD [Normal] | 62 |

Table 22: Provided are the Sorghum correlated parameters.
"N" = nitrogen;
Cold conditions = 10 ± 2° C.;
NaCl = 100 mM NaCl;
Low nitrogen = 1.2 mM Nitrogen;
Normal conditions = 16 mM Nitrogen;
"TP" = time point. Thus, TP1, TP2 and TP3 refer to time points 1, 2 (TP1 + 8 days) and 3 (TP2 + 7 days), respectively.

TABLE 23

Sorghum accessions, measured parameters under low nitrogen growth conditions

| Line | Corr. ID | | | | | | | | | | |
|---|---|---|---|---|---|---|---|---|---|---|---|
| | 3 | 5 | 11 | 15 | 19 | 38 | 41 | 45 | 52 | 21 | 22 |
| Line-1 | 0.04 | 0.08 | 3.00 | 4.00 | 3.90 | 6.73 | 13.30 | 22.23 | 26.88 | 27.53 | 1.87 |
| Line-2 | 0.11 | 0.19 | 3.13 | 4.58 | 4.27 | 9.77 | 20.63 | 31.07 | 28.02 | 64.12 | 1.71 |
| Line-3 | 0.20 | 0.33 | 3.87 | 4.97 | 4.70 | 12.70 | 23.70 | 34.67 | 29.64 | 115.23 | 1.73 |
| Line-4 | 0.10 | 0.16 | 3.53 | 4.73 | 4.23 | 8.67 | 18.03 | 30.03 | 31.52 | 58.02 | 1.57 |
| Line-5 | 0.08 | 0.16 | 3.20 | 4.60 | 4.30 | 9.77 | 19.33 | 30.83 | 29.61 | 52.22 | 2.10 |
| Line-6 | 0.09 | 0.16 | 3.13 | 4.70 | 4.57 | 9.23 | 19.20 | 29.87 | 26.82 | 35.10 | 1.81 |
| Line-7 | 0.13 | 0.26 | 3.13 | 4.97 | 4.63 | 10.27 | 21.87 | 30.87 | 28.48 | 84.57 | 2.06 |
| Line-8 | 0.09 | 0.20 | 3.30 | 4.87 | 4.67 | 10.10 | 22.13 | 32.40 | 28.21 | 63.73 | 2.10 |
| Line-9 | 0.09 | 0.13 | 3.07 | 4.67 | 3.97 | 7.93 | 18.20 | 29.37 | 30.48 | 47.03 | 1.50 |
| Line-10 | 0.09 | 0.18 | 3.07 | 4.57 | 4.10 | 8.23 | 21.00 | 30.70 | 27.63 | 60.00 | 2.00 |

Table 23:
Provided are the values of each of the parameters (as described above) measured in Sorghum accessions (Seed ID) under low nitrogen conditions. Growth conditions are specified in the experimental procedure section.

TABLE 24

Additional calculated parameters in sorghum accessions, measured parameters under low nitrogen growth conditions

| Line | Corr. ID | | | | | | | | |
|---|---|---|---|---|---|---|---|---|---|
| | 23 | 24 | 25 | 26 | 27 | 28 | 49 | 57 | 61 |
| Line-1 | 9.65 | 17.88 | 84.53 | 81.57 | 82.58 | 6.89 | 0.00 | 0.00 | 0.00 |
| Line-2 | 23.54 | 40.59 | 80.95 | 79.16 | 79.81 | 6.57 | 0.00 | 0.01 | 0.01 |
| Line-3 | 43.88 | 71.35 | 117.00 | 104.75 | 109.10 | 6.31 | 0.01 | 0.01 | 0.02 |
| Line-4 | 22.58 | 35.44 | 100.52 | 103.50 | 102.32 | 7.45 | 0.00 | 0.01 | 0.01 |
| Line-5 | 16.89 | 35.33 | 72.54 | 83.71 | 79.74 | 6.89 | 0.00 | 0.01 | 0.01 |
| Line-6 | 12.44 | 22.66 | 71.78 | 83.22 | 78.77 | 5.87 | 0.00 | 0.01 | 0.01 |
| Line-7 | 28.19 | 56.38 | 93.47 | 107.69 | 102.49 | 6.15 | 0.00 | 0.01 | 0.01 |
| Line-8 | 20.53 | 43.20 | 76.05 | 81.39 | 79.59 | 6.05 | 0.00 | 0.01 | 0.01 |
| Line-9 | 18.76 | 28.27 | 86.82 | 70.30 | 76.07 | 7.68 | 0.00 | 0.00 | 0.01 |
| Line-10 | 20.09 | 39.91 | 80.51 | 75.86 | 77.36 | 6.74 | 0.00 | 0.01 | 0.01 |

Table 24:
Provided are the values of each of the parameters (as described above) measured in Sorghum accessions (Seed ID) under low nitrogen conditions. Growth conditions are specified in the experimental procedure section.

TABLE 25

*Sorghum* accessions, measured parameters under salinity growth conditions

| Line | \multicolumn{10}{c}{Corr. ID} |
|---|---|---|---|---|---|---|---|---|---|---|

| Line | 1 | 6 | 9 | 13 | 17 | 36 | 43 | 44 | 54 | 29 |
|---|---|---|---|---|---|---|---|---|---|---|
| Line-1 | 0.05 | 0.09 | 3.00 | 4.00 | 4.00 | 7.90 | 14.20 | 21.80 | 32.73 | 8.18 |
| Line-2 | 0.10 | 0.19 | 3.13 | 4.37 | 4.13 | 9.50 | 16.27 | 23.17 | 35.14 | 8.50 |
| Line-3 | 0.12 | 0.20 | 3.40 | 4.87 | 4.57 | 10.93 | 20.37 | 30.37 | 27.97 | 6.12 |
| Line-4 | 0.07 | 0.14 | 3.07 | 4.60 | 4.43 | 7.93 | 13.33 | 22.83 | 30.93 | 6.98 |
| Line-5 | 0.08 | 0.13 | 3.33 | 4.50 | 4.07 | 9.70 | 15.90 | 23.70 | 34.53 | 8.49 |
| Line-6 | 0.08 | 0.13 | 3.07 | 4.53 | 4.33 | 8.53 | 16.53 | 23.30 | 29.99 | 6.92 |
| Line-7 | 0.14 | 0.15 | 3.07 | 4.50 | 4.13 | 8.90 | 15.47 | 22.47 | 32.09 | 7.76 |
| Line-8 | 0.10 | 0.19 | 3.27 | 4.77 | 4.50 | 10.37 | 18.93 | 26.83 | 31.86 | 7.08 |
| Line-9 | 0.16 | 0.10 | 3.00 | 4.32 | 3.78 | 7.00 | 13.68 | 20.28 | 32.51 | 8.60 |
| Line-10 | 0.14 | 0.12 | 3.07 | 4.20 | 4.20 | 7.83 | 15.77 | 23.57 | 34.32 | 8.17 |

Table 25:
Provided are the values of each of the parameters (as described above) measured in *Sorghum* accessions (Seed ID) under 100 mM NaCl growth conditions. Growth conditions are specified in the experimental procedure section.

TABLE 26

Additional calculated parameters in *sorghum* accessions, measured parameters under salinity growth conditions

| Line | \multicolumn{3}{c}{Correlation ID} |
|---|---|---|---|

| Line | 47 | 55 | 59 |
|---|---|---|---|
| Line-1 | 0.002 | 0.003 | 0.004 |
| Line-2 | 0.003 | 0.005 | 0.008 |
| Line-3 | 0.004 | 0.007 | 0.012 |
| Line-4 | 0.002 | 0.004 | 0.007 |
| Line-5 | 0.002 | 0.004 | 0.006 |
| Line-6 | 0.003 | 0.004 | 0.007 |
| Line-7 | 0.004 | 0.005 | 0.009 |
| Line-8 | 0.003 | 0.006 | 0.009 |
| Line-9 | 0.005 | 0.003 | 0.008 |
| Line-10 | 0.004 | 0.004 | 0.008 |

Table 26: Provided are the values of each of the parameters (as described above) measured in Sorghum accessions (Seed ID) under 100 mM NaCl growth conditions. Growth conditions are specified in the experimental procedure section.

TABLE 27

*Sorghum* accessions, measured parameters under cold growth conditions

| Line | \multicolumn{9}{c}{Correlation ID} |
|---|---|---|---|---|---|---|---|---|---|

| Line | 2 | 7 | 10 | 14 | 18 | 37 | 40 | 51 | 30 |
|---|---|---|---|---|---|---|---|---|---|
| Line-1 | 0.07 | 0.08 | 3.00 | 3.90 | 4.73 | 6.50 | 11.17 | 28.62 | 6.05 |
| Line-2 | 0.11 | 0.15 | 3.00 | 4.13 | 5.33 | 8.77 | 15.87 | 30.31 | 5.68 |
| Line-3 | 0.16 | 0.19 | 3.50 | 4.63 | 5.43 | 10.40 | 18.43 | 27.04 | 4.98 |
| Line-4 | 0.09 | 0.11 | 3.17 | 4.17 | 5.50 | 6.80 | 12.20 | 32.28 | 5.87 |
| Line-5 | 0.08 | 0.13 | 3.40 | 4.27 | 5.33 | 9.03 | 16.03 | 28.28 | 5.30 |
| Line-6 | 0.11 | 0.16 | 3.20 | 4.23 | 5.07 | 9.00 | 14.63 | 29.89 | 5.90 |
| Line-7 | 0.14 | 0.15 | 3.13 | 4.20 | 4.50 | 7.97 | 14.60 | 32.47 | 7.21 |

TABLE 27-continued

*Sorghum* accessions, measured parameters under cold growth conditions

| Line | \multicolumn{9}{c}{Correlation ID} |
|---|---|---|---|---|---|---|---|---|---|

| Line | 2 | 7 | 10 | 14 | 18 | 37 | 40 | 51 | 30 |
|---|---|---|---|---|---|---|---|---|---|
| Line-8 | 0.13 | 0.15 | 3.07 | 4.30 | 5.40 | 9.17 | 17.27 | 28.63 | 5.30 |
| Line-9 | 0.11 | 0.11 | 3.07 | 4.17 | 5.37 | 6.50 | 13.43 | 31.71 | 5.91 |
| Line-10 | 0.14 | 0.14 | 3.00 | 4.00 | 5.18 | 7.23 | 13.91 | 29.56 | 5.70 |

Table 27:
Provided are the values of each of the parameters (as described above) measured in *Sorghum* accessions (Seed ID) under cold growth conditions. Growth conditions are specified in the experimental procedure section.

TABLE 28

Additional calculated parameters in *sorghum* accessions, measured parameters under cold growth conditions

| Line | \multicolumn{3}{c}{Correlation ID} |
|---|---|---|---|

| Line | 48 | 56 | 60 |
|---|---|---|---|
| Line-1 | 0.002 | 0.003 | 0.005 |
| Line-2 | 0.004 | 0.005 | 0.009 |
| Line-3 | 0.006 | 0.007 | 0.013 |
| Line-4 | 0.003 | 0.003 | 0.006 |
| Line-5 | 0.003 | 0.005 | 0.008 |
| Line-6 | 0.004 | 0.006 | 0.009 |
| Line-7 | 0.004 | 0.005 | 0.009 |
| Line-8 | 0.004 | 0.005 | 0.010 |
| Line-9 | 0.003 | 0.004 | 0.007 |
| Line-10 | 0.005 | 0.005 | 0.009 |

Table 28: Provided are the values of each of the parameters (as described above) measured in *Sorghum* accessions (Seed ID) under cold growth conditions. Growth conditions are specified in the experimental procedure section.

TABLE 29

*Sorghum* accessions, measured parameters under regular growth conditions

| Line | \multicolumn{11}{c}{Corr. ID} |
|---|---|---|---|---|---|---|---|---|---|---|---|

| Line | 4 | 8 | 12 | 16 | 20 | 39 | 42 | 46 | 53 | 31 | 32 |
|---|---|---|---|---|---|---|---|---|---|---|---|
| Line-1 | 0.05 | 0.10 | 3.00 | 4.17 | 5.33 | 7.47 | 14.97 | 0.16 | 26.70 | 5.01 | 1.98 |
| Line-2 | 0.13 | 0.24 | 3.07 | 4.50 | 5.87 | 9.30 | 18.23 | 0.19 | 29.33 | 5.00 | 1.94 |
| Line-3 | 0.17 | 0.31 | 3.80 | 4.80 | 6.20 | 12.87 | 22.10 | 0.16 | 29.86 | 4.82 | 1.90 |
| Line-4 | 0.10 | 0.16 | 3.20 | 4.60 | 5.80 | 8.57 | 17.60 | 0.17 | 29.09 | 5.02 | 1.59 |

TABLE 29-continued

Sorghum accessions, measured parameters under regular growth conditions

| Line | Corr. ID | | | | | | | | | | |
|---|---|---|---|---|---|---|---|---|---|---|---|
| | 4 | 8 | 12 | 16 | 20 | 39 | 42 | 46 | 53 | 31 | 32 |
| Line-5 | 0.11 | 0.19 | 3.23 | 4.53 | 5.80 | 8.93 | 18.07 | 0.17 | 24.98 | 4.31 | 1.81 |
| Line-6 | 0.12 | 0.19 | 3.23 | 4.97 | 5.73 | 8.53 | 18.53 | 0.17 | 24.62 | 4.29 | 1.58 |
| Line-7 | 0.14 | 0.24 | 3.13 | 4.60 | 5.73 | 10.67 | 22.83 | 0.17 | 30.79 | 5.37 | 1.76 |
| Line-8 | 0.12 | 0.24 | 3.43 | 4.93 | 6.00 | 10.27 | 22.03 | 0.17 | 25.50 | 4.25 | 1.99 |
| Line-9 | 0.10 | 0.19 | 3.00 | 4.50 | 5.60 | 7.87 | 20.03 | 0.17 | 32.89 | 5.87 | 1.89 |
| Line-10 | 0.11 | 0.24 | 3.00 | 4.57 | 6.07 | 8.77 | 21.80 | 0.20 | 33.54 | 5.53 | 2.20 |

Table 29:
Provided are the values of each of the parameters (as described above) measured in Sorghum accessions (Seed ID) under regular growth conditions. Growth conditions are specified in the experimental procedure section.

TABLE 30

Additional measured parameters under regular growth conditions

| Line | Corr. ID | | | | | |
|---|---|---|---|---|---|---|
| | 33 | 34 | 35 | 50 | 58 | 62 |
| Line-1 | 0.86 | 1.65 | 2.51 | 0.002 | 0.004 | 0.006 |
| Line-2 | 2.19 | 3.87 | 6.06 | 0.005 | 0.008 | 0.013 |
| Line-3 | 2.83 | 5.14 | 7.96 | 0.006 | 0.010 | 0.016 |
| Line-4 | 1.69 | 2.58 | 4.28 | 0.004 | 0.005 | 0.009 |
| Line-5 | 1.76 | 3.18 | 4.94 | 0.004 | 0.008 | 0.012 |
| Line-6 | 1.96 | 3.08 | 5.04 | 0.005 | 0.008 | 0.012 |
| Line-7 | 2.27 | 3.95 | 6.22 | 0.005 | 0.008 | 0.012 |
| Line-8 | 2.04 | 4.00 | 6.04 | 0.005 | 0.010 | 0.014 |
| Line-9 | 1.09 | 2.02 | 3.11 | 0.003 | 0.006 | 0.009 |
| Line-10 | 1.88 | 3.97 | 5.85 | 0.003 | 0.007 | 0.011 |

Table 30:
Provided are the values of each of the parameters (as described above) measured in Sorghum accessions (Seed ID) under regular growth conditions. Growth conditions are specified in the experimental procedure section.

TABLE 31

Correlation between the expression level of selected LAB genes of some embodiments of the invention in various tissues and the phenotypic performance under low nitrogen, normal, cold or salinity stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LAB741 | 0.94 | 1.64E−03 | 3 | 22 | LAB744 | 0.80 | 3.18E−02 | 3 | 15 |
| LAB744 | 0.81 | 2.73E−02 | 3 | 45 | LAB744 | 0.77 | 4.22E−02 | 3 | 23 |
| LAB744 | 0.79 | 3.41E−02 | 3 | 52 | LAB744 | 0.71 | 7.25E−02 | 3 | 28 |
| LAB744 | 0.74 | 5.84E−02 | 3 | 24 | LAB744 | 0.77 | 4.36E−02 | 3 | 21 |
| LAB744 | 0.77 | 1.50E−02 | 7 | 1 | LAB744 | 0.74 | 2.24E−02 | 8 | 32 |
| LAB746 | 0.80 | 3.09E−02 | 3 | 22 | LAB746 | 0.80 | 1.02E−02 | 6 | 22 |
| LAB746 | 0.76 | 1.69E−02 | 2 | 42 | LAB748 | 0.76 | 4.61E−02 | 3 | 28 |
| LAB748 | 0.80 | 1.03E−02 | 6 | 27 | LAB748 | 0.90 | 9.97E−04 | 6 | 25 |
| LAB748 | 0.72 | 2.72E−02 | 7 | 59 | LAB748 | 0.75 | 2.09E−02 | 5 | 56 |
| LAB748 | 0.74 | 2.31E−02 | 5 | 60 | LAB749 | 0.71 | 3.09E−02 | 6 | 49 |
| LAB749 | 0.71 | 3.09E−02 | 6 | 3 | LAB749 | 0.71 | 3.09E−02 | 6 | 23 |
| LAB749 | 0.80 | 9.00E−03 | 5 | 7 | LAB749 | 0.80 | 1.01E−02 | 5 | 48 |
| LAB749 | 0.87 | 2.31E−03 | 5 | 56 | LAB749 | 0.86 | 2.99E−03 | 5 | 60 |
| LAB749 | 0.78 | 1.26E−02 | 5 | 37 | LAB749 | 0.80 | 8.93E−03 | 5 | 40 |
| LAB749 | 0.80 | 9.46E−03 | 5 | 14 | LAB750 | 0.76 | 4.71E−02 | 3 | 25 |
| LAB751 | 0.71 | 3.14E−02 | 6 | 41 | LAB751 | 0.77 | 1.58E−02 | 8 | 39 |
| LAB751 | 0.72 | 2.89E−02 | 8 | 4 | LAB752 | 0.77 | 4.19E−02 | 3 | 28 |
| LAB753 | 0.76 | 1.65E−02 | 6 | 22 | LAB753 | 0.72 | 2.86E−02 | 2 | 35 |
| LAB753 | 0.73 | 2.47E−02 | 2 | 34 | LAB753 | 0.73 | 2.55E−02 | 2 | 8 |
| LAB753 | 0.94 | 1.96E−04 | 2 | 20 | LAB753 | 0.81 | 8.14E−03 | 2 | 16 |
| LAB753 | 0.71 | 3.06E−02 | 2 | 42 | LAB753 | 0.76 | 1.72E−02 | 2 | 58 |
| LAB753 | 0.72 | 2.81E−02 | 2 | 62 | LAB754 | 0.71 | 7.23E−02 | 3 | 3 |
| LAB754 | 0.86 | 1.38E−02 | 3 | 15 | LAB754 | 0.74 | 5.90E−02 | 3 | 5 |
| LAB754 | 0.82 | 2.28E−02 | 3 | 45 | LAB754 | 0.72 | 7.02E−02 | 3 | 41 |
| LAB754 | 0.84 | 4.40E−03 | 7 | 54 | LAB754 | 0.72 | 3.00E−02 | 2 | 4 |
| LAB755 | 0.78 | 1.35E−02 | 5 | 30 | LAB757 | 0.71 | 7.59E−02 | 3 | 19 |
| LAB757 | 0.81 | 7.93E−03 | 6 | 11 | LAB757 | 0.71 | 3.11E−02 | 6 | 19 |
| LAB757 | 0.74 | 2.17E−02 | 7 | 17 | LAB757 | 0.78 | 1.28E−02 | 7 | 13 |
| LAB757 | 0.74 | 2.36E−02 | 7 | 47 | LAB757 | 0.75 | 1.91E−02 | 2 | 12 |
| LAB757 | 0.76 | 1.86E−02 | 2 | 39 | LAB757 | 0.71 | 3.35E−02 | 8 | 12 |
| LAB757 | 0.71 | 3.22E−02 | 8 | 16 | LAB758 | 0.87 | 2.41E−03 | 5 | 7 |
| LAB758 | 0.82 | 6.21E−03 | 5 | 56 | LAB758 | 0.79 | 1.21E−02 | 5 | 60 |
| LAB758 | 0.80 | 9.37E−03 | 5 | 37 | LAB758 | 0.85 | 3.33E−03 | 5 | 40 |
| LAB758 | 0.79 | 1.13E−02 | 5 | 14 | LAB759 | 0.70 | 3.53E−02 | 5 | 10 |
| LAB762 | 0.75 | 2.01E−02 | 6 | 22 | LAB762 | 0.72 | 2.89E−02 | 5 | 30 |

TABLE 31-continued

Correlation between the expression level of selected LAB genes of some embodiments of the invention in various tissues and the phenotypic performance under low nitrogen, normal, cold or salinity stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LAB763 | 0.75 | 5.26E−02 | 3 | 49 | LAB763 | 0.78 | 3.92E−02 | 3 | 5 |
| LAB763 | 0.84 | 1.71E−02 | 3 | 61 | LAB763 | 0.84 | 1.70E−02 | 3 | 38 |
| LAB763 | 0.79 | 3.63E−02 | 3 | 19 | LAB763 | 0.86 | 1.33E−02 | 3 | 57 |
| LAB763 | 0.73 | 6.31E−02 | 3 | 41 | LAB763 | 0.82 | 6.95E−03 | 6 | 49 |
| LAB763 | 0.79 | 1.14E−02 | 6 | 3 | LAB763 | 0.79 | 1.21E−02 | 6 | 5 |
| LAB763 | 0.79 | 1.14E−02 | 6 | 23 | LAB763 | 0.81 | 7.54E−03 | 6 | 61 |
| LAB763 | 0.79 | 1.21E−02 | 6 | 24 | LAB763 | 0.80 | 1.02E−02 | 6 | 21 |
| LAB763 | 0.70 | 3.42E−02 | 6 | 38 | LAB763 | 0.80 | 1.03E−02 | 6 | 57 |
| LAB763 | 0.71 | 3.15E−02 | 6 | 41 | LAB763 | 0.73 | 2.45E−02 | 5 | 7 |
| LAB763 | 0.81 | 8.02E−03 | 5 | 56 | LAB763 | 0.77 | 1.55E−02 | 5 | 60 |
| LAB763 | 0.77 | 1.55E−02 | 5 | 37 | LAB763 | 0.72 | 2.84E−02 | 5 | 18 |
| LAB763 | 0.81 | 8.44E−03 | 5 | 40 | LAB763 | 0.83 | 5.82E−03 | 5 | 14 |
| LAB764 | 0.76 | 1.64E−02 | 7 | 54 | LAB769 | 0.71 | 3.15E−02 | 8 | 42 |
| LAB769 | 0.73 | 2.59E−02 | 8 | 58 | LAB769 | 0.72 | 3.04E−02 | 6 | 49 |
| LAB771 | 0.76 | 1.77E−02 | 6 | 27 | LAB771 | 0.72 | 2.78E−02 | 6 | 3 |
| LAB771 | 0.75 | 1.93E−02 | 6 | 5 | LAB771 | 0.72 | 2.78E−02 | 6 | 23 |
| LAB771 | 0.73 | 2.50E−02 | 6 | 61 | LAB771 | 0.75 | 1.93E−02 | 6 | 24 |
| LAB771 | 0.73 | 2.63E−02 | 6 | 26 | LAB771 | 0.75 | 1.99E−02 | 6 | 21 |
| LAB771 | 0.73 | 2.63E−02 | 6 | 57 | LAB771 | 0.84 | 4.94E−03 | 7 | 1 |
| LAB771 | 0.82 | 7.20E−03 | 7 | 47 | LAB772 | 0.86 | 1.38E−02 | 3 | 27 |
| LAB772 | 0.85 | 1.66E−02 | 3 | 11 | LAB772 | 0.85 | 1.51E−02 | 3 | 26 |
| LAB772 | 0.78 | 1.23E−02 | 6 | 27 | LAB772 | 0.70 | 3.47E−02 | 6 | 25 |
| LAB772 | 0.78 | 1.32E−02 | 6 | 26 | LAB772 | 0.79 | 1.04E−02 | 5 | 56 |
| LAB772 | 0.75 | 1.94E−02 | 5 | 60 | LAB772 | 0.84 | 4.21E−03 | 5 | 37 |
| LAB772 | 0.83 | 5.77E−03 | 5 | 40 | LAB772 | 0.81 | 7.76E−03 | 5 | 14 |
| LAB773 | 0.82 | 6.66E−03 | 5 | 7 | LAB773 | 0.77 | 1.42E−02 | 5 | 56 |
| LAB773 | 0.74 | 2.16E−02 | 5 | 60 | LAB773 | 0.78 | 1.34E−02 | 5 | 37 |
| LAB773 | 0.83 | 5.74E−03 | 5 | 40 | LAB773 | 0.82 | 6.76E−03 | 5 | 14 |
| LAB774 | 0.77 | 4.09E−02 | 3 | 49 | LAB774 | 0.73 | 2.48E−02 | 2 | 50 |
| LAB774 | 0.88 | 1.76E−03 | 2 | 12 | LAB774 | 0.79 | 1.15E−02 | 2 | 16 |
| LAB774 | 0.70 | 3.41E−02 | 2 | 62 | LAB776 | 0.74 | 2.14E−02 | 6 | 28 |
| LAB777 | 0.80 | 3.24E−02 | 3 | 52 | LAB777 | 0.81 | 2.72E−02 | 3 | 28 |
| LAB777 | 0.86 | 2.83E−03 | 6 | 52 | LAB777 | 0.84 | 4.33E−03 | 5 | 30 |
| LAB777 | 0.74 | 2.31E−02 | 5 | 18 | LAB778 | 0.83 | 2.21E−02 | 3 | 22 |
| LAB778 | 0.86 | 2.89E−03 | 2 | 46 | LAB780 | 0.85 | 1.46E−02 | 3 | 49 |
| LAB780 | 0.91 | 4.53E−03 | 3 | 3 | LAB780 | 0.78 | 4.02E−02 | 3 | 15 |
| LAB780 | 0.72 | 7.08E−02 | 3 | 5 | LAB780 | 0.78 | 3.81E−02 | 3 | 45 |
| LAB780 | 0.88 | 8.97E−03 | 3 | 23 | LAB780 | 0.72 | 6.92E−02 | 3 | 61 |
| LAB780 | 0.72 | 7.04E−02 | 3 | 24 | LAB780 | 0.80 | 3.25E−02 | 3 | 21 |
| LAB780 | 0.75 | 5.30E−02 | 3 | 41 | LAB780 | 0.83 | 5.15E−03 | 6 | 49 |
| LAB780 | 0.81 | 8.57E−03 | 6 | 3 | LAB780 | 0.79 | 1.13E−02 | 6 | 5 |
| LAB780 | 0.82 | 6.69E−03 | 6 | 45 | LAB780 | 0.81 | 8.57E−03 | 6 | 23 |
| LAB780 | 0.82 | 6.70E−03 | 6 | 61 | LAB780 | 0.79 | 1.13E−02 | 6 | 24 |
| LAB780 | 0.81 | 8.70E−03 | 6 | 21 | LAB780 | 0.78 | 1.27E−02 | 6 | 38 |
| LAB780 | 0.80 | 1.02E−02 | 6 | 57 | LAB780 | 0.82 | 6.37E−03 | 6 | 41 |
| LAB780 | 0.76 | 1.75E−02 | 5 | 7 | LAB780 | 0.83 | 5.74E−03 | 5 | 56 |
| LAB780 | 0.78 | 1.36E−02 | 5 | 60 | LAB780 | 0.87 | 2.49E−03 | 5 | 37 |
| LAB780 | 0.87 | 2.31E−03 | 5 | 40 | LAB780 | 0.82 | 7.01E−03 | 5 | 14 |
| LAB781 | 0.72 | 6.80E−02 | 3 | 61 | LAB781 | 0.81 | 2.72E−02 | 3 | 19 |
| LAB781 | 0.75 | 5.41E−02 | 3 | 57 | LAB783 | 0.74 | 2.38E−02 | 2 | 50 |
| LAB783 | 0.73 | 2.48E−02 | 2 | 20 | LAB783 | 0.74 | 2.25E−02 | 2 | 58 |
| LAB783 | 0.75 | 2.01E−02 | 2 | 62 | LAB783 | 0.84 | 4.77E−03 | 5 | 10 |
| LAB783 | 0.75 | 2.02E−02 | 5 | 37 | LAB783 | 0.75 | 1.22E−02 | 1 | 30 |
| LAB785 | 0.73 | 2.42E−02 | 6 | 5 | LAB785 | 0.73 | 2.44E−02 | 6 | 61 |
| LAB785 | 0.73 | 2.42E−02 | 6 | 24 | LAB785 | 0.72 | 2.80E−02 | 6 | 21 |
| LAB785 | 0.74 | 2.22E−02 | 6 | 57 | LAB785 | 0.76 | 1.65E−02 | 6 | 41 |
| LAB785 | 0.77 | 1.53E−02 | 8 | 42 | LAB786 | 0.83 | 2.04E−02 | 3 | 27 |
| LAB786 | 0.74 | 5.64E−02 | 3 | 25 | LAB786 | 0.74 | 5.80E−02 | 3 | 26 |
| LAB786 | 0.71 | 3.27E−02 | 6 | 19 | LAB786 | 0.79 | 1.13E−02 | 7 | 13 |
| LAB789 | 0.80 | 1.01E−02 | 5 | 10 | LAB789 | 0.72 | 3.01E−02 | 5 | 56 |
| LAB789 | 0.76 | 1.86E−02 | 5 | 37 | LAB789 | 0.79 | 1.17E−02 | 5 | 40 |
| LAB789 | 0.80 | 9.00E−03 | 5 | 14 | LAB790 | 0.74 | 5.87E−02 | 3 | 22 |
| LAB791 | 0.73 | 2.62E−02 | 5 | 7 | LAB791 | 0.70 | 3.44E−02 | 5 | 14 |
| LAB792 | 0.83 | 5.79E−03 | 2 | 46 | LAB793 | 0.78 | 1.23E−02 | 2 | 50 |
| LAB793 | 0.74 | 2.36E−02 | 2 | 35 | LAB793 | 0.73 | 2.59E−02 | 2 | 34 |
| LAB793 | 0.80 | 1.01E−02 | 2 | 8 | LAB793 | 0.81 | 8.42E−03 | 2 | 4 |
| LAB793 | 0.81 | 8.61E−03 | 2 | 58 | LAB793 | 0.81 | 8.13E−03 | 2 | 62 |
| LAB793 | 0.73 | 2.60E−02 | 2 | 33 | LAB796 | 0.74 | 1.50E−02 | 1 | 30 |
| LAB797 | 0.82 | 2.26E−02 | 3 | 11 | LAB797 | 0.80 | 2.91E−02 | 3 | 52 |
| LAB797 | 0.79 | 1.10E−02 | 7 | 1 | LAB797 | 0.78 | 1.29E−02 | 7 | 47 |
| LAB797 | 0.85 | 3.70E−03 | 5 | 48 | LAB797 | 0.75 | 2.01E−02 | 5 | 2 |
| LAB797 | 0.78 | 1.22E−02 | 5 | 56 | LAB797 | 0.84 | 4.66E−03 | 5 | 60 |
| LAB798 | 0.74 | 5.62E−02 | 3 | 26 | LAB798 | 0.79 | 1.18E−02 | 5 | 7 |

TABLE 31-continued

Correlation between the expression level of selected LAB genes of some embodiments of the invention in various tissues and the phenotypic performance under low nitrogen, normal, cold or salinity stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LAB798 | 0.75 | 1.98E−02 | 5 | 48 | LAB798 | 0.85 | 3.89E−03 | 5 | 56 |
| LAB798 | 0.82 | 6.21E−03 | 5 | 60 | LAB798 | 0.76 | 1.81E−02 | 5 | 37 |
| LAB798 | 0.77 | 1.47E−02 | 5 | 40 | LAB799 | 0.79 | 3.50E−02 | 3 | 49 |
| LAB799 | 0.81 | 2.56E−02 | 3 | 3 | LAB799 | 0.90 | 5.60E−03 | 3 | 15 |
| LAB799 | 0.85 | 1.50E−02 | 3 | 45 | LAB799 | 0.74 | 5.71E−02 | 3 | 11 |
| LAB799 | 0.85 | 1.52E−02 | 3 | 23 | LAB799 | 0.86 | 1.23E−02 | 3 | 52 |
| LAB799 | 0.74 | 5.81E−02 | 3 | 28 | LAB799 | 0.70 | 7.86E−02 | 3 | 24 |
| LAB799 | 0.78 | 4.05E−02 | 3 | 21 | LAB799 | 0.79 | 3.35E−02 | 3 | 41 |
| LAB799 | 0.76 | 1.64E−02 | 5 | 14 | | | | | |

Table 31.
Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 5

Production of *Sorghum* Transcriptom and High Throughput Correlation Analysis Using 60K *Sorghum* Oligonucleotide Micro-Array In order to produce a high throughput correlation analysis between plant phenotype and gene expression level, the present inventors utilized a *Sorghum* oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60,000 *Sorghum* genes and transcripts. In order to define correlations between the levels of RNA expression with vigor related parameters, various plant characteristics of 10 different *Sorghum* hybrids were analyzed. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Correlation of *Sorghum* varieties across ecotypes grown in growth chambers under temperature of 30° C. or 14° C. at low light (100 μE) and high light (250 μE) conditions.

Analyzed *Sorghum* tissues—All 10 selected *Sorghum* hybrids were sampled per each condition. Leaf tissue growing under 30° C. and low light (100 μE m$^{-2}$ sec$^{-1}$), 14° C. and low light (100 μE m$^{-2}$ sec$^{-1}$), 30° C. and high light (250 μE m$^{-2}$ sec$^{-1}$), 14° C. and high light (250 μE m$^{-2}$ sec$^{-1}$) were sampled at vegetative stage of four-five leaves and RNA was extracted as described above. Each micro-array expression information tissue type has received a Set ID as summarized in Table 32 below.

TABLE 32

*Sorghum* transcriptom expression sets in growth chamber experiments

| Expression Set | Set ID |
|---|---|
| *Sorghum*/leaf: 14 Celsius degree: high light: light on | 1 |
| *Sorghum*/leaf: 14 Celsius degree: low light: light on | 2 |
| *Sorghum*/leaf: 30 Celsius degree: high light: light on | 3 |
| *Sorghum*/leaf: 30 Celsius degree: low light: light on | 4 |

Table 32: Provided are the *sorghum* transcriptom expression sets.

The following parameters (Table 33) were collected by sampling 8-10 plants per plot or by measuring the parameter across all the plants within the plot.

Relative Growth Rate (RGR) was calculated as regression coefficient of vegetative dry weight along time course.

Leaves number [num]—Plants were characterized for leaf number during growing period. In each measure, plants were measured for their leaf number by counting all the leaves of selected plants per plot.

Shoot fresh weight (FW) [gr.]—shoot fresh weight per plant, measurement of all vegetative tissue above ground.

Shoot dry weight (DW) [gr.]—shoot dry weight per plant, measurement of all vegetative tissue above ground after drying at 70° C. in oven for 48 hours.

Leaves temperature [° C.]—leaf temperature was measured using Fluke IR thermometer 568 device. Measurements were done on opened leaves.

Data parameters collected are summarized in Table 33, herein below.

TABLE 33

*Sorghum* correlated parameters (vectors)

| Correlated parameter with | Correlation ID |
|---|---|
| Leaves number | 1 |
| Leaves temperature | 2 |
| RGR | 3 |
| Shoot DW | 4 |
| Shoot FW | 5 |

Table 33. Provided are the *Sorghum* correlated parameters (vectors).

Experimental Results 10 different *Sorghum* accessions were grown and characterized for different parameters as described above. Table 33 describes the *Sorghum* correlated parameters. The average for each of the measured parameters was calculated using the JMP software and values are summarized in Tables 34-37 below. Subsequent correlation analysis between the various transcriptom sets and the average parameters (Table 38) was conducted. Follow, results were integrated to the database.

TABLE 34

Measured parameters in *Sorghum* accessions under 14° C. and high light (250 µE m$^{-2}$ sec$^{-1}$)

| Line | Correlation ID 3 | 4 | 5 |
|---|---|---|---|
| Line-1 | 0.053 | 0.037 | 0.370 |
| Line-2 | 0.052 | 0.026 | 0.253 |
| Line-3 | 0.034 | 0.021 | 0.224 |
| Line-4 | 0.040 | 0.023 | 0.250 |
| Line-5 | 0.056 | 0.037 | 0.431 |
| Line-6 | 0.061 | 0.036 | 0.370 |
| Line-7 | 0.049 | 0.022 | 0.242 |
| Line-8 | 0.056 | 0.022 | 0.226 |
| Line-9 | 0.068 | 0.023 | 0.241 |
| Line-10 | 0.063 | 0.027 | 0.274 |

Table 34: Provided are the values of each of the parameters (as described above) measured in *Sorghum* accessions (Line) under 14° C. and high light (250 µE m$^{-2}$ sec$^{-1}$). Growth conditions are specified in the experimental procedure section.

TABLE 35

Measured parameters in *Sorghum* accessions under 30° C. and high light (250 µE m$^{-2}$ sec$^{-1}$)

| Line | Correlation ID 1 | 3 | 4 | 5 |
|---|---|---|---|---|
| Line-1 | 4.000 | 0.098 | 0.076 | 0.772 |
| Line-2 | 3.700 | 0.096 | 0.050 | 0.516 |
| Line-3 | 3.500 | 0.087 | 0.047 | 0.487 |
| Line-4 | 3.333 | 0.070 | 0.036 | 0.378 |
| Line-5 | 4.000 | 0.094 | 0.065 | 0.710 |
| Line-6 | 4.000 | 0.118 | 0.085 | 0.855 |
| Line-7 | 3.600 | 0.097 | 0.049 | 0.489 |
| Line-8 | 3.400 | 0.099 | 0.042 | 0.453 |
| Line-9 | 3.300 | 0.106 | 0.042 | 0.444 |
| Line-10 | 3.400 | 0.121 | 0.062 | 0.668 |

Table 35: Provided are the values of each of the parameters (as described above) measured in *Sorghum* accessions (Line) under 30° C. and high light (250 µE m$^{-2}$ sec$^{-1}$). Growth conditions are specified in the experimental procedure section.

TABLE 36

Measured parameters in *Sorghum* accessions under 14° C. and low light (100 µE m$^{-2}$ sec$^{-1}$)

| Line | Correlation ID 1 | 3 | 4 | 5 |
|---|---|---|---|---|
| Line-1 | 3 | 0.032 | 0.041 | 0.550 |
| Line-2 | 3 | −0.014 | 0.013 | 0.296 |
| Line-3 | 2.75 | −0.022 | 0.013 | 0.334 |
| Line-4 | 2.75 | 0.024 | 0.009 | 0.284 |
| Line-5 | 2.625 | −0.037 | 0.011 | 0.364 |
| Line-6 | 3 | −0.045 | 0.011 | 0.364 |
| Line-7 | 3.5 | 0.083 | 0.031 | 0.579 |
| Line-8 | 2.75 | NA | 0.009 | 0.216 |
| Line-9 | 2.429 | −0.050 | 0.009 | 0.184 |
| Line-10 | 2 | −0.073 | 0.009 | 0.300 |

Table 36: Provided are the values of each of the parameters (as described above) measured in *Sorghum* accessions (Line) under 14° C. and low light (100 µE m$^{-2}$ sec$^{-1}$). Growth conditions are specified in the experimental procedure section.

TABLE 37

Measured parameters in *Sorghum* accessions under 30° C. and low light (100 µE m$^{-2}$ sec$^{-1}$)

| Line | Correlation ID 1 | 2 | 3 | 4 | 5 |
|---|---|---|---|---|---|
| Line-1 | 5.273 | 28.140 | 0.099 | 0.114 | 1.350 |
| Line-2 | 5.000 | 29.813 | 0.098 | 0.079 | 1.050 |
| Line-3 | 4.750 | 24.213 | 0.090 | 0.071 | 0.884 |
| Line-4 | 4.000 | 23.138 | 0.122 | 0.056 | 0.948 |
| Line-5 | 4.000 | 19.900 | 0.108 | 0.093 | 1.285 |
| Line-6 | 4.000 | 21.350 | 0.084 | 0.077 | 1.126 |
| Line-7 | 5.250 | 23.360 | 0.113 | 0.040 | 0.710 |
| Line-8 | 4.500 | 29.922 | 0.121 | 0.055 | 0.789 |
| Line-9 | 3.750 | 21.525 | 0.042 | 0.036 | 0.665 |
| Line-10 | 4.000 | 24.440 | 0.039 | 0.050 | 0.824 |

Table 37: Provided are the values of each of the parameters (as described above) measured in *Sorghum* accessions (Line) under 30° C. and low light (100 µE m$^{-2}$ sec$^{-1}$). Growth conditions are specified in the experimental procedure section.

TABLE 38

Correlation between the expression level of selected genes of some embodiments of the invention in various tissues and the phenotypic performance under combinations of temperature and light conditions treatments (14° C. or 30° C.; high light (250 µE m$^{-2}$ sec$^{-1}$) or low light (100 µE m$^{-2}$ sec$^{-1}$) across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LAB742 | 0.80 | 5.49E−03 | 1 | 4 | LAB749 | 0.71 | 2.14E−02 | 2 | 5 |
| LAB750 | 0.72 | 1.04E−01 | 3 | 4 | LAB755 | 0.75 | 1.19E−02 | 2 | 5 |
| LAB755 | 0.72 | 1.07E−01 | 3 | 4 | LAB756 | 0.80 | 5.07E−03 | 4 | 4 |
| LAB760 | 0.86 | 2.64E−02 | 3 | 5 | LAB760 | 0.91 | 1.15E−02 | 3 | 4 |
| LAB760 | 0.79 | 6.13E−02 | 3 | 1 | LAB761 | 0.75 | 8.76E−02 | 3 | 5 |
| LAB761 | 0.80 | 5.80E−02 | 3 | 4 | LAB765 | 0.74 | 1.43E−02 | 1 | 4 |
| LAB765 | 0.83 | 5.24E−03 | 2 | 3 | LAB765 | 0.76 | 8.25E−02 | 3 | 5 |
| LAB765 | 0.81 | 4.96E−02 | 3 | 4 | LAB767 | 0.72 | 1.94E−02 | 4 | 2 |
| LAB768 | 0.75 | 1.26E−02 | 2 | 4 | LAB770 | 0.78 | 8.24E−03 | 1 | 5 |
| LAB770 | 0.79 | 6.75E−03 | 1 | 4 | LAB770 | 0.70 | 2.37E−02 | 4 | 5 |
| LAB770 | 0.77 | 9.70E−03 | 4 | 4 | LAB770 | 0.73 | 9.99E−02 | 3 | 5 |
| LAB770 | 0.78 | 6.47E−02 | 3 | 4 | LAB774 | 0.73 | 9.84E−02 | 3 | 5 |
| LAB774 | 0.79 | 6.22E−02 | 3 | 4 | LAB777 | 0.72 | 1.07E−01 | 3 | 5 |
| LAB777 | 0.76 | 7.82E−02 | 3 | 4 | LAB780 | 0.74 | 1.46E−02 | 1 | 5 |
| LAB780 | 0.76 | 1.11E−02 | 1 | 4 | LAB780 | 0.78 | 7.98E−03 | 4 | 3 |
| LAB780 | 0.86 | 1.47E−03 | 2 | 5 | LAB780 | 0.88 | 1.93E−03 | 2 | 3 |
| LAB780 | 0.85 | 2.05E−03 | 2 | 4 | LAB780 | 0.74 | 1.45E−02 | 2 | 1 |
| LAB783 | 0.77 | 9.40E−03 | 2 | 5 | LAB783 | 0.93 | 2.18E−04 | 2 | 3 |
| LAB783 | 0.73 | 1.62E−02 | 2 | 4 | LAB784 | 0.81 | 8.69E−03 | 2 | 3 |
| LAB784 | 0.92 | 1.03E−02 | 3 | 5 | LAB784 | 0.88 | 2.13E−02 | 3 | 4 |
| LAB784 | 0.89 | 1.76E−02 | 3 | 1 | LAB787 | 0.81 | 7.89E−03 | 2 | 3 |
| LAB787 | 0.71 | 2.06E−02 | 2 | 4 | LAB788 | 0.81 | 7.45E−03 | 2 | 3 |

TABLE 38-continued

Correlation between the expression level of selected genes of some embodiments of the invention in various tissues and the phenotypic performance under combinations of temperature and light conditions treatments (14° C. or 30° C.; high light (250 µE m$^{-2}$ sec$^{-1}$) or low light (100 µE m$^{-2}$ sec$^{-1}$) across Sorghum accessions

| Gene Name | R | P value | Exp. set | Corr. Set ID | Gene Name | R | P value | Exp. set | Corr. Set ID |
|---|---|---|---|---|---|---|---|---|---|
| LAB789 | 0.77 | 1.52E−02 | 2 | 3 | LAB791 | 0.79 | 6.27E−02 | 3 | 5 |
| LAB791 | 0.84 | 3.63E−02 | 3 | 4 | LAB792 | 0.78 | 6.83E−02 | 3 | 3 |
| LAB793 | 0.77 | 7.21E−02 | 3 | 5 | LAB793 | 0.81 | 5.14E−02 | 3 | 4 |
| LAB794 | 0.71 | 1.16E−01 | 3 | 5 | LAB794 | 0.76 | 8.17E−02 | 3 | 4 |
| LAB796 | 0.75 | 8.37E−02 | 3 | 4 | | | | | |

Table 38. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 6

Production of Maize Transcriptom and High Throughput Correlation Analysis with Yield and NUE Related Parameters Using 60K Maize Oligonucleotide Micro-Arrays In order to produce a high throughput correlation analysis between plant phenotype and gene expression level, the present inventors utilized a maize oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60,000 maize genes and transcripts.

Correlation of Maize Hybrids Across Ecotypes Grown Under Low Nitrogen Conditions Experimental Procedures Twelve Maize hybrids were grown in 3 repetitive plots, in field. Maize seeds were planted and plants were grown in the field using commercial fertilization and irrigation protocols, which included 485 m$^3$ water per dunam (1000 square meters) per entire growth period and fertilization of 30 units of URAN® 21% fertilization per dunam per entire growth period (normal conditions). In order to define correlations between the levels of RNA expression with NUE and yield components or vigor related parameters, the 12 different maize hybrids were analyzed. Among them, 11 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize tissues—All 11 selected maize hybrids were sampled per each treatment (low N and normal conditions), in three time points: TP2=V6-V8 (six to eight collar leaves are visible, rapid growth phase and kernel row determination begins; TP5=R1-R2 (silking-blister); and TP6=R3-R4 (milk-dough). Four types of plant tissues [Ear, flag leaf indicated in Table as leaf, grain distal part, and internode] were sampled and RNA was extracted as described above. Each micro-array expression information tissue type has received a Set ID as summarized in Tables 39-40 below.

TABLE 39

Maize transcriptom expression sets under low nitrogen conditions

| Expression Set | Set ID |
|---|---|
| Maize field Low N/Ear/TP5 | 1 |
| Maize field Low N/Ear/TP6 | 2 |
| Maize field Low N/Internodes/TP2 | 3 |
| Maize field Low N/Internodes/TP5 | 4 |
| Maize field Low N/Internodes/TP6 | 5 |
| Maize field Low N/Leaf/TP2 | 6 |
| Maize field Low N/Leaf/TP5 | 7 |
| Maize field Low N/Leaf/TP6 | 8 |

Table 39: Provided are the maize transcriptom expression sets under low nitrogen conditions
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

TABLE 40

Maize transcriptom expression sets under normal growth conditions

| Expression Set | Set ID |
|---|---|
| Maize field Normal/Ear/R1-R2 | 1 |
| Maize field Normal/Grain Distal/R4-R5 | 2 |
| Maize field Normal/Internode/R3-R4 | 3 |
| Maize field Normal/Leaf/R1-R2 | 4 |
| Maize field Normal/Ear/R3-R4 | 5 |
| Maize field Normal/Internode/R1-R2 | 6 |
| Maize field Normal/Internode/V6-V8 | 7 |
| Maize field Normal/Leaf/V6-V8 | 8 |

Table 40: Provided are the maize transcriptom expression sets under normal growth conditions.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.

The following parameters were collected using digital imaging system:

Grain Area (cm$^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area (cm$^2$)—At the end of the growing period 5 ears were photographed and images were processed using the below described image processing system. The Ear area was measured from those images and was divided by the number of Ears.

Ear Length (cm) and Ear Width (mm)—At the end of the growing period 5 ears were photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (kg)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (kg)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height [cm]—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant [num]—Plants were characterized for leaf number during growing period at 5 time points. In each measure, plants were measured for their leaf number by counting all the leaves of 3 selected plants per plot.

Relative Growth Rate was calculated using Formula II (described above).

SPAD [SPAD unit]—Chlorophyll content was determined using a Minolta SPAD 502 chlorophyll meter and measurement was performed at early stages of grain filling (R1-R2) and late stage of grain filling (R3-R4). SPAD meter readings were done on young fully developed leaf. Three measurements per leaf were taken per plot. Data were taken after 46 and 54 days after sowing (DPS).

Dry weight per plant [kg]—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index per plant was calculated using Formula VIII.

Harvest Index (Maize)=Average grain weight per plant/(Average vegetative dry weight per plant plus Average grain weight per plant)   Formula VIII:

Percent Filled Ear [%]—was calculated as the percentage of the Ear area with grains out of the total ear.

Cob diameter [mm]—The diameter of the cob without grains was measured using a ruler.

Kernel Row Number per Ear [num]—The number of rows in each ear was counted.

Experimental Results

Twelve different maize hybrids were grown and characterized for different parameters. Table 41 describes the Maize correlated parameters. The average for each of the measured parameter was calculated using the JMP software (Tables 42-47) and a subsequent correlation analysis was performed (Table 48-49). Results were then integrated to the database.

TABLE 41

Maize correlated parameters (vectors) under low nitrogen conditions

| Correlated parameter with | Correlation ID |
|---|---|
| Ear Length [cm] Low N | 1 |
| Ear Length of filled area [cm] Low N | 2 |
| Ear width [mm] Low N | 3 |
| Final Leaf Number [number] Low N | 4 |
| Final Main Ear Height [cm] Low N | 5 |
| Final Plant Height [cm] Low N | 6 |
| No of rows per ear [number] Low N | 7 |
| SPAD at R1-R2 [(SPAD unit)] Low N | 8 |
| SPAD at R3-R4 [(SPAD unit)] Low N | 9 |
| Stalk width at TP5 Low N | 10 |
| Ears weight per plot [kg] Low N | 11 |
| Final Plant DW [kg] Low N | 12 |
| Final Leaf Area [number] Low N | 13 |
| NUE yield kg/N applied in soil kg Low N | 14 |
| NUE at early grain filling [R1-R2] yield kg/N in plant per SPAD Low N | 15 |
| NUE at grain filling [R3-R4] yield kg/N in plant per SPAD Low N | 16 |
| NUpE [biomass/N applied] Low N | 17 |
| Seed yield per dunam [kg] Low N | 18 |
| Yield/LAI Low N | 19 |
| Yield/stalk width Low N | 20 |
| seed yield per plant [kg] Low N | 21 |

Table 41.
"cm" = centimeters'
"mm" = millimeters;
"kg" = kilograms;
SPAD at R1-R2 and SPAD R3-R4: Chlorophyll level after early and late stages of grain filling;
"NUE" = nitrogen use efficiency;
"NUpE" = nitrogen uptake efficiency;
"LAI" = leaf area;
"N" = nitrogen;
Low N = under low Nitrogen conditions;
"Normal" = under normal conditions;
"dunam" = 1000 m$^2$.
"Final" - At harvest.

TABLE 42

Maize correlated parameters (vectors) under normal conditions

| Correlated parameter with | Correlation ID |
|---|---|
| Final Plant DW [kg] Normal | 1 |
| Ear Length [cm] Normal | 2 |
| Ear Length of filled area [cm] Normal | 3 |
| Ear width [mm] Normal | 4 |
| Final Leaf Number [number] Normal | 5 |
| Final Main Ear Height [cm] Normal | 6 |
| Final Plant Height [cm] Normal | 7 |
| No of rows per ear [number] Normal | 8 |
| SPAD at R1-R2 [(SPAD unit)] Normal | 9 |
| SPAD at R3-R4 [(SPAD unit)] Normal | 10 |
| Stalk width at TP5 Normal | 11 |
| Ears weight per plot [kg] Normal | 12 |
| Final Leaf Area [number] Normal | 13 |
| NUE yield kg/N applied in soil kg Normal | 14 |
| NUE at early grain filling [R1-R2] yield kg/N in plant per SPAD Normal | 15 |
| NUE at grain filling [R3-R4] yield kg/N in plant per SPAD Normal | 16 |
| NUpE [biomass/N applied] Normal | 17 |
| Seed yield per dunam [kg] Normal | 18 |
| Yield/LAI Normal | 19 |
| Yield/stalk width Normal | 20 |
| seed yield per plant [kg] Normal | 21 |

Table 42.
"cm" = centimeters'
"mm" = millimeters;
"kg" = kilograms;
SPAD at R1-R2 and SPAD R3-R4: Chlorophyll level after early and late stages of grain filling;
"NUE" = nitrogen use efficiency;
"NUpE" = nitrogen uptake efficiency;
"LAI" = leaf area;
"N" = nitrogen;
Low N = under low Nitrogen conditions;
"Normal" = under normal conditions;
"dunam" = 1000 m$^2$.

TABLE 43

Measured parameters in Maize accessions under Low nitrogen conditions

| Line | Corr. ID 1 | 2 | 3 | 4 | 5 | 6 | 7 | 8 | 9 | 10 | 11 |
|---|---|---|---|---|---|---|---|---|---|---|---|
| Line-1 | 20.61 | 18.40 | 46.71 | 15.02 | 158.08 | 305.84 | 14.18 | 60.24 | 59.29 | 2.76 | 6.61 |
| Line-2 | 20.98 | 18.42 | 48.22 | 11.64 | 136.24 | 270.93 | 15.21 | 57.94 | 57.62 | 2.42 | 7.97 |
| Line-3 | 20.22 | 19.78 | 48.32 | 13.50 | 128.39 | 290.61 | 15.00 | 58.76 | 58.40 | 2.65 | 9.63 |
| Line-4 | 20.11 | 18.83 | 49.86 | 11.61 | 133.06 | 252.17 | 15.67 | 59.48 | 59.19 | 2.77 | 9.22 |
| Line-5 | 20.11 | 16.22 | 52.87 | 11.83 | 137.83 | 260.22 | 16.00 | 58.50 | 58.19 | 2.67 | 7.63 |
| Line-6 | 18.50 | 16.00 | 47.44 | 11.89 | 99.56 | 227.22 | 15.94 | 64.04 | 62.67 | 2.59 | 7.21 |
| Line-7 | 19.06 | 15.28 | 49.61 | 12.56 | 130.17 | 271.72 | 15.56 | 56.42 | 61.04 | 2.98 | 7.92 |
| Line-8 | 18.25 | 15.69 | 48.57 | 11.67 | 114.61 | 248.61 | 14.50 | 60.00 | 59.87 | 2.61 | 28.96 |
| Line-9 | 20.10 | 16.77 | 52.41 | 12.44 | 143.86 | 279.33 | 16.41 | 58.32 | 57.47 | 2.65 | 7.80 |
| Line-10 | 17.81 | 14.06 | 42.63 | 9.28 | 61.61 | 171.28 | 14.37 | 53.06 | 49.61 | 2.28 | 2.41 |
| Line-11 | 21.25 | 19.56 | 50.00 | 13.17 | 114.44 | 269.78 | 15.74 | 61.72 | 61.87 | 2.82 | 9.78 |

Table 43. Provided are the values of each of the parameters (as described above) measured in maize accessions (line) under low nitrogen growth conditions. Growth conditions are specified in the experimental procedure section.

TABLE 44

Additional parameters in Maize accessions under Low nitrogen conditions

| Line | Corr. ID 12 | 14 | 15 | 16 | 17 | 18 | 20 | 21 | 13 | 19 |
|---|---|---|---|---|---|---|---|---|---|---|
| Line-1 | 1.59 | 7.22 | 18.02 | 18.35 | 0.01 | 1083.75 | 416.53 | 0.14 | 2.92 | 341.50 |
| Line-2 | 1.43 | 8.41 | 21.79 | 21.92 | 0.01 | 1261.63 | 528.38 | 0.16 | 3.15 | 408.09 |
| Line-3 | 1.53 | 10.33 | 26.33 | 26.48 | 0.01 | 1549.24 | 583.46 | 0.19 | 3.33 | 464.77 |
| Line-4 | 1.95 | 9.99 | 25.14 | 25.33 | 0.01 | 1497.86 | 541.02 | 0.19 | 2.87 | 522.26 |
| Line-5 | 1.48 | 7.63 | 19.55 | 19.69 | 0.01 | 1143.85 | 428.09 | 0.14 | 2.79 | 439.53 |
| Line-6 | 1.60 | 7.73 | 18.05 | 18.54 | 0.01 | 1159.26 | 444.29 | 0.14 | 3.76 | 312.58 |
| Line-7 | 1.58 | 8.05 | 21.39 | 19.78 | 0.01 | 1207.42 | 407.20 | 0.15 | 3.50 | 345.90 |
| Line-8 | 1.28 | 8.33 | 20.79 | 20.92 | 0.01 | 1250.05 | 477.44 | 0.16 | 5.02 | 287.73 |
| Line-9 | 1.51 | 7.64 | 19.68 | 19.94 | 0.01 | 1146.04 | 445.60 | 0.14 | | |
| Line-10 | 0.43 | 2.55 | 7.21 | 7.72 | 0.00 | 383.22 | 167.90 | 0.05 | | |
| Line-11 | 1.52 | 10.60 | 25.70 | 25.90 | 0.01 | 1589.91 | 562.29 | 0.20 | 3.16 | 501.24 |

Table 44. Provided are the values of each of the parameters (as described above) measured in maize accessions (line) under low nitrogen growth conditions. Growth conditions are specified in the experimental procedure section.

TABLE 45

Measured parameters in Maize accessions under normal growth conditions

| Line | Corr. ID | | | | | | | | | | |
|---|---|---|---|---|---|---|---|---|---|---|---|
| | 1 | 2 | 3 | 4 | 5 | 6 | 7 | 8 | 9 | 10 | 11 |
| Line-1 | 1.27 | 19.94 | 16.23 | 51.08 | 11.80 | 130.31 | 273.46 | 16.11 | 56.89 | 59.93 | 2.91 |
| Line-2 | 1.30 | 20.17 | 17.50 | 46.29 | 11.11 | 122.33 | 260.50 | 14.67 | 57.16 | 60.90 | 2.64 |
| Line-3 | 1.33 | 18.11 | 17.72 | 45.92 | 13.28 | 127.67 | 288.00 | 15.44 | 59.27 | 56.89 | 2.71 |
| Line-4 | 1.50 | 19.89 | 18.44 | 47.63 | 11.78 | 113.02 | 238.50 | 15.89 | 61.61 | 58.70 | 2.90 |
| Line-5 | 1.30 | 19.50 | 15.67 | 51.41 | 11.94 | 135.28 | 286.94 | 16.17 | 58.63 | 58.70 | 2.70 |
| Line-6 | 1.58 | 17.72 | 14.67 | 47.42 | 12.33 | 94.28 | 224.83 | 15.17 | 61.23 | 63.16 | 2.62 |
| Line-7 | 1.42 | 17.67 | 12.94 | 47.25 | 12.44 | 120.94 | 264.44 | 16.00 | 60.17 | 59.75 | 2.92 |
| Line-8 | 1.37 | 17.28 | 14.03 | 46.85 | 12.22 | 107.72 | 251.61 | 14.83 | 61.09 | 62.35 | 2.72 |
| Line-9 | 11.38 | 20.50 | 18.78 | 49.28 | 12.56 | 112.50 | 278.44 | 15.39 | 62.20 | 61.93 | 2.84 |
| Line-10 | 1.70 | 17.50 | 12.33 | 48.28 | 11.67 | 139.67 | 279.00 | 17.67 | 57.51 | 57.23 | 2.66 |
| Line-11 | 0.42 | 19.86 | 16.07 | 41.84 | 9.28 | 60.44 | 163.78 | 14.27 | 52.04 | 49.34 | 2.26 |

Table 45. Provided are the values of each of the parameters (as described above) measured in maize accessions (line) under normal growth conditions. Growth conditions are specified in the experimental procedure section.

TABLE 46

Additional measured parameters in Maize accessions under normal growth conditions

| Line | Corr. ID | | | | | | | | | |
|---|---|---|---|---|---|---|---|---|---|---|
| | 12 | 13 | 14 | 15 | 16 | 17 | 18 | 19 | 20 | 21 |
| Line-1 | 8.94 | 3.2076 | 4.4521 | 23.431 | 24.978 | 0.0084 | 1335.6 | 426.09 | 456.71 | 0.167 |
| Line-2 | 7.02 | 3.9473 | 3.6235 | 19.052 | 17.807 | 0.0087 | 1087.1 | 312.97 | 412.44 | 0.1359 |
| Line-3 | 7.53 | 3.332 | 4.0084 | 20.293 | 20.332 | 0.0089 | 1202.5 | 307.28 | 443.37 | 0.1503 |
| Line-4 | 7.99 | 4.0116 | 4.2373 | 20.719 | 19.957 | 0.01 | 1271.2 | 362.44 | 438.7 | 0.1589 |
| Line-5 | 8.48 | 3.864 | 4.0099 | 20.486 | 19.026 | 0.0087 | 1203 | 314.14 | 446.66 | 0.1504 |
| Line-6 | 5.63 | 4.1908 | 3.1236 | 15.36 | 13.904 | 0.0106 | 937.08 | 224.58 | 356.95 | 0.1171 |
| Line-7 | 6.10 | 3.9688 | 3.2863 | 16.383 | 16.234 | 0.0094 | 985.89 | 266.44 | 337.49 | 0.1232 |
| Line-8 | 6.66 | 4.3216 | 3.5004 | 17.191 | 17.214 | 0.0091 | 1050.1 | 261.66 | 385.79 | 0.1313 |
| Line-9 | 8.40 | 2.8879 | 4.551 | 21.955 | 21.017 | 0.0759 | 1365.3 | 482.33 | 481.94 | 0.1707 |
| Line-10 | 8.21 | 4.306 | 4.0869 | 20.994 | 21.529 | 0.0038 | 1226.1 | | 471.57 | 0.1533 |
| Line-11 | 1.88 | | 1.0031 | 5.7249 | 5.5186 | 0.0028 | 300.93 | | 139.73 | 0.0376 |

Table 46. Provided are the values of each of the parameters (as described above) measured in maize accessions (line) under normal growth conditions. Growth conditions are specified in the experimental procedure section.

TABLE 47

Correlation between the expression level of selected LAB genes of some embodiments of the invention in various tissues and the phenotypic performance under low nitrogen conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB673 | 0.90 | 5.34E−03 | 1 | 18 | LAB673 | 0.96 | 5.41E−04 | 1 | 10 |
| LAB673 | 0.81 | 2.56E−02 | 1 | 17 | LAB673 | 0.75 | 5.02E−02 | 1 | 9 |
| LAB673 | 0.87 | 1.04E−02 | 1 | 3 | LAB673 | 0.88 | 8.49E−03 | 1 | 5 |
| LAB673 | 0.90 | 5.34E−03 | 1 | 14 | LAB673 | 0.94 | 1.83E−03 | 1 | 20 |
| LAB673 | 0.78 | 4.06E−02 | 1 | 6 | LAB673 | 0.90 | 5.28E−03 | 1 | 15 |
| LAB673 | 0.81 | 2.56E−02 | 1 | 12 | LAB673 | 0.84 | 3.68E−02 | 1 | 19 |
| LAB673 | 0.88 | 8.91E−03 | 1 | 2 | LAB673 | 0.83 | 2.01E−02 | 1 | 1 |
| LAB673 | 0.90 | 5.34E−03 | 1 | 21 | LAB673 | 0.93 | 2.59E−03 | 1 | 16 |
| LAB673 | 0.83 | 4.28E−02 | 6 | 18 | LAB673 | 0.88 | 1.96E−02 | 6 | 9 |
| LAB673 | 0.83 | 4.28E−02 | 6 | 14 | LAB673 | 0.83 | 4.28E−02 | 6 | 21 |
| LAB673 | 0.72 | 1.05E−01 | 6 | 16 | LAB673 | 0.90 | 2.15E−03 | 8 | 4 |
| LAB673 | 0.75 | 3.34E−02 | 8 | 5 | LAB673 | 0.79 | 2.05E−02 | 8 | 6 |
| LAB673 | 0.73 | 6.42E−02 | 4 | 17 | LAB673 | 0.83 | 2.00E−02 | 4 | 3 |
| LAB673 | 0.73 | 6.42E−02 | 4 | 12 | LAB675 | 0.88 | 9.25E−03 | 1 | 10 |
| LAB675 | 0.90 | 9.54E−04 | 5 | 4 | LAB675 | 0.79 | 1.11E−02 | 5 | 5 |
| LAB675 | 0.87 | 2.12E−03 | 5 | 6 | LAB675 | 0.79 | 3.63E−02 | 8 | 13 |
| LAB675 | 0.72 | 4.19E−02 | 8 | 17 | LAB675 | 0.88 | 3.76E−03 | 8 | 11 |
| LAB675 | 0.72 | 4.19E−02 | 8 | 12 | LAB675 | 0.71 | 4.74E−02 | 7 | 2 |
| LAB675 | 0.84 | 1.85E−02 | 4 | 8 | LAB676 | 0.98 | 4.64E−04 | 6 | 13 |
| LAB676 | 0.88 | 2.03E−02 | 6 | 11 | LAB676 | 0.71 | 7.63E−02 | 4 | 8 |
| LAB676 | 0.77 | 4.12E−02 | 4 | 11 | LAB677 | 0.80 | 5.69E−02 | 1 | 13 |

TABLE 47-continued

Correlation between the expression level of selected LAB genes of some embodiments of the invention in various tissues and the phenotypic performance under low nitrogen conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB677 | 0.97 | 1.77E−03 | 1 | 19 | LAB677 | 0.72 | 1.08E−01 | 6 | 8 |
| LAB677 | 0.71 | 7.34E−02 | 4 | 1 | LAB678 | 0.97 | 3.24E−04 | 1 | 10 |
| LAB678 | 0.78 | 4.04E−02 | 1 | 3 | LAB678 | 0.77 | 4.09E−02 | 1 | 5 |
| LAB678 | 0.76 | 4.77E−02 | 1 | 6 | LAB678 | 0.86 | 2.84E−02 | 6 | 4 |
| LAB678 | 0.89 | 1.72E−02 | 6 | 5 | LAB678 | 0.94 | 5.31E−03 | 6 | 6 |
| LAB678 | 0.83 | 3.88E−02 | 6 | 15 | LAB678 | 0.85 | 3.04E−02 | 6 | 19 |
| LAB678 | 0.76 | 7.97E−02 | 6 | 2 | LAB678 | 0.80 | 5.42E−02 | 6 | 1 |
| LAB678 | 0.75 | 8.28E−02 | 6 | 16 | LAB678 | 0.76 | 2.93E−02 | 8 | 1 |
| LAB678 | 0.79 | 1.92E−02 | 7 | 5 | LAB678 | 0.74 | 5.88E−02 | 4 | 7 |
| LAB679 | 0.74 | 9.48E−02 | 6 | 17 | LAB679 | 0.84 | 3.76E−02 | 6 | 9 |
| LAB679 | 0.91 | 1.16E−02 | 6 | 7 | LAB679 | 0.74 | 9.48E−02 | 6 | 12 |
| LAB679 | 0.72 | 7.02E−02 | 2 | 13 | LAB680 | 0.71 | 1.16E−01 | 6 | 10 |
| LAB680 | 0.76 | 7.89E−02 | 6 | 9 | LAB680 | 0.71 | 1.13E−01 | 6 | 3 |
| LAB681 | 0.84 | 1.78E−02 | 1 | 10 | LAB681 | 0.70 | 7.72E−02 | 1 | 2 |
| LAB681 | 0.90 | 5.35E−03 | 1 | 1 | LAB681 | 0.81 | 5.31E−02 | 6 | 11 |
| LAB681 | 0.77 | 7.22E−02 | 6 | 1 | LAB681 | 0.78 | 3.98E−02 | 8 | 19 |
| LAB681 | 0.82 | 1.20E−02 | 8 | 2 | LAB681 | 0.80 | 1.75E−02 | 8 | 1 |
| LAB681 | 0.83 | 9.99E−03 | 2 | 10 | LAB681 | 0.73 | 3.86E−02 | 2 | 17 |
| LAB681 | 0.95 | 2.93E−04 | 2 | 9 | LAB681 | 0.76 | 3.03E−02 | 2 | 3 |
| LAB681 | 0.75 | 3.14E−02 | 2 | 8 | LAB681 | 0.76 | 2.76E−02 | 2 | 7 |
| LAB681 | 0.73 | 3.86E−02 | 2 | 12 | LAB681 | 0.72 | 6.94E−02 | 4 | 4 |
| LAB681 | 0.84 | 1.71E−02 | 4 | 6 | LAB681 | 0.72 | 6.65E−02 | 4 | 1 |
| LAB682 | 0.87 | 9.98E−03 | 4 | 8 | LAB683 | 0.82 | 2.38E−02 | 1 | 18 |
| LAB683 | 0.75 | 5.36E−02 | 1 | 10 | LAB683 | 0.83 | 2.14E−02 | 1 | 17 |
| LAB683 | 0.88 | 8.89E−03 | 1 | 3 | LAB683 | 0.94 | 1.51E−03 | 1 | 5 |
| LAB683 | 0.82 | 2.38E−02 | 1 | 14 | LAB683 | 0.83 | 2.05E−02 | 1 | 20 |
| LAB683 | 0.78 | 3.69E−02 | 1 | 6 | LAB683 | 0.84 | 1.88E−02 | 1 | 15 |
| LAB683 | 0.83 | 2.14E−02 | 1 | 12 | LAB683 | 0.79 | 3.28E−02 | 1 | 1 |
| LAB683 | 0.82 | 2.38E−02 | 1 | 21 | LAB683 | 0.83 | 2.23E−02 | 1 | 16 |
| LAB683 | 0.93 | 6.62E−03 | 6 | 13 | LAB683 | 0.83 | 4.08E−02 | 6 | 8 |
| LAB683 | 0.99 | 1.61E−04 | 6 | 11 | LAB683 | 0.73 | 1.76E−02 | 3 | 18 |
| LAB683 | 0.73 | 1.76E−02 | 3 | 14 | LAB683 | 0.82 | 3.85E−03 | 3 | 20 |
| LAB683 | 0.72 | 1.89E−02 | 3 | 11 | LAB683 | 0.73 | 1.76E−02 | 3 | 21 |
| LAB683 | 0.74 | 1.43E−02 | 3 | 16 | LAB683 | 0.79 | 1.98E−02 | 8 | 10 |
| LAB683 | 0.72 | 4.59E−02 | 8 | 7 | LAB683 | 0.92 | 1.09E−03 | 2 | 17 |
| LAB683 | 0.78 | 2.25E−02 | 2 | 9 | LAB683 | 0.70 | 5.18E−02 | 2 | 3 |
| LAB683 | 0.78 | 2.38E−02 | 2 | 5 | LAB683 | 0.92 | 1.09E−03 | 2 | 12 |
| LAB683 | 0.87 | 1.04E−02 | 4 | 18 | LAB683 | 0.75 | 5.17E−02 | 4 | 3 |
| LAB683 | 0.87 | 1.04E−02 | 4 | 14 | LAB683 | 0.71 | 7.54E−02 | 4 | 11 |
| LAB683 | 0.80 | 3.10E−02 | 4 | 15 | LAB683 | 0.72 | 6.95E−02 | 4 | 19 |
| LAB683 | 0.87 | 1.04E−02 | 4 | 21 | LAB683 | 0.79 | 3.41E−02 | 4 | 16 |
| LAB684 | 0.73 | 1.01E−01 | 6 | 17 | LAB684 | 0.73 | 1.01E−01 | 6 | 12 |
| LAB684 | 0.73 | 6.09E−02 | 4 | 5 | LAB684 | 0.77 | 1.48E−02 | 5 | 17 |
| LAB685 | 0.77 | 1.48E−02 | 5 | 12 | LAB685 | 0.78 | 6.89E−02 | 6 | 6 |
| LAB685 | 0.72 | 1.05E−01 | 6 | 15 | LAB685 | 0.90 | 1.56E−02 | 6 | 19 |
| LAB685 | 0.80 | 5.51E−02 | 6 | 2 | LAB685 | 0.95 | 3.86E−03 | 6 | 1 |
| LAB685 | 0.76 | 2.86E−02 | 8 | 4 | LAB685 | 0.75 | 3.30E−02 | 8 | 5 |
| LAB685 | 0.76 | 2.96E−02 | 8 | 6 | LAB685 | 0.72 | 4.49E−02 | 8 | 2 |
| LAB685 | 0.74 | 3.66E−02 | 8 | 1 | LAB685 | 0.73 | 4.04E−02 | 7 | 8 |
| LAB685 | 0.80 | 3.02E−02 | 4 | 9 | LAB685 | 0.80 | 3.19E−02 | 4 | 4 |
| LAB685 | 0.96 | 5.69E−04 | 4 | 8 | LAB687 | 0.71 | 1.15E−01 | 6 | 3 |
| LAB687 | 0.91 | 1.14E−02 | 6 | 5 | LAB687 | 0.85 | 3.12E−02 | 6 | 6 |
| LAB687 | 0.74 | 3.43E−02 | 7 | 10 | LAB687 | 0.72 | 4.51E−02 | 2 | 18 |
| LAB687 | 0.87 | 4.77E−03 | 2 | 10 | LAB687 | 0.88 | 3.80E−03 | 2 | 17 |
| LAB687 | 0.71 | 4.99E−02 | 2 | 9 | LAB687 | 0.82 | 1.18E−02 | 2 | 4 |
| LAB687 | 0.75 | 3.28E−02 | 2 | 3 | LAB687 | 0.97 | 6.23E−05 | 2 | 5 |
| LAB687 | 0.72 | 4.51E−02 | 2 | 14 | LAB687 | 0.92 | 1.30E−03 | 2 | 6 |
| LAB687 | 0.74 | 3.45E−02 | 2 | 15 | LAB687 | 0.88 | 3.80E−03 | 2 | 12 |
| LAB687 | 0.72 | 4.51E−02 | 2 | 21 | LAB687 | 0.71 | 4.82E−02 | 2 | 16 |
| LAB688 | 0.71 | 1.13E−01 | 6 | 5 | LAB688 | 0.71 | 1.16E−01 | 6 | 20 |
| LAB688 | 0.75 | 8.29E−02 | 6 | 2 | LAB688 | 0.84 | 1.72E−02 | 4 | 4 |
| LAB689 | 0.92 | 3.25E−03 | 1 | 18 | LAB689 | 0.93 | 2.79E−03 | 1 | 10 |
| LAB689 | 0.75 | 5.03E−02 | 1 | 17 | LAB689 | 0.76 | 4.88E−02 | 1 | 9 |
| LAB689 | 0.87 | 1.11E−02 | 1 | 4 | LAB689 | 0.89 | 7.66E−03 | 1 | 3 |
| LAB689 | 0.88 | 8.19E−03 | 1 | 5 | LAB689 | 0.92 | 3.25E−03 | 1 | 14 |
| LAB689 | 0.91 | 4.14E−03 | 1 | 20 | LAB689 | 0.92 | 2.84E−03 | 1 | 6 |
| LAB689 | 0.92 | 3.06E−03 | 1 | 15 | LAB689 | 0.75 | 5.03E−02 | 1 | 12 |
| LAB689 | 0.92 | 3.25E−03 | 1 | 21 | LAB689 | 0.91 | 4.45E−03 | 1 | 16 |
| LAB689 | 0.71 | 4.75E−02 | 5 | 19 | LAB689 | 0.84 | 3.45E−02 | 6 | 5 |
| LAB689 | 0.82 | 3.43E−03 | 3 | 18 | LAB689 | 0.72 | 1.91E−02 | 3 | 9 |
| LAB689 | 0.79 | 6.52E−03 | 3 | 8 | LAB689 | 0.82 | 3.43E−03 | 3 | 14 |
| LAB689 | 0.80 | 5.22E−03 | 3 | 20 | LAB689 | 0.76 | 1.12E−02 | 3 | 15 |
| LAB689 | 0.84 | 2.64E−03 | 3 | 2 | LAB689 | 0.82 | 3.43E−03 | 3 | 21 |

TABLE 47-continued

Correlation between the expression level of selected LAB genes of some embodiments of the invention in various tissues and the phenotypic performance under low nitrogen conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB689 | 0.80 | 5.92E-03 | 3 | 16 | LAB689 | 0.81 | 1.45E-02 | 8 | 3 |
| LAB689 | 0.73 | 4.13E-02 | 8 | 15 | LAB689 | 0.78 | 2.38E-02 | 7 | 11 |
| LAB689 | 0.89 | 3.17E-03 | 2 | 18 | LAB689 | 0.82 | 1.24E-02 | 2 | 10 |
| LAB689 | 0.90 | 2.67E-03 | 2 | 17 | LAB689 | 0.89 | 3.20E-03 | 2 | 9 |
| LAB689 | 0.92 | 1.19E-03 | 2 | 3 | LAB689 | 0.77 | 2.51E-02 | 2 | 7 |
| LAB689 | 0.89 | 3.17E-03 | 2 | 14 | LAB689 | 0.85 | 7.91E-03 | 2 | 20 |
| LAB689 | 0.91 | 1.96E-03 | 2 | 15 | LAB689 | 0.90 | 2.67E-03 | 2 | 12 |
| LAB689 | 0.89 | 3.17E-03 | 2 | 21 | LAB689 | 0.88 | 3.92E-03 | 2 | 16 |
| LAB689 | 0.79 | 3.57E-02 | 4 | 5 | LAB690 | 0.92 | 1.01E-02 | 6 | 13 |
| LAB690 | 0.79 | 5.88E-02 | 6 | 18 | LAB690 | 0.79 | 5.88E-02 | 6 | 14 |
| LAB690 | 0.85 | 3.02E-02 | 6 | 11 | LAB690 | 0.79 | 5.88E-02 | 6 | 21 |
| LAB690 | 0.77 | 4.35E-02 | 8 | 19 | LAB690 | 0.76 | 4.57E-02 | 2 | 19 |
| LAB690 | 0.86 | 1.20E-02 | 4 | 3 | LAB691 | 0.80 | 3.00E-02 | 1 | 4 |
| LAB691 | 0.73 | 6.12E-02 | 1 | 5 | LAB691 | 0.71 | 7.55E-02 | 1 | 20 |
| LAB691 | 0.86 | 1.34E-02 | 1 | 6 | LAB691 | 0.75 | 5.35E-02 | 1 | 15 |
| LAB691 | 0.80 | 2.93E-02 | 1 | 2 | LAB691 | 0.81 | 2.64E-02 | 1 | 1 |
| LAB691 | 0.73 | 6.17E-02 | 1 | 16 | LAB691 | 0.76 | 7.95E-02 | 6 | 5 |
| LAB691 | 0.76 | 8.06E-02 | 6 | 6 | LAB692 | 0.83 | 2.21E-02 | 1 | 10 |
| LAB692 | 0.71 | 7.23E-02 | 1 | 9 | LAB692 | 0.71 | 3.20E-02 | 5 | 10 |
| LAB692 | 0.87 | 1.12E-02 | 7 | 13 | LAB693 | 0.84 | 3.73E-02 | 6 | 18 |
| LAB693 | 0.87 | 2.43E-02 | 6 | 4 | LAB693 | 0.84 | 3.73E-02 | 6 | 14 |
| LAB693 | 0.75 | 8.46E-02 | 6 | 20 | LAB693 | 0.81 | 5.24E-02 | 6 | 6 |
| LAB693 | 0.77 | 7.14E-02 | 6 | 15 | LAB693 | 0.83 | 4.32E-02 | 6 | 19 |
| LAB693 | 0.83 | 3.97E-02 | 6 | 2 | LAB693 | 0.84 | 3.73E-02 | 6 | 21 |
| LAB693 | 0.82 | 4.78E-02 | 6 | 16 | LAB693 | 0.81 | 2.57E-02 | 4 | 9 |
| LAB693 | 0.78 | 3.90E-02 | 4 | 8 | LAB694 | 0.79 | 6.36E-02 | 6 | 9 |
| LAB694 | 0.82 | 4.63E-02 | 6 | 8 | LAB694 | 0.80 | 5.75E-03 | 3 | 8 |
| LAB694 | 0.90 | 5.82E-03 | 4 | 7 | LAB695 | 0.83 | 1.96E-02 | 1 | 1 |
| LAB695 | 0.80 | 5.38E-02 | 6 | 5 | LAB695 | 0.80 | 1.81E-02 | 7 | 10 |
| LAB695 | 0.71 | 5.08E-02 | 7 | 9 | LAB695 | 0.72 | 4.59E-02 | 7 | 3 |
| LAB696 | 0.70 | 3.39E-02 | 5 | 17 | LAB696 | 0.72 | 2.91E-02 | 5 | 7 |
| LAB696 | 0.70 | 3.39E-02 | 5 | 12 | LAB696 | 0.75 | 8.57E-02 | 6 | 5 |
| LAB696 | 0.71 | 4.85E-02 | 8 | 7 | LAB696 | 0.83 | 2.14E-02 | 8 | 19 |
| LAB696 | 0.89 | 2.70E-03 | 2 | 7 | LAB696 | 0.88 | 8.09E-03 | 4 | 8 |
| LAB697 | 0.73 | 6.36E-02 | 1 | 2 | LAB697 | 0.87 | 1.06E-02 | 1 | 1 |
| LAB697 | 0.82 | 4.39E-02 | 6 | 20 | LAB697 | 0.86 | 2.94E-02 | 6 | 2 |
| LAB697 | 0.74 | 5.70E-02 | 8 | 13 | LAB697 | 0.73 | 6.18E-02 | 7 | 13 |
| LAB697 | 0.78 | 2.27E-02 | 7 | 11 | LAB697 | 0.71 | 5.01E-02 | 2 | 4 |
| LAB697 | 0.74 | 3.76E-02 | 2 | 6 | LAB697 | 0.76 | 2.86E-02 | 2 | 2 |
| LAB697 | 0.77 | 2.45E-02 | 2 | 1 | LAB697 | 0.76 | 4.60E-02 | 4 | 10 |
| LAB697 | 0.86 | 1.31E-02 | 4 | 4 | LAB697 | 0.70 | 7.86E-02 | 4 | 6 |
| LAB698 | 0.73 | 1.00E-01 | 1 | 13 | LAB698 | 0.84 | 1.82E-02 | 1 | 11 |
| LAB698 | 0.86 | 2.93E-03 | 5 | 18 | LAB698 | 0.80 | 1.03E-02 | 5 | 10 |
| LAB698 | 0.84 | 4.43E-03 | 5 | 17 | LAB698 | 0.85 | 3.41E-03 | 5 | 9 |
| LAB698 | 0.71 | 3.18E-02 | 5 | 4 | LAB698 | 0.90 | 1.04E-03 | 5 | 3 |
| LAB698 | 0.86 | 2.93E-03 | 5 | 14 | LAB698 | 0.78 | 1.27E-02 | 5 | 20 |
| LAB698 | 0.78 | 1.26E-02 | 5 | 6 | LAB698 | 0.84 | 4.27E-03 | 5 | 15 |
| LAB698 | 0.84 | 4.43E-03 | 5 | 12 | LAB698 | 0.73 | 4.06E-02 | 5 | 19 |
| LAB698 | 0.71 | 3.33E-02 | 5 | 1 | LAB698 | 0.86 | 2.93E-03 | 5 | 21 |
| LAB698 | 0.83 | 5.50E-03 | 5 | 16 | LAB698 | 0.90 | 1.53E-02 | 6 | 20 |
| LAB698 | 0.76 | 7.92E-02 | 6 | 2 | LAB698 | 0.75 | 8.72E-02 | 6 | 16 |
| LAB698 | 0.71 | 7.11E-02 | 7 | 13 | LAB698 | 0.85 | 6.94E-03 | 7 | 11 |
| LAB698 | 0.71 | 7.27E-02 | 4 | 5 | LAB700 | 0.75 | 5.23E-02 | 1 | 7 |
| LAB700 | 0.78 | 3.85E-02 | 4 | 8 | LAB701 | 0.95 | 3.60E-03 | 1 | 13 |
| LAB701 | 0.77 | 4.25E-02 | 1 | 11 | LAB701 | 0.93 | 6.82E-04 | 5 | 13 |
| LAB701 | 0.74 | 2.18E-02 | 5 | 11 | LAB701 | 0.92 | 8.33E-03 | 6 | 13 |
| LAB701 | 0.92 | 8.63E-03 | 6 | 11 | LAB701 | 0.92 | 3.42E-03 | 8 | 13 |
| LAB701 | 0.75 | 3.13E-02 | 8 | 11 | LAB701 | 0.89 | 7.33E-03 | 7 | 13 |
| LAB701 | 0.86 | 1.25E-02 | 2 | 13 | LAB701 | 0.94 | 1.60E-03 | 4 | 13 |
| LAB701 | 0.89 | 6.74E-03 | 4 | 11 | LAB702 | 0.76 | 4.62E-02 | 1 | 11 |
| LAB702 | 0.71 | 7.34E-02 | 1 | 2 | LAB702 | 0.91 | 4.98E-03 | 1 | 1 |
| LAB702 | 0.78 | 1.31E-02 | 5 | 10 | LAB702 | 0.78 | 3.95E-02 | 8 | 19 |
| LAB702 | 0.82 | 1.31E-02 | 2 | 10 | LAB702 | 0.93 | 9.45E-04 | 2 | 17 |
| LAB702 | 0.86 | 6.76E-03 | 2 | 9 | LAB702 | 0.73 | 3.97E-02 | 2 | 3 |
| LAB702 | 0.73 | 4.00E-02 | 2 | 5 | LAB702 | 0.93 | 9.45E-04 | 2 | 12 |
| LAB703 | 0.77 | 1.52E-02 | 5 | 10 | LAB703 | 0.70 | 3.56E-02 | 5 | 1 |
| LAB703 | 0.73 | 1.01E-01 | 6 | 5 | LAB703 | 0.72 | 4.33E-02 | 8 | 10 |
| LAB703 | 0.71 | 4.86E-02 | 7 | 10 | LAB703 | 0.85 | 1.46E-02 | 4 | 18 |
| LAB703 | 0.85 | 1.46E-02 | 4 | 14 | LAB703 | 0.79 | 3.44E-02 | 4 | 20 |
| LAB703 | 0.79 | 3.34E-02 | 4 | 15 | LAB703 | 0.82 | 2.41E-02 | 4 | 19 |
| LAB703 | 0.79 | 3.56E-02 | 4 | 2 | LAB703 | 0.84 | 1.88E-02 | 4 | 1 |
| LAB703 | 0.85 | 1.46E-02 | 4 | 21 | LAB703 | 0.80 | 3.12E-02 | 4 | 16 |
| LAB704 | 0.80 | 3.02E-02 | 1 | 18 | LAB704 | 0.75 | 5.14E-02 | 1 | 5 |

TABLE 47-continued

Correlation between the expression level of selected LAB genes of some embodiments of the invention in various tissues and the phenotypic performance under low nitrogen conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB704 | 0.80 | 3.02E−02 | 1 | 14 | LAB704 | 0.88 | 8.67E−03 | 1 | 20 |
| LAB704 | 0.73 | 6.34E−02 | 1 | 6 | LAB704 | 0.76 | 4.84E−02 | 1 | 15 |
| LAB704 | 0.87 | 1.16E−02 | 1 | 2 | LAB704 | 0.91 | 4.19E−03 | 1 | 1 |
| LAB704 | 0.80 | 3.02E−02 | 1 | 21 | LAB704 | 0.82 | 2.48E−02 | 1 | 16 |
| LAB704 | 0.71 | 3.20E−02 | 5 | 1 | LAB704 | 0.82 | 3.48E−03 | 3 | 10 |
| LAB704 | 0.73 | 4.00E−02 | 8 | 17 | LAB704 | 0.73 | 4.17E−02 | 8 | 5 |
| LAB704 | 0.73 | 4.00E−02 | 8 | 12 | LAB704 | 0.80 | 2.97E−02 | 7 | 13 |
| LAB704 | 0.79 | 1.92E−02 | 7 | 5 | LAB704 | 0.86 | 6.30E−03 | 7 | 11 |
| LAB704 | 0.72 | 4.31E−02 | 2 | 10 | LAB704 | 0.71 | 4.98E−02 | 2 | 5 |
| LAB705 | 0.71 | 1.15E−01 | 6 | 8 | LAB705 | 0.70 | 1.21E−01 | 6 | 7 |
| LAB705 | 0.78 | 3.72E−02 | 4 | 9 | LAB705 | 0.89 | 7.80E−03 | 4 | 8 |
| LAB706 | 0.76 | 8.02E−02 | 6 | 5 | LAB706 | 0.83 | 1.95E−02 | 7 | 13 |
| LAB706 | 0.71 | 7.54E−02 | 4 | 5 | LAB707 | 0.82 | 4.64E−02 | 1 | 13 |
| LAB708 | 0.80 | 5.61E−02 | 6 | 5 | LAB708 | 0.77 | 2.54E−02 | 2 | 5 |
| LAB708 | 0.70 | 7.97E−02 | 4 | 9 | LAB708 | 0.94 | 1.55E−03 | 4 | 8 |
| LAB709 | 0.93 | 7.18E−03 | 1 | 19 | LAB709 | 0.75 | 8.48E−02 | 6 | 3 |
| LAB709 | 0.78 | 3.77E−02 | 4 | 13 | LAB709 | 0.81 | 2.80E−02 | 4 | 11 |
| LAB710 | 0.79 | 3.37E−02 | 1 | 1 | LAB710 | 0.74 | 9.23E−02 | 6 | 18 |
| LAB710 | 0.85 | 3.14E−02 | 6 | 17 | LAB710 | 0.92 | 9.62E−03 | 6 | 4 |
| LAB710 | 0.74 | 9.23E−02 | 6 | 14 | LAB710 | 0.75 | 8.34E−02 | 6 | 15 |
| LAB710 | 0.85 | 3.14E−02 | 6 | 12 | LAB710 | 0.83 | 3.95E−02 | 6 | 19 |
| LAB710 | 0.74 | 9.23E−02 | 6 | 21 | LAB710 | 0.80 | 1.74E−02 | 8 | 10 |
| LAB710 | 0.79 | 2.03E−02 | 8 | 4 | LAB710 | 0.80 | 1.60E−02 | 8 | 5 |
| LAB710 | 0.79 | 1.88E−02 | 8 | 6 | LAB710 | 0.77 | 4.34E−02 | 4 | 6 |
| LAB711 | 0.87 | 1.15E−02 | 1 | 18 | LAB711 | 0.91 | 4.87E−03 | 1 | 10 |
| LAB711 | 0.75 | 5.35E−02 | 1 | 17 | LAB711 | 0.90 | 5.86E−03 | 1 | 4 |
| LAB711 | 0.83 | 2.04E−02 | 1 | 3 | LAB711 | 0.77 | 4.42E−02 | 1 | 5 |
| LAB711 | 0.87 | 1.15E−02 | 1 | 14 | LAB711 | 0.79 | 3.29E−02 | 1 | 20 |
| LAB711 | 0.86 | 1.28E−02 | 1 | 6 | LAB711 | 0.89 | 6.82E−03 | 1 | 15 |
| LAB711 | 0.75 | 5.35E−02 | 1 | 12 | LAB711 | 0.75 | 5.45E−02 | 1 | 2 |
| LAB711 | 0.87 | 1.15E−02 | 1 | 21 | LAB711 | 0.88 | 9.53E−03 | 1 | 16 |
| LAB711 | 0.72 | 1.94E−02 | 3 | 17 | LAB711 | 0.75 | 1.27E−02 | 3 | 5 |
| LAB711 | 0.72 | 1.94E−02 | 3 | 12 | LAB711 | 0.83 | 3.02E−03 | 3 | 1 |
| LAB711 | 0.77 | 2.60E−02 | 2 | 17 | LAB711 | 0.77 | 2.60E−02 | 2 | 12 |
| LAB712 | 0.86 | 2.62E−02 | 6 | 20 | LAB712 | 0.75 | 8.76E−02 | 6 | 2 |
| LAB712 | 0.71 | 1.15E−01 | 6 | 16 | LAB712 | 0.78 | 4.01E−02 | 8 | 13 |
| LAB713 | 0.73 | 6.18E−02 | 1 | 8 | LAB713 | 0.73 | 9.89E−02 | 6 | 13 |
| LAB713 | 0.74 | 9.06E−02 | 6 | 8 | LAB713 | 0.87 | 1.07E−02 | 2 | 13 |
| LAB714 | 0.79 | 6.21E−02 | 6 | 13 | LAB714 | 0.71 | 1.14E−01 | 6 | 9 |
| LAB714 | 0.73 | 9.71E−02 | 6 | 8 | LAB714 | 0.77 | 1.58E−02 | 3 | 13 |
| LAB714 | 0.81 | 2.79E−02 | 8 | 13 | LAB714 | 0.92 | 2.93E−03 | 7 | 13 |
| LAB714 | 0.87 | 5.53E−03 | 7 | 11 | | | | | |

Table 47. Correlations (R) between the genes expression levels in various tissues and the phenotypic performance under low nitrogen conditions.
"Corr. ID"—correlation set ID according to the correlated parameters Table above.
"Exp. Set"—Expression set.
"R" = Pearson correlation coefficient;
"P" = p value.

TABLE 48

Correlation between the expression level of selected LAB genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB673 | 0.72 | 6.61E−02 | 1 | 7 | LAB673 | 0.89 | 7.29E−03 | 1 | 5 |
| LAB673 | 0.75 | 5.01E−02 | 1 | 9 | LAB673 | 0.75 | 8.30E−02 | 5 | 8 |
| LAB673 | 0.95 | 1.03E−03 | 4 | 3 | LAB673 | 0.72 | 6.65E−02 | 4 | 8 |
| LAB673 | 0.84 | 3.50E−02 | 4 | 19 | LAB673 | 0.86 | 1.29E−02 | 4 | 2 |
| LAB673 | 0.85 | 1.63E−02 | 6 | 7 | LAB673 | 0.87 | 1.07E−02 | 6 | 5 |
| LAB673 | 0.73 | 6.10E−02 | 6 | 6 | LAB675 | 0.93 | 6.44E−03 | 1 | 13 |
| LAB675 | 0.90 | 5.75E−03 | 1 | 10 | LAB675 | 0.75 | 8.29E−02 | 5 | 11 |
| LAB675 | 0.92 | 1.03E−02 | 5 | 8 | LAB675 | 0.83 | 1.08E−02 | 2 | 12 |
| LAB675 | 0.75 | 3.37E−02 | 2 | 15 | LAB675 | 0.82 | 1.24E−02 | 2 | 14 |
| LAB675 | 0.71 | 4.95E−02 | 2 | 4 | LAB675 | 0.73 | 4.10E−02 | 2 | 16 |
| LAB675 | 0.82 | 1.24E−02 | 2 | 18 | LAB675 | 0.75 | 3.12E−02 | 2 | 8 |
| LAB675 | 0.82 | 1.24E−02 | 2 | 21 | LAB675 | 0.73 | 4.08E−02 | 2 | 20 |
| LAB675 | 0.70 | 7.82E−02 | 4 | 3 | LAB675 | 0.85 | 3.29E−02 | 4 | 19 |

TABLE 48-continued

Correlation between the expression level of selected LAB genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB675 | 0.83 | 1.98E−02 | 4 | 2 | LAB675 | 0.73 | 4.10E−02 | 3 | 13 |
| LAB675 | 0.77 | 2.61E−02 | 3 | 10 | LAB676 | 0.92 | 9.86E−03 | 5 | 10 |
| LAB677 | 0.94 | 1.38E−03 | 1 | 8 | LAB677 | 0.92 | 9.95E−03 | 5 | 5 |
| LAB677 | 0.75 | 3.24E−02 | 3 | 5 | LAB677 | 0.77 | 7.14E−02 | 6 | 13 |
| LAB678 | 0.79 | 3.63E−02 | 1 | 7 | LAB678 | 0.73 | 6.32E−02 | 1 | 12 |
| LAB678 | 0.83 | 2.21E−02 | 1 | 5 | LAB678 | 0.75 | 5.26E−02 | 1 | 15 |
| LAB678 | 0.73 | 6.17E−02 | 1 | 14 | LAB678 | 0.75 | 5.40E−02 | 1 | 4 |
| LAB678 | 0.90 | 6.39E−03 | 1 | 10 | LAB678 | 0.71 | 7.33E−02 | 1 | 16 |
| LAB678 | 0.85 | 1.67E−02 | 1 | 6 | LAB678 | 0.73 | 6.17E−02 | 1 | 18 |
| LAB678 | 0.73 | 6.17E−02 | 1 | 21 | LAB678 | 0.71 | 7.32E−02 | 1 | 9 |
| LAB678 | 0.78 | 3.74E−02 | 1 | 20 | LAB678 | 0.77 | 7.43E−02 | 5 | 11 |
| LAB678 | 0.75 | 8.39E−02 | 5 | 6 | LAB678 | 0.99 | 1.09E−04 | 5 | 8 |
| LAB678 | 0.88 | 4.35E−03 | 2 | 12 | LAB678 | 0.70 | 5.14E−02 | 2 | 11 |
| LAB678 | 0.82 | 1.22E−02 | 2 | 15 | LAB678 | 0.87 | 5.41E−03 | 2 | 14 |
| LAB678 | 0.79 | 1.90E−02 | 2 | 4 | LAB678 | 0.83 | 1.00E−02 | 2 | 16 |
| LAB678 | 0.87 | 5.41E−03 | 2 | 18 | LAB678 | 0.85 | 7.52E−03 | 2 | 8 |
| LAB678 | 0.87 | 5.41E−03 | 2 | 21 | LAB678 | 0.75 | 3.27E−02 | 2 | 19 |
| LAB678 | 0.81 | 1.52E−02 | 2 | 20 | LAB678 | 0.84 | 2.18E−03 | 8 | 17 |
| LAB678 | 0.84 | 2.18E−03 | 8 | 1 | LAB678 | 0.87 | 2.31E−03 | 8 | 19 |
| LAB678 | 0.96 | 5.76E−04 | 4 | 3 | LAB678 | 0.77 | 7.61E−02 | 4 | 19 |
| LAB678 | 0.71 | 7.49E−02 | 4 | 2 | LAB679 | 0.92 | 9.44E−03 | 1 | 19 |
| LAB679 | 0.80 | 3.07E−02 | 1 | 2 | LAB679 | 0.87 | 2.39E−02 | 5 | 11 |
| LAB679 | 0.89 | 1.87E−02 | 5 | 3 | LAB679 | 0.77 | 7.44E−02 | 5 | 20 |
| LAB679 | 0.92 | 1.07E−03 | 2 | 4 | LAB679 | 0.83 | 1.13E−02 | 2 | 8 |
| LAB679 | 0.75 | 3.07E−02 | 3 | 11 | LAB679 | 0.72 | 4.57E−02 | 3 | 4 |
| LAB680 | 0.79 | 1.96E−02 | 2 | 4 | LAB680 | 0.72 | 4.36E−02 | 2 | 6 |
| LAB681 | 0.85 | 3.33E−02 | 5 | 13 | LAB681 | 0.73 | 1.01E−01 | 5 | 10 |
| LAB681 | 0.71 | 1.17E−01 | 5 | 8 | LAB681 | 0.83 | 1.06E−02 | 2 | 7 |
| LAB681 | 0.73 | 4.00E−02 | 2 | 12 | LAB681 | 0.72 | 4.60E−02 | 2 | 4 |
| LAB681 | 0.85 | 7.03E−03 | 2 | 6 | LAB681 | 0.72 | 6.69E−02 | 4 | 3 |
| LAB681 | 0.81 | 2.57E−02 | 4 | 2 | LAB681 | 0.71 | 5.08E−02 | 3 | 11 |
| LAB681 | 0.82 | 2.44E−02 | 6 | 12 | LAB681 | 0.81 | 2.68E−02 | 6 | 11 |
| LAB681 | 0.82 | 2.44E−02 | 6 | 15 | LAB681 | 0.82 | 2.47E−02 | 6 | 14 |
| LAB681 | 0.85 | 1.42E−02 | 6 | 4 | LAB681 | 0.73 | 6.22E−02 | 6 | 10 |
| LAB681 | 0.76 | 4.74E−02 | 6 | 16 | LAB681 | 0.82 | 2.47E−02 | 6 | 18 |
| LAB681 | 0.82 | 2.47E−02 | 6 | 21 | LAB681 | 0.81 | 2.75E−02 | 6 | 20 |
| LAB681 | 0.76 | 1.79E−02 | 7 | 4 | LAB681 | 0.79 | 1.08E−02 | 7 | 10 |
| LAB682 | 0.77 | 4.20E−02 | 6 | 8 | LAB683 | 0.71 | 1.17E−01 | 1 | 13 |
| LAB683 | 0.79 | 1.97E−02 | 2 | 12 | LAB683 | 0.72 | 4.61E−02 | 2 | 15 |
| LAB683 | 0.90 | 2.04E−03 | 2 | 4 | LAB683 | 0.99 | 3.77E−05 | 4 | 17 |
| LAB683 | 0.99 | 3.77E−05 | 4 | 1 | LAB683 | 0.85 | 3.27E−02 | 4 | 19 |
| LAB683 | 0.87 | 5.40E−03 | 3 | 10 | LAB683 | 0.79 | 3.37E−02 | 6 | 7 |
| LAB683 | 0.86 | 1.32E−02 | 6 | 12 | LAB683 | 0.77 | 4.39E−02 | 6 | 11 |
| LAB683 | 0.88 | 8.97E−03 | 6 | 15 | LAB683 | 0.87 | 1.13E−02 | 6 | 14 |
| LAB683 | 0.81 | 2.81E−02 | 6 | 4 | LAB683 | 0.84 | 1.89E−02 | 6 | 16 |
| LAB683 | 0.78 | 3.93E−02 | 6 | 6 | LAB683 | 0.87 | 1.13E−02 | 6 | 18 |
| LAB683 | 0.87 | 1.13E−02 | 6 | 21 | LAB683 | 0.79 | 6.21E−02 | 6 | 19 |
| LAB683 | 0.88 | 9.36E−03 | 6 | 20 | LAB683 | 0.85 | 7.72E−03 | 7 | 13 |
| LAB683 | 0.78 | 1.37E−02 | 7 | 10 | LAB684 | 0.89 | 1.76E−02 | 1 | 13 |
| LAB684 | 0.78 | 2.36E−02 | 2 | 12 | LAB684 | 0.91 | 1.58E−03 | 2 | 4 |
| LAB684 | 0.90 | 2.53E−03 | 2 | 8 | LAB685 | 0.92 | 9.61E−03 | 5 | 5 |
| LAB685 | 0.87 | 2.45E−02 | 5 | 3 | LAB685 | 0.71 | 7.16E−02 | 4 | 11 |
| LAB685 | 0.76 | 4.81E−02 | 4 | 5 | LAB685 | 0.71 | 7.35E−02 | 4 | 14 |
| LAB685 | 0.90 | 5.61E−03 | 4 | 4 | LAB685 | 0.82 | 2.25E−02 | 4 | 10 |
| LAB685 | 0.71 | 7.35E−02 | 4 | 18 | LAB685 | 0.75 | 5.04E−02 | 4 | 8 |
| LAB685 | 0.71 | 7.35E−02 | 4 | 21 | LAB685 | 0.89 | 6.63E−03 | 4 | 9 |
| LAB685 | 0.71 | 7.38E−02 | 4 | 20 | LAB685 | 0.74 | 3.40E−02 | 3 | 12 |
| LAB685 | 0.73 | 3.82E−02 | 3 | 15 | LAB685 | 0.70 | 5.24E−02 | 3 | 14 |
| LAB685 | 0.70 | 5.24E−02 | 3 | 18 | LAB685 | 0.70 | 5.24E−02 | 3 | 21 |
| LAB685 | 0.75 | 3.04E−02 | 3 | 2 | LAB685 | 0.77 | 1.42E−02 | 7 | 4 |
| LAB685 | 0.74 | 2.32E−02 | 7 | 8 | LAB686 | 0.72 | 4.51E−02 | 2 | 17 |
| LAB686 | 0.72 | 4.51E−02 | 2 | 1 | LAB687 | 0.71 | 7.36E−02 | 1 | 17 |
| LAB687 | 0.71 | 7.36E−02 | 1 | 1 | LAB687 | 0.92 | 9.97E−03 | 5 | 11 |
| LAB687 | 0.84 | 3.75E−02 | 5 | 8 | LAB687 | 0.84 | 9.89E−03 | 2 | 17 |
| LAB687 | 0.84 | 9.89E−03 | 2 | 1 | LAB687 | 0.73 | 1.64E−02 | 8 | 7 |
| LAB687 | 0.74 | 1.49E−02 | 8 | 6 | LAB687 | 0.76 | 4.61E−02 | 4 | 5 |
| LAB687 | 0.71 | 7.32E−02 | 4 | 15 | LAB687 | 0.73 | 6.38E−02 | 4 | 14 |
| LAB687 | 0.73 | 6.38E−02 | 4 | 18 | LAB687 | 0.84 | 1.67E−02 | 4 | 8 |
| LAB687 | 0.73 | 6.38E−02 | 4 | 21 | LAB687 | 0.72 | 6.58E−02 | 4 | 20 |
| LAB687 | 0.81 | 2.68E−02 | 6 | 10 | LAB687 | 0.72 | 2.82E−02 | 7 | 12 |
| LAB687 | 0.90 | 1.01E−03 | 7 | 4 | LAB688 | 0.75 | 8.35E−02 | 5 | 5 |
| LAB689 | 0.86 | 1.34E−02 | 1 | 5 | LAB689 | 0.77 | 4.41E−02 | 1 | 9 |
| LAB689 | 0.74 | 9.04E−02 | 5 | 10 | LAB689 | 0.71 | 5.08E−02 | 2 | 7 |

TABLE 48-continued

Correlation between the expression level of selected LAB genes of some
embodiments of the invention in various tissues and the phenotypic
performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB689 | 0.74 | 3.46E−02 | 2 | 12 | LAB689 | 0.88 | 3.68E−03 | 2 | 4 |
| LAB689 | 0.76 | 2.78E−02 | 2 | 6 | LAB689 | 0.72 | 4.42E−02 | 2 | 8 |
| LAB689 | 0.90 | 3.41E−04 | 8 | 11 | LAB689 | 0.70 | 7.75E−02 | 4 | 7 |
| LAB689 | 0.73 | 6.36E−02 | 4 | 12 | LAB689 | 0.79 | 3.57E−02 | 4 | 17 |
| LAB689 | 0.73 | 6.37E−02 | 4 | 15 | LAB689 | 0.75 | 5.01E−02 | 4 | 14 |
| LAB689 | 0.80 | 3.14E−02 | 4 | 3 | LAB689 | 0.74 | 5.83E−02 | 4 | 16 |
| LAB689 | 0.75 | 5.01E−02 | 4 | 18 | LAB689 | 0.73 | 6.13E−02 | 4 | 8 |
| LAB689 | 0.75 | 5.01E−02 | 4 | 21 | LAB689 | 0.79 | 3.57E−02 | 4 | 1 |
| LAB689 | 0.83 | 3.98E−02 | 4 | 19 | LAB689 | 0.73 | 6.24E−02 | 4 | 20 |
| LAB689 | 0.78 | 2.21E−02 | 3 | 10 | LAB689 | 0.74 | 5.92E−02 | 6 | 5 |
| LAB689 | 0.83 | 1.96E−02 | 6 | 8 | LAB689 | 0.72 | 4.51E−02 | 7 | 13 |
| LAB689 | 0.72 | 2.97E−02 | 7 | 5 | LAB689 | 0.72 | 2.90E−02 | 7 | 9 |
| LAB690 | 0.86 | 2.71E−02 | 1 | 19 | LAB690 | 0.71 | 1.17E−01 | 5 | 7 |
| LAB690 | 0.91 | 1.22E−02 | 5 | 5 | LAB690 | 0.82 | 1.24E−02 | 3 | 7 |
| LAB690 | 0.72 | 1.09E−01 | 6 | 13 | LAB691 | 0.82 | 4.81E−02 | 5 | 5 |
| LAB691 | 0.82 | 1.17E−02 | 2 | 5 | LAB691 | 0.78 | 3.68E−02 | 4 | 6 |
| LAB692 | 0.83 | 2.17E−02 | 1 | 10 | LAB692 | 0.77 | 7.09E−02 | 5 | 11 |
| LAB692 | 0.94 | 5.24E−03 | 5 | 8 | LAB692 | 0.80 | 1.62E−02 | 2 | 8 |
| LAB692 | 0.77 | 1.42E−02 | 8 | 13 | LAB692 | 0.88 | 2.08E−02 | 4 | 13 |
| LAB693 | 0.75 | 8.40E−02 | 5 | 11 | LAB693 | 0.75 | 8.78E−02 | 5 | 6 |
| LAB693 | 0.88 | 2.08E−02 | 5 | 8 | LAB693 | 0.84 | 8.96E−03 | 2 | 5 |
| LAB693 | 0.85 | 1.89E−03 | 8 | 3 | LAB693 | 0.75 | 2.09E−02 | 8 | 19 |
| LAB693 | 0.83 | 1.03E−02 | 3 | 11 | LAB693 | 0.81 | 1.38E−02 | 3 | 8 |
| LAB693 | 0.87 | 2.30E−02 | 6 | 13 | LAB694 | 0.76 | 2.87E−02 | 2 | 3 |
| LAB695 | 0.87 | 1.12E−02 | 1 | 2 | LAB695 | 0.70 | 1.20E−01 | 5 | 16 |
| LAB695 | 0.82 | 4.69E−02 | 5 | 6 | LAB695 | 0.72 | 1.07E−01 | 5 | 8 |
| LAB695 | 0.72 | 2.85E−02 | 7 | 4 | LAB695 | 0.72 | 2.87E−02 | 7 | 8 |
| LAB696 | 0.90 | 5.25E−03 | 1 | 7 | LAB696 | 0.79 | 3.45E−02 | 1 | 12 |
| LAB696 | 0.94 | 1.52E−03 | 1 | 5 | LAB696 | 0.81 | 2.84E−02 | 1 | 15 |
| LAB696 | 0.80 | 3.04E−02 | 1 | 14 | LAB696 | 0.74 | 5.48E−02 | 1 | 4 |
| LAB696 | 0.78 | 3.78E−02 | 1 | 10 | LAB696 | 0.80 | 2.90E−02 | 1 | 16 |
| LAB696 | 0.83 | 2.05E−02 | 1 | 6 | LAB696 | 0.80 | 3.04E−02 | 1 | 18 |
| LAB696 | 0.80 | 3.04E−02 | 1 | 21 | LAB696 | 0.76 | 4.91E−02 | 1 | 9 |
| LAB696 | 0.84 | 1.68E−02 | 1 | 20 | LAB696 | 0.72 | 1.04E−01 | 5 | 17 |
| LAB696 | 0.72 | 1.04E−01 | 5 | 1 | LAB696 | 0.76 | 7.96E−02 | 5 | 9 |
| LAB696 | 0.75 | 3.30E−02 | 2 | 4 | LAB696 | 0.76 | 4.77E−02 | 6 | 8 |
| LAB696 | 0.73 | 2.46E−02 | 7 | 7 | LAB696 | 0.76 | 1.85E−02 | 7 | 12 |
| LAB696 | 0.70 | 3.54E−02 | 7 | 11 | LAB696 | 0.72 | 3.01E−02 | 7 | 15 |
| LAB696 | 0.75 | 2.04E−02 | 7 | 14 | LAB696 | 0.86 | 2.63E−03 | 7 | 4 |
| LAB696 | 0.75 | 2.04E−02 | 7 | 18 | LAB696 | 0.75 | 1.93E−02 | 7 | 8 |
| LAB696 | 0.75 | 2.04E−02 | 7 | 21 | LAB696 | 0.74 | 2.21E−02 | 7 | 20 |
| LAB697 | 0.77 | 4.43E−02 | 1 | 17 | LAB697 | 0.77 | 4.43E−02 | 1 | 1 |
| LAB697 | 0.77 | 7.19E−02 | 1 | 19 | LAB697 | 0.74 | 9.08E−02 | 5 | 17 |
| LAB697 | 0.74 | 9.08E−02 | 5 | 1 | LAB697 | 0.80 | 1.71E−02 | 2 | 4 |
| LAB697 | 0.99 | 2.61E−05 | 4 | 17 | LAB697 | 0.99 | 2.61E−05 | 4 | 1 |
| LAB697 | 0.89 | 1.60E−02 | 4 | 19 | LAB697 | 0.79 | 3.45E−02 | 6 | 7 |
| LAB697 | 0.76 | 4.67E−02 | 6 | 6 | LAB697 | 0.73 | 3.97E−02 | 2 | 15 |
| LAB698 | 0.74 | 3.76E−02 | 2 | 14 | LAB698 | 0.74 | 3.76E−02 | 2 | 18 |
| LAB698 | 0.74 | 3.76E−02 | 2 | 21 | LAB698 | 0.77 | 2.45E−02 | 2 | 20 |
| LAB698 | 0.80 | 3.26E−02 | 4 | 6 | LAB698 | 0.83 | 2.03E−02 | 6 | 7 |
| LAB698 | 0.76 | 4.92E−02 | 6 | 12 | LAB698 | 0.92 | 3.14E−02 | 6 | 5 |
| LAB698 | 0.77 | 4.23E−02 | 6 | 15 | LAB698 | 0.76 | 4.81E−02 | 6 | 14 |
| LAB698 | 0.72 | 7.09E−02 | 6 | 4 | LAB698 | 0.84 | 1.77E−02 | 6 | 10 |
| LAB698 | 0.79 | 3.40E−02 | 6 | 16 | LAB698 | 0.85 | 1.52E−02 | 6 | 6 |
| LAB698 | 0.76 | 4.81E−02 | 6 | 18 | LAB698 | 0.76 | 4.81E−02 | 6 | 21 |
| LAB698 | 0.79 | 3.55E−02 | 6 | 9 | LAB698 | 0.79 | 3.50E−02 | 6 | 20 |
| LAB700 | 0.78 | 2.25E−02 | 2 | 4 | LAB700 | 0.79 | 2.03E−02 | 2 | 8 |
| LAB701 | 0.80 | 5.62E−02 | 1 | 13 | LAB701 | 0.75 | 3.31E−02 | 2 | 5 |
| LAB701 | 0.92 | 1.00E−02 | 6 | 13 | LAB702 | 0.71 | 1.17E−01 | 5 | 13 |
| LAB702 | 0.70 | 1.21E−01 | 5 | 10 | LAB702 | 0.84 | 8.58E−03 | 2 | 4 |
| LAB702 | 0.71 | 5.08E−02 | 2 | 8 | LAB702 | 0.71 | 4.90E−02 | 7 | 13 |
| LAB703 | 0.71 | 1.17E−01 | 5 | 9 | LAB703 | 0.91 | 1.65E−03 | 2 | 12 |
| LAB703 | 0.90 | 2.34E−03 | 2 | 15 | LAB703 | 0.90 | 2.21E−03 | 2 | 14 |
| LAB703 | 0.78 | 2.26E−02 | 2 | 4 | LAB703 | 0.89 | 3.01E−03 | 2 | 16 |
| LAB703 | 0.90 | 2.21E−03 | 2 | 18 | LAB703 | 0.74 | 3.76E−02 | 2 | 8 |
| LAB703 | 0.90 | 2.21E−03 | 2 | 21 | LAB703 | 0.89 | 3.21E−03 | 2 | 19 |
| LAB703 | 0.78 | 2.24E−02 | 2 | 20 | LAB703 | 0.91 | 5.06E−03 | 4 | 17 |
| LAB703 | 0.70 | 7.98E−02 | 4 | 14 | LAB703 | 0.73 | 6.45E−02 | 4 | 4 |
| LAB703 | 0.71 | 7.30E−02 | 4 | 3 | LAB703 | 0.70 | 7.98E−02 | 4 | 18 |
| LAB703 | 0.70 | 7.98E−02 | 4 | 21 | LAB703 | 0.91 | 5.06E−03 | 4 | 1 |
| LAB703 | 0.95 | 4.35E−03 | 4 | 19 | LAB703 | 0.77 | 4.34E−02 | 6 | 7 |
| LAB703 | 0.79 | 3.54E−02 | 6 | 12 | LAB703 | 0.82 | 2.31E−02 | 6 | 15 |
| LAB703 | 0.78 | 3.81E−02 | 6 | 14 | LAB703 | 0.78 | 3.96E−02 | 6 | 16 |

TABLE 48-continued

Correlation between the expression level of selected LAB genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LAB703 | 0.86 | 1.40E-02 | 6 | 6 | LAB703 | 0.78 | 3.81E-02 | 6 | 18 |
| LAB703 | 0.79 | 3.48E-02 | 6 | 8 | LAB703 | 0.78 | 3.81E-02 | 6 | 21 |
| LAB703 | 0.82 | 2.47E-02 | 6 | 20 | LAB704 | 0.90 | 5.64E-03 | 1 | 7 |
| LAB704 | 0.85 | 1.51E-02 | 1 | 12 | LAB704 | 0.73 | 6.22E-02 | 1 | 11 |
| LAB704 | 0.86 | 1.42E-02 | 1 | 5 | LAB704 | 0.88 | 9.03E-03 | 1 | 15 |
| LAB704 | 0.86 | 1.28E-02 | 1 | 14 | LAB704 | 0.71 | 7.41E-02 | 1 | 4 |
| LAB704 | 0.87 | 1.16E-02 | 1 | 16 | LAB704 | 0.87 | 9.95E-03 | 1 | 6 |
| LAB704 | 0.86 | 1.28E-02 | 1 | 18 | LAB704 | 0.70 | 7.75E-02 | 1 | 8 |
| LAB704 | 0.86 | 1.28E-02 | 1 | 21 | LAB704 | 0.89 | 7.60E-03 | 1 | 20 |
| LAB704 | 0.84 | 4.84E-03 | 8 | 13 | LAB704 | 0.71 | 7.62E-02 | 4 | 11 |
| LAB704 | 0.74 | 3.59E-02 | 3 | 2 | LAB704 | 0.75 | 5.42E-02 | 6 | 12 |
| LAB704 | 0.78 | 3.74E-02 | 6 | 11 | LAB704 | 0.73 | 6.00E-02 | 6 | 15 |
| LAB704 | 0.73 | 6.11E-02 | 6 | 14 | LAB704 | 0.80 | 3.11E-02 | 6 | 4 |
| LAB704 | 0.87 | 1.09E-02 | 6 | 10 | LAB704 | 0.73 | 6.11E-02 | 6 | 18 |
| LAB704 | 0.73 | 6.11E-02 | 6 | 21 | LAB704 | 0.75 | 5.40E-02 | 6 | 9 |
| LAB704 | 0.74 | 5.83E-02 | 6 | 20 | LAB704 | 0.82 | 6.64E-03 | 7 | 11 |
| LAB704 | 0.72 | 2.89E-02 | 7 | 15 | LAB704 | 0.72 | 2.99E-02 | 7 | 14 |
| LAB704 | 0.71 | 3.11E-02 | 7 | 16 | LAB704 | 0.72 | 2.99E-02 | 7 | 18 |
| LAB704 | 0.72 | 2.99E-02 | 7 | 21 | LAB705 | 0.74 | 9.41E-02 | 5 | 17 |
| LAB705 | 0.74 | 9.41E-02 | 5 | 1 | LAB705 | 0.90 | 2.63E-03 | 2 | 7 |
| LAB705 | 0.84 | 8.58E-03 | 2 | 6 | LAB705 | 0.72 | 4.45E-02 | 3 | 17 |
| LAB705 | 0.72 | 4.45E-02 | 3 | 1 | LAB706 | 0.70 | 1.19E-01 | 5 | 8 |
| LAB706 | 0.72 | 4.50E-02 | 2 | 4 | LAB707 | 0.71 | 1.14E-01 | 5 | 6 |
| LAB707 | 0.81 | 7.79E-03 | 7 | 2 | LAB708 | 0.77 | 7.10E-02 | 1 | 19 |
| LAB708 | 0.87 | 1.09E-02 | 1 | 2 | LAB708 | 0.71 | 4.62E-02 | 2 | 10 |
| LAB708 | 0.93 | 7.87E-04 | 3 | 3 | LAB708 | 0.77 | 2.51E-02 | 3 | 20 |
| LAB708 | 0.73 | 6.08E-02 | 6 | 5 | LAB708 | 0.75 | 5.45E-02 | 6 | 10 |
| LAB708 | 0.71 | 7.51E-02 | 6 | 6 | LAB709 | 0.80 | 5.42E-02 | 5 | 5 |
| LAB709 | 0.83 | 4.01E-02 | 4 | 19 | LAB709 | 0.79 | 3.52E-02 | 4 | 2 |
| LAB709 | 0.81 | 8.58E-03 | 7 | 4 | LAB709 | 0.89 | 1.17E-03 | 7 | 8 |
| LAB710 | 0.78 | 6.46E-02 | 5 | 11 | LAB710 | 0.86 | 2.77E-02 | 5 | 4 |
| LAB710 | 0.76 | 1.01E-02 | 8 | 17 | LAB710 | 0.76 | 1.01E-02 | 8 | 1 |
| LAB710 | 0.79 | 3.36E-02 | 4 | 17 | LAB710 | 0.72 | 6.91E-02 | 4 | 8 |
| LAB710 | 0.79 | 3.36E-02 | 4 | 1 | LAB710 | 0.72 | 1.09E-01 | 4 | 19 |
| LAB710 | 0.80 | 3.05E-02 | 6 | 3 | LAB710 | 0.76 | 4.94E-02 | 6 | 8 |
| LAB711 | 0.88 | 9.36E-03 | 1 | 7 | LAB711 | 0.82 | 2.40E-02 | 1 | 12 |
| LAB711 | 0.77 | 4.36E-02 | 1 | 11 | LAB711 | 0.97 | 3.29E-04 | 1 | 5 |
| LAB711 | 0.83 | 2.20E-02 | 1 | 15 | LAB711 | 0.83 | 1.97E-02 | 1 | 14 |
| LAB711 | 0.85 | 1.43E-02 | 1 | 16 | LAB711 | 0.81 | 2.71E-02 | 1 | 6 |
| LAB711 | 0.83 | 1.97E-02 | 1 | 18 | LAB711 | 0.77 | 4.41E-02 | 1 | 8 |
| LAB711 | 0.83 | 1.97E-02 | 1 | 21 | LAB711 | 0.76 | 4.76E-02 | 1 | 9 |
| LAB711 | 0.84 | 1.71E-02 | 1 | 20 | LAB711 | 0.71 | 1.12E-01 | 5 | 11 |
| LAB711 | 0.83 | 1.15E-02 | 2 | 12 | LAB711 | 0.76 | 3.01E-02 | 2 | 15 |
| LAB711 | 0.70 | 5.11E-02 | 2 | 14 | LAB711 | 0.94 | 4.28E-04 | 2 | 4 |
| LAB711 | 0.74 | 3.48E-02 | 2 | 16 | LAB711 | 0.70 | 5.11E-02 | 2 | 18 |
| LAB711 | 0.70 | 5.11E-02 | 2 | 21 | LAB711 | 0.72 | 4.50E-02 | 2 | 19 |
| LAB711 | 0.71 | 3.37E-02 | 7 | 8 | LAB712 | 0.76 | 7.83E-02 | 5 | 5 |
| LAB712 | 0.80 | 5.38E-02 | 5 | 3 | LAB712 | 0.75 | 5.32E-02 | 6 | 5 |
| LAB713 | 0.92 | 9.07E-03 | 5 | 5 | LAB714 | 0.70 | 1.19E-01 | 5 | 10 |
| LAB714 | 0.83 | 3.99E-02 | 5 | 9 | LAB714 | 0.78 | 2.37E-02 | 2 | 4 |
| LAB714 | 0.72 | 6.72E-02 | 4 | 17 | LAB714 | 0.72 | 6.72E-02 | 4 | 1 |

Table 48. Correlations (R) between the genes expression levels in various tissues and the phenotypic performance under Normal conditions.
"Corr. ID"—correlation set ID according to the correlated parameters Table above.
"Exp. Set"—Expression set.
"R" = Pearson correlation coefficient;
"P" = p value.

Example 7

Production of Maize Transcriptom and High Throughput Correlation Analysis with Yield and NUE Related Parameters Using 44K Maize Oligonucleotide Micro-Arrays In order to produce a high throughput correlation analysis between plant phenotype and gene expression level, the present inventors utilized a maize oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 maize genes and transcripts.

Correlation of Maize Hybrids Across Ecotypes Grown Under Regular Growth Conditions Experimental Procedures Twelve Maize hybrids were grown in 3 repetitive plots, in field. Maize seeds were planted and plants were grown in the field using commercial fertilization and irrigation protocols. In order to define correlations between the levels of RNA expression with stress and yield components or vigor related parameters, the 12 different maize hybrids were analyzed.

Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Analyzed Maize tissues—All 10 selected maize hybrids were sampled per 3 time points (TP2=V6-V8, TP5=R1-R2, TP6=R3-R4). Four types of plant tissues [Ear, flag leaf (indicated in Table 49 as "leaf"), grain distal part, and internode] growing under normal conditions were sampled and RNA was extracted as described above. Each microarray expression information tissue type has received a Set ID as summarized in Table 49 below.

TABLE 49

Maize transcriptom expression sets under normal growth conditions

| Expression Set | Set ID |
|---|---|
| Maize field/Normal/Ear TP5 | 1 |
| Maize field/Normal/Ear TP6 | 2 |
| Maize field/Normal/Internode TP2 | 3 |
| Maize field/Normal/Internode TP5 | 4 |
| Maize field/Normal/Internode TP6 | 5 |
| Maize field/Normal/Leaf TP2 | 6 |
| Maize field/Normal/Leaf TP5 | 7 |
| Maize field/Normal/Grain Distal | 8 |

Table 49: Provided are the maize transcriptom expression sets.
Leaf = the leaf below the main ear;
Flower meristem = Apical meristem following male flower initiation;
Ear = the female flower at the anthesis day.
Grain Distal = maize developing grains from the cob extreme area,
Grain Basal = maize developing grains from the cob basal area;
Internodes = internodes located above and below the main ear in the plant.
TP = time point.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were, photographed and images were processed using the below described image processing system. The Ear area was measured from those images and was divided by the number of Ears.

Ear Length and Ear Width (cm)—At the end of the growing period 5 ears were, photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height [cm]—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant [num]—Plants were characterized for leaf number during growing period at 5 time points. In each measure, plants were measured for their leaf number by counting all the leaves of 3 selected plants per plot.

Relative Growth Rate was calculated using Formula II (described above).

SPAD [SPAD unit]—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index was calculated using Formula VIII above.

Percent Filled Ear [%]—was calculated as the percentage of the Ear area with grains out of the total ear.

Cob diameter [mm]—The diameter of the cob without grains was measured using a ruler.

Kernel Row Number per Ear [num]—The number of rows in each ear was counted.

Data parameters collected are summarized in Table 50, herein below

TABLE 50

Maize correlated parameters (vectors)

| Correlated parameter with | Correlation ID |
|---|---|
| Cob Diameter (mm) | 1 |
| DW per Plant based on 6 (gr.) | 2 |
| Ear Area ($cm^2$) | 3 |
| Ear FW per Plant based on 6 (gr.) | 4 |
| Ear Height (cm) | 5 |

TABLE 50-continued

Maize correlated parameters (vectors)

| Correlated parameter with | Correlation ID |
|---|---|
| Ear Length (cm) | 6 |
| Ear Width (cm) | 7 |
| Ears FW per plant based on all (gr.) | 8 |
| Filled per Whole Ear | 9 |
| Grain Area (cm$^2$) | 10 |
| Grain Length (cm) | 11 |
| Grain Width (cm) | 12 |
| Growth Rate Leaf Num | 13 |
| Kernel Row Number per Ear | 14 |
| Leaf Number per Plant | 15 |
| Normalized Grain Weight per Plant based on all (gr.) | 16 |
| Normalized Grain Weight per plant based on 6 (gr.) | 17 |
| Percent Filled Ear | 18 |
| Plant Height per Plot (cm) | 19 |
| SPAD 46DPS TP2 (SPAD unit) | 20 |
| SPAD 54DPS TP5 (SPAD unit) | 21 |

Table 50. SPAD 46DPS and SPAD 54DPS: Chlorophyll level after 46 and 54 days after sowing (DPS).
"FW" = fresh weight;
"DW" = dry weight.
"TP" = Time point.

Experimental Results

Twelve different maize hybrids were grown and characterized for different parameters. The correlated parameters are described in Table 50 above. The average for each of the measured parameter was calculated using the JMP software (Tables 51-52) and a subsequent correlation analysis was performed (Table 53). Results were then integrated to the database.

TABLE 51

Measured parameters in Maize accessions under normal conditions

| Line | Corr. ID | | | | | | | | | |
|---|---|---|---|---|---|---|---|---|---|---|
| | 1 | 2 | 3 | 4 | 5 | 6 | 7 | 8 | 9 | 10 |
| Line-1 | 28.96 | 657.50 | 85.06 | 245.83 | 135.17 | 19.69 | 5.58 | 278.19 | 0.92 | 0.75 |
| Line-2 | 25.08 | 491.67 | 85.84 | 208.33 | 122.33 | 19.05 | 5.15 | 217.50 | 0.92 | 0.71 |
| Line-3 | 28.05 | 641.11 | 90.51 | 262.22 | 131.97 | 20.52 | 5.67 | 288.28 | 0.93 | 0.75 |
| Line-4 | 25.73 | 580.56 | 95.95 | 263.89 | 114.00 | 21.34 | 5.53 | 247.88 | 0.92 | 0.77 |
| Line-5 | 28.72 | 655.56 | 91.62 | 272.22 | 135.28 | 20.92 | 5.73 | 280.11 | 0.91 | 0.81 |
| Line-6 | 25.78 | 569.44 | 72.41 | 177.78 | 94.28 | 18.23 | 5.23 | 175.84 | 0.95 | 0.71 |
| Line-7 | 26.43 | 511.11 | 74.03 | 188.89 | 120.94 | 19.02 | 5.22 | 192.47 | 0.87 | 0.71 |
| Line-8 | 25.19 | 544.44 | 76.53 | 197.22 | 107.72 | 18.57 | 5.33 | 204.70 | 0.94 | 0.75 |
| Line-9 | | | | | | | | | | |
| Line-10 | 26.67 | 574.17 | 55.20 | 141.11 | 60.44 | 16.69 | 4.12 | 142.72 | 0.80 | 0.50 |
| Line-11 | | 522.22 | 95.36 | 261.11 | 112.50 | 21.70 | 5.58 | 264.24 | 0.96 | 0.76 |
| Line-12 | | | | | | | | | | |

Table 51. Provided are the values of each of the parameters (as described above) measured in maize accessions (Seed ID) under regular growth conditions. Growth conditions are specified in the experimental procedure section.

TABLE 52

Additional measured parameters in Maize accessions under regular growth conditions

| Line | Corr. ID | | | | | | | | | | |
|---|---|---|---|---|---|---|---|---|---|---|---|
| | 11 | 12 | 13 | 14 | 15 | 16 | 17 | 18 | 19 | 20 | 21 |
| Line-1 | 1.17 | 0.81 | 0.28 | 16.17 | 12.00 | 153.90 | 140.68 | 80.62 | 278.08 | 51.67 | 54.28 |
| Line-2 | 1.09 | 0.81 | 0.22 | 14.67 | 11.11 | 135.88 | 139.54 | 86.76 | 260.50 | 56.41 | 57.18 |
| Line-3 | 1.18 | 0.80 | 0.28 | 16.20 | 11.69 | 152.50 | 153.67 | 82.14 | 275.13 | 53.55 | 56.01 |
| Line-4 | 1.20 | 0.80 | 0.27 | 15.89 | 11.78 | 159.16 | 176.98 | 92.71 | 238.50 | 55.21 | 59.68 |
| Line-5 | 1.23 | 0.82 | 0.31 | 16.17 | 11.94 | 140.46 | 156.61 | 80.38 | 286.94 | 55.30 | 54.77 |
| Line-6 | 1.12 | 0.80 | 0.24 | 15.17 | 12.33 | 117.14 | 119.67 | 82.76 | 224.83 | 59.35 | 59.14 |
| Line-7 | 1.14 | 0.79 | 0.24 | 16.00 | 12.44 | 123.24 | 119.69 | 73.25 | 264.44 | 58.48 | 57.99 |
| Line-8 | 1.13 | 0.84 | 0.27 | 14.83 | 12.22 | 131.27 | 133.51 | 81.06 | 251.61 | 55.88 | 60.36 |
| Line-9 | | | | | | | | | | 52.98 | 54.77 |
| Line-10 | 0.92 | 0.67 | 0.19 | 14.27 | 9.28 | 40.84 | 54.32 | 81.06 | 163.78 | 53.86 | 51.39 |
| Line-11 | 1.18 | 0.81 | 0.30 | 15.39 | 12.56 | 170.66 | 173.23 | 91.60 | 278.44 | 59.75 | 61.14 |
| Line-12 | | | | | | | | | | 49.99 | 53.34 |

Table 52. Provided are the values of each of the parameters (as described above) measured in maize accessions (Seed ID) under regular growth conditions. Growth conditions are specified in the experimental procedure section.

TABLE 53

Correlation between the expression level of selected LAB genes of some embodiments of the invention in various tissues and the phenotypic performance under normal across maize accessions

| Gene Name | R | P value | Exp. set | Corr. Set ID | Gene Name | R | P value | Exp. set | Corr. Set ID |
|---|---|---|---|---|---|---|---|---|---|
| LAB673 | 0.70 | 5.26E−02 | 5 | 12 | LAB673 | 0.82 | 2.38E−02 | 4 | 14 |
| LAB673 | 0.70 | 7.71E−02 | 4 | 11 | LAB673 | 0.75 | 4.98E−02 | 4 | 19 |
| LAB673 | 0.78 | 3.69E−02 | 4 | 5 | LAB673 | 0.79 | 3.65E−02 | 4 | 7 |
| LAB673 | 0.80 | 3.14E−02 | 4 | 8 | LAB673 | 0.80 | 3.04E−02 | 7 | 6 |
| LAB673 | 0.79 | 3.34E−02 | 7 | 18 | LAB673 | 0.73 | 6.14E−02 | 7 | 4 |
| LAB673 | 0.84 | 1.92E−02 | 1 | 15 | LAB673 | 0.75 | 5.18E−02 | 1 | 13 |
| LAB673 | 0.75 | 5.11E−02 | 1 | 11 | LAB673 | 0.80 | 2.90E−02 | 1 | 9 |
| LAB673 | 0.82 | 2.37E−02 | 1 | 10 | LAB673 | 0.72 | 6.77E−02 | 1 | 19 |
| LAB673 | 0.80 | 3.21E−02 | 1 | 7 | LAB673 | 0.84 | 1.91E−02 | 1 | 12 |
| LAB675 | 0.72 | 1.05E−01 | 4 | 1 | LAB675 | 0.80 | 2.92E−02 | 4 | 2 |
| LAB675 | 0.77 | 4.47E−02 | 1 | 15 | LAB675 | 0.78 | 3.93E−02 | 1 | 9 |
| LAB675 | 0.81 | 2.89E−02 | 1 | 12 | LAB675 | 0.76 | 2.91E−02 | 8 | 1 |
| LAB675 | 0.73 | 4.11E−02 | 8 | 14 | LAB675 | 0.96 | 1.59E−04 | 8 | 13 |
| LAB675 | 0.89 | 2.96E−03 | 8 | 11 | LAB675 | 0.90 | 2.31E−03 | 8 | 10 |
| LAB675 | 0.87 | 5.48E−03 | 8 | 2 | LAB675 | 0.91 | 1.68E−03 | 8 | 7 |
| LAB675 | 0.77 | 2.50E−02 | 8 | 8 | LAB675 | 0.78 | 2.12E−02 | 8 | 4 |
| LAB675 | 0.78 | 6.71E−02 | 2 | 14 | LAB678 | 0.80 | 1.68E−02 | 5 | 9 |
| LAB678 | 0.81 | 2.63E−02 | 4 | 14 | LAB678 | 0.82 | 2.54E−02 | 4 | 2 |
| LAB678 | 0.76 | 4.68E−02 | 7 | 3 | LAB678 | 0.72 | 6.79E−02 | 7 | 14 |
| LAB678 | 0.78 | 3.78E−02 | 7 | 6 | LAB678 | 0.83 | 2.18E−02 | 7 | 8 |
| LAB678 | 0.83 | 2.14E−02 | 7 | 4 | LAB678 | 0.75 | 5.26E−02 | 1 | 16 |
| LAB678 | 0.87 | 1.05E−02 | 1 | 15 | LAB678 | 0.79 | 3.27E−02 | 1 | 11 |
| LAB678 | 0.93 | 2.02E−03 | 1 | 9 | LAB678 | 0.88 | 9.20E−03 | 1 | 10 |
| LAB678 | 0.84 | 1.80E−02 | 1 | 19 | LAB678 | 0.82 | 2.38E−02 | 1 | 5 |
| LAB678 | 0.83 | 2.18E−02 | 1 | 7 | LAB678 | 0.94 | 1.53E−03 | 1 | 12 |
| LAB678 | 0.71 | 4.82E−02 | 8 | 1 | LAB678 | 0.70 | 5.30E−02 | 8 | 14 |
| LAB678 | 0.80 | 1.63E−02 | 8 | 13 | LAB678 | 0.71 | 4.73E−02 | 8 | 11 |
| LAB678 | 0.72 | 4.41E−02 | 8 | 10 | LAB678 | 0.76 | 2.91E−02 | 8 | 2 |
| LAB678 | 0.71 | 4.95E−02 | 8 | 7 | LAB678 | 0.86 | 2.90E−02 | 2 | 14 |
| LAB679 | 0.83 | 9.95E−03 | 5 | 15 | LAB679 | 0.78 | 2.32E−02 | 5 | 9 |
| LAB679 | 0.98 | 6.33E−04 | 2 | 9 | LAB679 | 0.90 | 1.55E−02 | 2 | 18 |
| LAB680 | 0.70 | 5.19E−02 | 5 | 9 | LAB680 | 0.71 | 4.72E−02 | 8 | 19 |
| LAB681 | 0.93 | 6.78E−04 | 5 | 12 | LAB681 | 0.73 | 6.51E−02 | 4 | 3 |
| LAB681 | 0.71 | 7.63E−02 | 4 | 16 | LAB681 | 0.76 | 4.88E−02 | 4 | 18 |
| LAB681 | 0.75 | 5.23E−02 | 4 | 17 | LAB681 | 0.91 | 4.93E−03 | 7 | 18 |
| LAB681 | 0.78 | 2.36E−02 | 8 | 1 | LAB681 | 0.87 | 5.40E−03 | 8 | 19 |
| LAB681 | 0.83 | 1.08E−02 | 8 | 5 | LAB683 | 0.77 | 4.10E−02 | 4 | 3 |
| LAB683 | 0.79 | 3.62E−02 | 4 | 16 | LAB683 | 0.71 | 7.38E−02 | 4 | 6 |
| LAB683 | 0.73 | 6.16E−02 | 4 | 9 | LAB683 | 0.82 | 2.36E−02 | 4 | 19 |
| LAB683 | 0.71 | 7.17E−02 | 4 | 5 | LAB683 | 0.74 | 5.81E−02 | 4 | 17 |
| LAB683 | 0.74 | 5.87E−02 | 7 | 13 | LAB683 | 0.77 | 2.50E−02 | 8 | 1 |
| LAB683 | 0.75 | 3.26E−02 | 8 | 2 | LAB683 | 0.84 | 3.81E−02 | 2 | 12 |
| LAB684 | 0.80 | 1.72E−02 | 8 | 1 | LAB684 | 0.76 | 2.73E−02 | 8 | 14 |
| LAB684 | 0.81 | 1.48E−02 | 8 | 13 | LAB684 | 0.77 | 2.40E−02 | 8 | 11 |
| LAB684 | 0.72 | 4.50E−02 | 8 | 10 | LAB684 | 0.75 | 3.32E−02 | 8 | 2 |
| LAB684 | 0.72 | 4.49E−02 | 8 | 7 | LAB685 | 0.78 | 3.70E−02 | 4 | 14 |
| LAB685 | 0.73 | 6.26E−02 | 7 | 14 | LAB685 | 0.91 | 4.64E−03 | 7 | 15 |
| LAB685 | 0.82 | 2.49E−02 | 7 | 21 | LAB685 | 0.76 | 4.96E−02 | 7 | 11 |
| LAB685 | 0.87 | 1.08E−02 | 7 | 9 | LAB685 | 0.74 | 5.47E−02 | 7 | 10 |
| LAB685 | 0.73 | 5.99E−02 | 7 | 7 | LAB685 | 0.88 | 3.57E−03 | 8 | 12 |
| LAB685 | 0.71 | 3.09E−02 | 3 | 15 | LAB685 | 0.73 | 2.47E−02 | 3 | 13 |
| LAB685 | 0.78 | 1.26E−02 | 3 | 11 | LAB685 | 0.76 | 1.70E−02 | 3 | 10 |
| LAB685 | 0.71 | 3.36E−02 | 3 | 7 | LAB685 | 0.76 | 7.86E−02 | 2 | 3 |
| LAB685 | 0.76 | 7.94E−02 | 2 | 6 | LAB685 | 0.72 | 1.07E−01 | 2 | 18 |
| LAB685 | 0.80 | 5.46E−02 | 2 | 17 | LAB686 | 0.72 | 6.98E−02 | 4 | 18 |
| LAB686 | 0.81 | 2.56E−02 | 7 | 18 | LAB687 | 0.74 | 5.60E−02 | 4 | 9 |
| LAB687 | 0.80 | 3.16E−02 | 7 | 3 | LAB687 | 0.82 | 2.44E−02 | 7 | 16 |
| LAB687 | 0.90 | 5.18E−03 | 7 | 14 | LAB687 | 0.71 | 7.21E−02 | 7 | 15 |
| LAB687 | 0.86 | 1.35E−02 | 7 | 13 | LAB687 | 0.84 | 1.71E−02 | 7 | 11 |
| LAB687 | 0.84 | 1.74E−02 | 7 | 6 | LAB687 | 0.70 | 7.95E−02 | 7 | 9 |
| LAB687 | 0.76 | 4.89E−02 | 7 | 10 | LAB687 | 0.75 | 5.07E−02 | 7 | 19 |
| LAB687 | 0.71 | 7.26E−02 | 7 | 5 | LAB687 | 0.86 | 1.21E−02 | 7 | 7 |
| LAB687 | 0.86 | 1.26E−02 | 7 | 8 | LAB687 | 0.85 | 1.45E−02 | 7 | 4 |
| LAB687 | 0.80 | 3.22E−02 | 7 | 17 | LAB687 | 0.71 | 7.42E−02 | 1 | 9 |
| LAB687 | 0.71 | 2.04E−02 | 6 | 19 | LAB687 | 0.73 | 1.68E−02 | 6 | 5 |
| LAB688 | 0.74 | 9.31E−02 | 2 | 2 | LAB689 | 0.81 | 2.69E−02 | 4 | 14 |
| LAB689 | 0.73 | 6.14E−02 | 4 | 13 | LAB689 | 0.85 | 1.47E−02 | 7 | 3 |
| LAB689 | 0.83 | 1.99E−02 | 7 | 16 | LAB689 | 0.83 | 2.09E−02 | 7 | 14 |
| LAB689 | 0.93 | 2.64E−03 | 7 | 13 | LAB689 | 0.84 | 1.75E−02 | 7 | 11 |
| LAB689 | 0.95 | 8.86E−04 | 7 | 6 | LAB689 | 0.74 | 5.88E−02 | 7 | 10 |
| LAB689 | 0.73 | 6.19E−02 | 7 | 18 | LAB689 | 0.81 | 2.74E−02 | 7 | 7 |
| LAB689 | 0.86 | 1.40E−02 | 7 | 8 | LAB689 | 0.92 | 2.92E−03 | 7 | 4 |
| LAB689 | 0.86 | 1.26E−02 | 7 | 17 | LAB689 | 0.78 | 3.88E−02 | 1 | 15 |

TABLE 53-continued

Correlation between the expression level of selected LAB genes of some embodiments of the invention in various tissues and the phenotypic performance under normal across maize accessions

| Gene Name | R | P value | Exp. set | Corr. Set ID | Gene Name | R | P value | Exp. set | Corr. Set ID |
|---|---|---|---|---|---|---|---|---|---|
| LAB689 | 0.79 | 3.50E−02 | 1 | 13 | LAB689 | 0.71 | 7.34E−02 | 1 | 11 |
| LAB689 | 0.73 | 6.44E−02 | 1 | 9 | LAB689 | 0.85 | 7.73E−03 | 8 | 1 |
| LAB689 | 0.76 | 2.85E−02 | 8 | 13 | LAB689 | 0.84 | 8.89E−03 | 8 | 19 |
| LAB689 | 0.72 | 4.34E−02 | 8 | 2 | LAB689 | 0.79 | 1.89E−02 | 8 | 5 |
| LAB689 | 0.74 | 1.41E−02 | 6 | 15 | LAB689 | 0.76 | 1.80E−02 | 3 | 15 |
| LAB689 | 0.73 | 2.65E−02 | 3 | 11 | LAB689 | 0.76 | 1.70E−02 | 3 | 10 |
| LAB689 | 0.77 | 1.60E−02 | 3 | 12 | LAB689 | 0.91 | 1.07E−02 | 2 | 15 |
| LAB690 | 0.83 | 4.19E−02 | 4 | 1 | LAB690 | 0.77 | 4.45E−02 | 4 | 2 |
| LAB691 | 0.81 | 2.86E−02 | 7 | 5 | LAB691 | 0.71 | 7.38E−02 | 1 | 5 |
| LAB692 | 0.73 | 6.08E−02 | 4 | 14 | LAB692 | 0.86 | 1.21E−02 | 4 | 2 |
| LAB692 | 0.71 | 7.48E−02 | 1 | 9 | LAB692 | 0.77 | 4.34E−02 | 1 | 12 |
| LAB692 | 0.74 | 3.65E−02 | 8 | 13 | LAB692 | 0.78 | 2.21E−02 | 8 | 11 |
| LAB692 | 0.83 | 4.06E−02 | 2 | 14 | LAB693 | 0.78 | 2.12E−02 | 5 | 14 |
| LAB693 | 0.72 | 4.54E−02 | 5 | 11 | LAB693 | 0.79 | 6.08E−03 | 6 | 18 |
| LAB693 | 0.79 | 6.32E−02 | 2 | 14 | LAB693 | 0.71 | 1.15E−01 | 2 | 5 |
| LAB694 | 0.82 | 1.17E−02 | 8 | 3 | LAB694 | 0.71 | 4.85E−02 | 8 | 6 |
| LAB694 | 0.71 | 4.91E−02 | 8 | 17 | LAB694 | 0.74 | 9.12E−02 | 2 | 18 |
| LAB695 | 0.78 | 6.89E−02 | 4 | 1 | LAB695 | 0.84 | 1.88E−02 | 1 | 18 |
| LAB695 | 0.76 | 3.00E−02 | 8 | 2 | LAB695 | 0.72 | 1.06E−01 | 2 | 3 |
| LAB695 | 0.87 | 2.47E−02 | 2 | 14 | LAB695 | 0.85 | 3.13E−02 | 2 | 11 |
| LAB695 | 0.71 | 1.15E−01 | 2 | 6 | LAB695 | 0.74 | 9.11E−02 | 2 | 19 |
| LAB695 | 0.78 | 6.51E−02 | 2 | 5 | LAB695 | 0.79 | 5.99E−02 | 2 | 7 |
| LAB695 | 0.83 | 3.88E−02 | 2 | 8 | LAB695 | 0.81 | 5.10E−02 | 2 | 4 |
| LAB696 | 0.79 | 3.52E−02 | 1 | 3 | LAB696 | 0.86 | 1.33E−02 | 1 | 16 |
| LAB696 | 0.74 | 5.61E−02 | 1 | 15 | LAB696 | 0.75 | 5.33E−02 | 1 | 11 |
| LAB696 | 0.87 | 1.09E−02 | 1 | 9 | LAB696 | 0.82 | 2.39E−02 | 1 | 10 |
| LAB696 | 0.94 | 1.63E−03 | 1 | 19 | LAB696 | 0.87 | 1.01E−02 | 1 | 5 |
| LAB696 | 0.82 | 2.45E−02 | 1 | 7 | LAB696 | 0.71 | 7.13E−02 | 1 | 8 |
| LAB696 | 0.85 | 1.63E−02 | 1 | 12 | LAB696 | 0.79 | 3.47E−02 | 1 | 17 |
| LAB696 | 0.71 | 3.19E−02 | 3 | 16 | LAB696 | 0.83 | 5.84E−03 | 3 | 15 |
| LAB696 | 0.83 | 6.09E−03 | 3 | 11 | LAB696 | 0.70 | 3.43E−02 | 3 | 6 |
| LAB696 | 0.79 | 1.06E−02 | 3 | 10 | LAB696 | 0.78 | 1.24E−02 | 3 | 19 |
| LAB696 | 0.75 | 2.03E−02 | 3 | 7 | LAB696 | 0.71 | 3.28E−02 | 3 | 12 |
| LAB696 | 0.72 | 2.76E−02 | 3 | 17 | LAB696 | 0.72 | 1.04E−01 | 2 | 9 |
| LAB697 | 0.80 | 1.69E−02 | 5 | 11 | LAB697 | 0.73 | 3.88E−02 | 5 | 6 |
| LAB697 | 0.75 | 3.27E−02 | 5 | 17 | LAB697 | 0.78 | 6.69E−02 | 4 | 1 |
| LAB697 | 0.73 | 6.11E−02 | 4 | 19 | LAB697 | 0.72 | 6.59E−02 | 4 | 5 |
| LAB697 | 0.82 | 2.44E−02 | 4 | 8 | LAB697 | 0.91 | 1.22E−02 | 1 | 1 |
| LAB697 | 0.79 | 3.64E−02 | 1 | 8 | LAB697 | 0.75 | 3.05E−02 | 8 | 1 |
| LAB698 | 0.76 | 4.53E−02 | 4 | 14 | LAB698 | 0.79 | 3.42E−02 | 4 | 15 |
| LAB698 | 0.79 | 3.28E−02 | 4 | 11 | LAB698 | 0.84 | 1.83E−02 | 4 | 9 |
| LAB698 | 0.82 | 2.44E−02 | 4 | 10 | LAB698 | 0.75 | 5.46E−02 | 4 | 19 |
| LAB698 | 0.83 | 2.17E−02 | 4 | 5 | LAB698 | 0.82 | 2.30E−02 | 4 | 7 |
| LAB698 | 0.70 | 7.92E−02 | 4 | 8 | LAB698 | 0.81 | 2.72E−02 | 4 | 12 |
| LAB698 | 0.81 | 2.74E−02 | 7 | 5 | LAB698 | 0.77 | 7.48E−02 | 1 | 1 |
| LAB698 | 0.78 | 3.71E−02 | 1 | 2 | LAB698 | 0.80 | 1.77E−02 | 8 | 1 |
| LAB698 | 0.91 | 1.53E−03 | 8 | 2 | LAB698 | 0.82 | 1.30E−02 | 8 | 7 |
| LAB698 | 0.84 | 8.86E−03 | 8 | 8 | LAB698 | 0.74 | 3.43E−02 | 8 | 4 |
| LAB698 | 0.85 | 3.18E−02 | 2 | 12 | LAB702 | 0.77 | 2.48E−02 | 5 | 9 |
| LAB702 | 0.71 | 1.12E−01 | 7 | 1 | LAB702 | 0.82 | 4.67E−02 | 1 | 1 |
| LAB702 | 0.75 | 5.44E−02 | 1 | 2 | LAB702 | 0.79 | 2.02E−02 | 8 | 1 |
| LAB703 | 0.79 | 3.42E−02 | 4 | 3 | LAB703 | 0.79 | 3.31E−02 | 4 | 16 |
| LAB703 | 0.70 | 7.83E−02 | 4 | 13 | LAB703 | 0.82 | 2.26E−02 | 4 | 6 |
| LAB703 | 0.74 | 5.91E−02 | 4 | 9 | LAB703 | 0.73 | 6.26E−02 | 4 | 10 |
| LAB703 | 0.78 | 3.97E−02 | 4 | 18 | LAB703 | 0.83 | 2.11E−02 | 4 | 19 |
| LAB703 | 0.87 | 1.09E−02 | 4 | 5 | LAB703 | 0.74 | 5.85E−02 | 4 | 7 |
| LAB703 | 0.74 | 5.91E−02 | 4 | 12 | LAB703 | 0.78 | 3.81E−02 | 4 | 4 |
| LAB703 | 0.76 | 4.97E−02 | 4 | 17 | LAB703 | 0.74 | 5.77E−02 | 7 | 3 |
| LAB703 | 0.71 | 7.54E−02 | 7 | 16 | LAB703 | 0.77 | 4.27E−02 | 7 | 13 |
| LAB703 | 0.86 | 1.35E−02 | 7 | 6 | LAB703 | 0.79 | 3.57E−02 | 7 | 18 |
| LAB703 | 0.75 | 5.08E−02 | 7 | 4 | LAB703 | 0.72 | 6.71E−02 | 7 | 17 |
| LAB703 | 0.73 | 3.94E−02 | 8 | 1 | LAB703 | 0.86 | 5.62E−03 | 8 | 16 |
| LAB703 | 0.77 | 2.67E−02 | 8 | 14 | LAB703 | 0.71 | 4.89E−02 | 8 | 6 |
| LAB703 | 0.76 | 2.78E−02 | 8 | 2 | LAB703 | 0.77 | 2.63E−02 | 8 | 7 |
| LAB703 | 0.80 | 1.71E−02 | 8 | 8 | LAB703 | 0.78 | 2.34E−02 | 8 | 4 |
| LAB703 | 0.83 | 4.09E−02 | 2 | 9 | LAB703 | 0.79 | 6.01E−02 | 2 | 18 |
| LAB703 | 0.94 | 5.91E−03 | 2 | 12 | LAB704 | 0.72 | 6.72E−02 | 4 | 16 |
| LAB704 | 0.77 | 4.09E−02 | 4 | 9 | LAB704 | 0.75 | 5.30E−02 | 4 | 10 |
| LAB704 | 0.85 | 1.53E−02 | 4 | 12 | LAB704 | 0.71 | 7.50E−02 | 4 | 17 |
| LAB704 | 0.72 | 6.69E−02 | 7 | 11 | LAB704 | 0.71 | 7.42E−02 | 7 | 10 |
| LAB704 | 0.84 | 1.78E−02 | 1 | 3 | LAB704 | 0.87 | 1.15E−02 | 1 | 16 |
| LAB704 | 0.77 | 4.24E−02 | 1 | 14 | LAB704 | 0.71 | 7.25E−02 | 1 | 15 |
| LAB704 | 0.71 | 7.49E−02 | 1 | 13 | LAB704 | 0.83 | 2.04E−02 | 1 | 11 |

TABLE 53-continued

Correlation between the expression level of selected LAB genes of some embodiments of the invention in various tissues and the phenotypic performance under normal across maize accessions

| Gene Name | R | P value | Exp. set | Corr. Set ID | Gene Name | R | P value | Exp. set | Corr. Set ID |
|---|---|---|---|---|---|---|---|---|---|
| LAB704 | 0.77 | 4.08E−02 | 1 | 6 | LAB704 | 0.80 | 3.09E−02 | 1 | 9 |
| LAB704 | 0.81 | 2.67E−02 | 1 | 10 | LAB704 | 0.87 | 1.09E−02 | 1 | 19 |
| LAB704 | 0.87 | 1.08E−02 | 1 | 5 | LAB704 | 0.88 | 8.76E−03 | 1 | 7 |
| LAB704 | 0.84 | 1.75E−02 | 1 | 8 | LAB704 | 0.71 | 7.11E−02 | 1 | 12 |
| LAB704 | 0.80 | 2.96E−02 | 1 | 4 | LAB704 | 0.82 | 2.29E−02 | 1 | 17 |
| LAB704 | 0.87 | 2.35E−02 | 2 | 15 | LAB705 | 0.88 | 4.25E−03 | 8 | 19 |
| LAB705 | 0.82 | 1.36E−02 | 8 | 5 | LAB705 | 0.74 | 9.55E−02 | 2 | 9 |
| LAB705 | 0.79 | 6.12E−02 | 2 | 18 | LAB706 | 0.79 | 1.87E−02 | 8 | 1 |
| LAB706 | 0.75 | 3.10E−02 | 8 | 13 | LAB706 | 0.71 | 4.99E−02 | 8 | 11 |
| LAB706 | 0.88 | 4.05E−03 | 8 | 2 | LAB706 | 0.75 | 3.05E−02 | 8 | 7 |
| LAB707 | 0.96 | 1.90E−03 | 2 | 14 | LAB707 | 0.87 | 2.36E−02 | 2 | 5 |
| LAB708 | 0.74 | 3.65E−02 | 5 | 3 | LAB708 | 0.78 | 2.27E−02 | 5 | 18 |
| LAB708 | 0.71 | 7.26E−02 | 4 | 16 | LAB708 | 0.78 | 4.06E−02 | 4 | 14 |
| LAB708 | 0.73 | 6.42E−02 | 4 | 15 | LAB708 | 0.75 | 5.39E−02 | 4 | 11 |
| LAB708 | 0.87 | 1.18E−02 | 4 | 9 | LAB708 | 0.77 | 4.46E−02 | 4 | 10 |
| LAB708 | 0.83 | 2.07E−02 | 4 | 19 | LAB708 | 0.81 | 2.66E−02 | 4 | 5 |
| LAB708 | 0.75 | 5.28E−02 | 4 | 7 | LAB708 | 0.85 | 1.50E−02 | 4 | 12 |
| LAB708 | 0.76 | 7.82E−02 | 2 | 12 | LAB709 | 0.75 | 3.15E−02 | 8 | 15 |
| LAB710 | 0.95 | 3.94E−03 | 4 | 1 | LAB710 | 0.72 | 6.60E−02 | 4 | 14 |
| LAB710 | 0.79 | 3.59E−02 | 7 | 14 | LAB710 | 0.81 | 2.88E−02 | 7 | 13 |
| LAB710 | 0.82 | 2.31E−02 | 7 | 6 | LAB710 | 0.77 | 4.40E−02 | 7 | 4 |
| LAB710 | 0.76 | 1.01E−02 | 6 | 20 | LAB711 | 0.83 | 2.15E−02 | 1 | 3 |
| LAB711 | 0.89 | 7.80E−03 | 1 | 16 | LAB711 | 0.89 | 7.10E−03 | 1 | 14 |
| LAB711 | 0.78 | 3.75E−02 | 1 | 15 | LAB711 | 0.84 | 1.90E−02 | 1 | 13 |
| LAB711 | 0.93 | 2.75E−03 | 1 | 11 | LAB711 | 0.78 | 3.86E−02 | 1 | 6 |
| LAB711 | 0.81 | 2.79E−02 | 1 | 9 | LAB711 | 0.90 | 5.67E−03 | 1 | 10 |
| LAB711 | 0.87 | 1.17E−02 | 1 | 19 | LAB711 | 0.89 | 7.09E−03 | 1 | 5 |
| LAB711 | 0.96 | 5.30E−04 | 1 | 7 | LAB711 | 0.88 | 8.72E−03 | 1 | 8 |
| LAB711 | 0.78 | 3.83E−02 | 1 | 12 | LAB711 | 0.85 | 1.63E−02 | 1 | 4 |
| LAB711 | 0.85 | 1.51E−02 | 1 | 17 | LAB711 | 0.82 | 1.22E−02 | 8 | 1 |
| LAB711 | 0.71 | 5.07E−02 | 8 | 13 | LAB711 | 0.76 | 3.03E−02 | 8 | 2 |
| LAB712 | 0.83 | 1.17E−02 | 5 | 9 | LAB712 | 0.78 | 6.81E−02 | 7 | 1 |
| LAB712 | 0.73 | 1.03E−01 | 2 | 7 | LAB713 | 0.85 | 3.12E−02 | 1 | 1 |
| LAB714 | 0.84 | 9.02E−03 | 8 | 1 | LAB714 | 0.74 | 3.69E−02 | 8 | 19 |
| LAB714 | 0.96 | 2.07E−03 | 2 | 12 | | | | | |

Table 53. Correlations (R) between the genes expression levels in various tissues and the phenotypic performance under normal conditions.
"Corr. ID"—correlation set ID according to the correlated parameters Table above.
"Exp. Set"—Expression set.
"R" = Pearson correlation coefficient;
"P" = p value.

Example 8

Production of Maize Transcriptom and High Throughput Correlation Analysis with Yield, NUE, and ABST Related Parameters Measured in Semi-Hydroponics Conditions Using 60K Maize Oligonucleotide Micro-Arrays Maize vigor related parameters under low nitrogen (1.6 mM), salinity (100 mM NaCl), low temperature (10±2° C.) and normal growth conditions—Twelve Maize hybrids were grown in 5 repetitive plots, each containing 7 plants, at a net house under semi-hydroponics conditions. Briefly, the growing protocol was as follows: Maize seeds were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution, i.e., to a final concentration of 10% from full Hoagland solution, final amount of 1.6 mM N) or at Normal growth solution (Full Hoagland containing 16 mM N solution, at 28±2° C.). Plants were grown at 28±2° C. unless otherwise indicated.

Full Hoagland solution consists of: $KNO_3$—0.808 grams/liter, $MgSO_4$—0.12 grams/liter, $KH_2PO_4$—0.136 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8.

Experimental Procedures

Analyzed Maize tissues—Twelve selected Maize hybrids were sampled per each treatment. Two tissues [leaves and root tip] representing different plant characteristics were sampled. Plants were sampled from all 4 treatments applied: salinity (100 mM NaCl), low temperature (10±2° C.), low Nitrogen (1.6 mM N) and Normal conditions. Sampling was done at the vegetative stage (V4-5) and RNA was extracted as described above. Each micro-array expression information tissue type has received a Set ID as summarized in Table 54-57 below.

TABLE 54

Maize transcriptom expression sets under normal conditions at semi hydroponics system

| Expression set | Set ID |
|---|---|
| maize/leaf: Normal | 1 |
| maize/root tip: Normal | 2 |

Table 54: Provided are the Maize transcriptom expression sets at normal conditions.

TABLE 55

Maize transcriptom expression sets under cold conditions at semi hydroponics system

| Expression set | Set ID |
|---|---|
| maize/leaf: Cold | 1 |
| maize/root tip: Cold | 2 |

Table 55: Provided are the Maize transcriptom expression sets at cold conditions.

TABLE 56

Maize transcriptom expression sets under low nitrogen conditions at semi hydroponics system

| Expression set | Set ID |
|---|---|
| maize/leaf: 1.6 mM N | 1 |
| maize/root tip: 1.6 mM N | 2 |

Table 56: Provided are the Maize transcriptom expression sets at low nitrogen conditions 1.6 Mm Nitrogen.

TABLE 57

Maize transcriptom expression sets under high salinity conditions at semi hydroponics system

| Expression set | Set ID |
|---|---|
| maize/leaf: NaCl 100 mM | 1 |
| maize/root tip: NaCl 100 mM | 2 |

Table 57: Provided are the Maize transcriptom expression sets at 100 mM NaCl.

Phenotypic Parameters Assessment

Ten different Maize hybrids were grown and characterized at the vegetative stage (V4-5) for the following parameters:

Leaves dry weight (DW)=leaves dry weight per plant (average of five plants); "Plant Height growth"=was calculated as regression coefficient of plant height [cm] along time course (average of five plants);

Root dry weight (DW)—root dry weight per plant, all vegetative tissue above ground (average of four plants);

Shoot dry weight (DW)—shoot dry weight per plant, all vegetative tissue above ground (average of four plants) after drying at 70° C. in oven for 48 hours;

Shoot fresh weight (FW)—shoot fresh weight per plant, all vegetative tissue above ground (average of four plants);

SPAD [SPAD unit]—Chlorophyll content was determined using a Minolta SPAD 502 chlorophyll meter and measurement was performed 30 days post sowing. SPAD meter readings were done on young fully developed leaf. Three measurements per leaf were taken per plot.

Plant height growth—the relative growth rate (RGR) of Plant Height was calculated using Formula IX:

Relative growth rate of Plant height=Regression coefficient of Plant height along time course (measured in cm/day).     Formula IX:

Root length—the length of the root was measured at V4 developmental stage.

Data parameters collected are summarized in Tables 58-59, herein below

TABLE 58

Maize correlated parameters (vectors) under cold conditions

| Correlated parameter with | Correlation ID |
|---|---|
| Leaves DW | 1 |
| Plant height growth | 2 |
| Root DW | 3 |
| SPAD (SPAD unit) | 4 |
| Shoot DW | 5 |
| Shoot FW | 6 |

Table 58: Provided are the Maize correlated parameters under cold conditions.
"DW" = dry weight;
"FW" = fresh weight;
"SPAD" = chlorophyll levels.

TABLE 59

Maize correlated parameters (vectors) under normal, low nitrogen and salinity growth conditions

| Correlated parameter with | Correlation ID |
|---|---|
| Leaves DW | 1 |
| Plant height growth | 2 |
| Root DW | 3 |
| Root length | 4 |
| SPAD (SPAD unit) | 5 |
| Shoot DW | 6 |
| Shoot FW | 7 |

Table 59: Provided are the Maize correlated parameters under normal, low nitrogen and salinity growth conditions.
"DW" = dry weight;
"FW" = fresh weight;
"SPAD" = chlorophyll levels.

Experimental Results

Twelve different maize accessions were grown and characterized for different parameters as described above. Tables 58-59 describes the maize correlated parameters. The average for each of the measured parameter was calculated using the JMP software and values are summarized in Tables 60-63 below. Subsequent correlation analysis between the various transcriptom sets and the average parameters (Tables 64-67) was conducted. Follow, results were integrated to the database.

TABLE 60

Maize accessions, measured parameters under low nitrogen growth conditions

| | Correlation ID | | | | | | |
|---|---|---|---|---|---|---|---|
| Line | 1 | 2 | 3 | 4 | 5 | 6 | 7 |
| Line-1 | 0.57 | 0.75 | 0.38 | 44.50 | 21.43 | 2.56 | 23.27 |
| Line-2 | 0.45 | 0.81 | 0.35 | 45.63 | 21.24 | 1.96 | 20.58 |
| Line-3 | 0.46 | 0.88 | 0.25 | 44.25 | 22.23 | 2.01 | 19.26 |
| Line-4 | 0.48 | 0.69 | 0.36 | 43.59 | 24.56 | 1.94 | 20.02 |
| Line-5 | 0.36 | 0.83 | 0.31 | 40.67 | 22.75 | 1.94 | 17.98 |
| Line-6 | 0.51 | 0.84 | 0.30 | 42.03 | 26.47 | 2.52 | 22.06 |
| Line-7 | 0.53 | 0.78 | 0.29 | 42.65 | 22.08 | 2.03 | 21.28 |
| Line-8 | 0.58 | 0.92 | 0.31 | 45.06 | 25.09 | 2.37 | 22.13 |
| Line-9 | 0.55 | 0.89 | 0.29 | 45.31 | 23.73 | 2.09 | 20.29 |
| Line-10 | 0.51 | 0.85 | 0.32 | 42.17 | 25.68 | 2.17 | 19.94 |
| Line-11 | 0.56 | 0.80 | 0.43 | 41.03 | 25.02 | 2.62 | 22.50 |
| Line-12 | 0.39 | 0.64 | 0.17 | 37.65 | 19.51 | 1.53 | 15.93 |

TABLE 60-continued

Maize accessions, measured parameters under low nitrogen growth conditions

| | Correlation ID | | | | | | |
|---|---|---|---|---|---|---|---|
| Line | 1 | 2 | 3 | 4 | 5 | 6 | 7 |

Table 60: Provided are the values of each of the parameters (as described above) measured in Maize accessions (Line) under low nitrogen conditions. Growth conditions are specified in the experimental procedure section.

TABLE 61

Maize accessions, measured parameters under 100 mM NaCl growth conditions

| | Correlation ID | | | | | | |
|---|---|---|---|---|---|---|---|
| Line | 1 | 2 | 3 | 4 | 5 | 6 | 7 |
| Line-1 | 0.41 | 0.46 | 0.05 | 10.88 | 36.55 | 2.43 | 19.58 |
| Line-2 | 0.50 | 0.40 | 0.05 | 11.28 | 39.92 | 2.19 | 20.78 |
| Line-3 | 0.43 | 0.45 | 0.03 | 11.82 | 37.82 | 2.25 | 18.45 |
| Line-4 | 0.48 | 0.32 | 0.07 | 10.08 | 41.33 | 2.26 | 19.35 |
| Line-5 | 0.43 | 0.32 | 0.05 | 8.46 | 40.82 | 1.54 | 15.65 |
| Line-6 | 0.56 | 0.31 | 0.03 | 10.56 | 44.40 | 1.94 | 16.09 |
| Line-7 | 0.33 | 0.29 | 0.10 | 10.14 | 37.92 | 1.78 | 12.46 |
| Line-8 | 0.51 | 0.36 | 0.06 | 11.83 | 43.22 | 1.90 | 16.92 |
| Line-9 | 0.47 | 0.37 | 0.02 | 10.55 | 39.83 | 1.89 | 16.75 |
| Line-10 | 0.98 | 0.35 | 0.04 | 11.18 | 38.20 | 2.20 | 17.64 |
| Line-11 | 0.48 | 0.31 | 0.05 | 10.09 | 38.14 | 1.86 | 15.90 |
| Line-12 | 0.15 | 0.27 | 0.01 | 8.90 | 37.84 | 0.97 | 9.40 |

Table 61: Provided are the values of each of the parameters (as described above) measured in Maize accessions (Line) under 100 mM NaCl growth conditions. Growth conditions are specified in the experimental procedure section.

TABLE 62

Maize accessions, measured parameters under cold growth conditions

| | Correlation ID | | | | | |
|---|---|---|---|---|---|---|
| Line | 1 | 2 | 3 | 4 | 5 | 6 |
| Line-1 | 1.19 | 2.15 | 0.05 | 28.88 | 5.74 | 73.79 |
| Line-2 | 1.17 | 1.93 | 0.07 | 29.11 | 4.86 | 55.46 |
| Line-3 | 1.02 | 2.12 | 0.10 | 27.08 | 3.98 | 53.26 |
| Line-4 | 1.18 | 1.80 | 0.08 | 32.38 | 4.22 | 54.92 |
| Line-5 | 1.04 | 2.32 | 0.07 | 32.68 | 4.63 | 58.95 |
| Line-6 | 1.23 | 2.15 | 0.07 | 32.89 | 4.93 | 62.36 |
| Line-7 | 1.13 | 2.49 | 0.14 | 31.58 | 4.82 | 63.65 |
| Line-8 | 0.98 | 2.01 | 0.07 | 33.01 | 4.03 | 54.90 |
| Line-9 | 0.88 | 1.95 | 0.07 | 28.65 | 3.57 | 48.25 |
| Line-10 | 1.28 | 2.03 | 0.02 | 31.43 | 3.99 | 52.83 |
| Line-11 | 1.10 | 1.85 | 0.05 | 30.64 | 4.64 | 55.08 |
| Line-12 | 0.60 | 1.21 | 0.06 | 30.71 | 1.89 | 29.61 |

Table 62: Provided are the values of each of the parameters (as described above) measured in Maize accessions (Line) under cold growth conditions. Growth conditions are specified in the experimental procedure section.

TABLE 63

Maize accessions, measured parameters under regular growth conditions

| | Correlation ID | | | | | | |
|---|---|---|---|---|---|---|---|
| Line | 1 | 2 | 3 | 4 | 5 | 6 | 7 |
| Line-1 | 1.16 | 1.99 | 0.14 | 20.15 | 34.50 | 5.27 | 79.00 |
| Line-2 | 1.10 | 1.92 | 0.11 | 15.89 | 35.77 | 4.67 | 62.85 |
| Line-3 | 0.92 | 1.93 | 0.23 | 18.59 | 34.70 | 3.88 | 59.73 |
| Line-4 | 1.01 | 1.93 | 0.16 | 18.72 | 34.42 | 5.08 | 63.92 |
| Line-5 | 0.93 | 2.15 | 0.08 | 16.38 | 35.26 | 4.10 | 60.06 |
| Line-6 | 0.91 | 1.95 | 0.05 | 14.93 | 37.52 | 4.46 | 64.67 |
| Line-7 | 1.11 | 2.23 | 0.17 | 17.48 | 36.50 | 4.68 | 68.10 |
| Line-8 | 1.01 | 1.94 | 0.10 | 15.74 | 36.07 | 4.59 | 65.81 |
| Line-9 | 1.01 | 1.97 | 0.07 | 15.71 | 33.74 | 4.08 | 58.31 |
| Line-10 | 1.02 | 2.05 | 0.10 | 17.58 | 34.34 | 4.61 | 61.87 |
| Line-11 | 1.23 | 1.74 | 0.14 | 16.13 | 35.74 | 5.42 | 70.04 |
| Line-12 | 0.44 | 1.26 | 0.03 | 17.43 | 29.04 | 2.02 | 35.96 |

Table 63: Provided are the values of each of the parameters (as described above) measured in Maize accessions (Line) under regular growth conditions. Growth conditions are specified in the experimental procedure section.

TABLE 64

Correlation between the expression level of selected genes of some embodiments of the invention in various tissues and the phenotypic performance under normal conditions across Maize accessions

| Gene Name | R | P value | Exp. set | Corr. Set ID | Gene Name | R | P value | Exp. set | Corr. Set ID |
|---|---|---|---|---|---|---|---|---|---|
| LAB686 | 0.71 | 2.03E−02 | 1 | 1 | LAB686 | 0.78 | 7.90E−03 | 1 | 6 |
| LAB689 | 0.74 | 2.41E−02 | 2 | 7 | LAB689 | 0.71 | 3.05E−02 | 2 | 1 |
| LAB689 | 0.72 | 2.84E−02 | 2 | 3 | LAB689 | 0.78 | 1.34E−02 | 2 | 6 |
| LAB700 | 0.71 | 3.36E−02 | 2 | 1 | LAB700 | 0.72 | 2.77E−02 | 2 | 6 |
| LAB701 | 0.81 | 4.52E−03 | 1 | 4 | | | | | |

Table 64. Correlations (R) between the genes expression levels in various tissues and the phenotypic performance.

"Corr. ID"—correlation set ID according to the correlated parameters Table above.

"Exp. Set"—Expression set.

"R" = Pearson correlation coefficient;

"P" = p value.

TABLE 65

Correlation between the expression level of selected genes of some embodiments of the invention in various tissues and the phenotypic performance under low nitrogen conditions across Maize accessions

| Gene Name | R | P value | Exp. set | Corr. Set ID | Gene Name | R | P value | Exp. set | Corr. Set ID |
|---|---|---|---|---|---|---|---|---|---|
| LAB682 | 0.74 | 1.47E−02 | 1 | 1 | LAB683 | 0.78 | 7.75E−03 | 1 | 1 |
| LAB683 | 0.74 | 1.43E−02 | 1 | 6 | LAB686 | 0.79 | 6.17E−03 | 1 | 3 |
| LAB687 | 0.76 | 1.77E−02 | 2 | 5 | LAB687 | 0.79 | 1.18E−02 | 2 | 3 |
| LAB688 | 0.72 | 2.96E−02 | 2 | 1 | LAB688 | 0.76 | 1.04E−02 | 1 | 6 |
| LAB689 | 0.93 | 3.13E−04 | 2 | 5 | LAB690 | 0.70 | 3.43E−02 | 2 | 5 |
| LAB697 | 0.84 | 5.01E−03 | 2 | 5 | LAB710 | 0.71 | 3.16E−02 | 2 | 4 |

Table 65. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 66

Correlation between the expression level of selected genes of some embodiments of the invention in various tissues and the phenotypic performance under cold conditions across Maize accessions

| Gene Name | R | P value | Exp. set | Corr. Set ID | Gene Name | R | P value | Exp. set | Corr. Set ID |
|---|---|---|---|---|---|---|---|---|---|
| LAB681 | 0.83 | 5.54E−03 | 2 | 4 | LAB683 | 0.80 | 1.79E−02 | 1 | 3 |
| LAB686 | 0.78 | 2.34E−02 | 1 | 6 | LAB686 | 0.75 | 3.23E−02 | 1 | 2 |
| LAB686 | 0.75 | 3.08E−02 | 1 | 1 | LAB686 | 0.77 | 2.56E−02 | 1 | 5 |
| LAB687 | 0.81 | 1.48E−02 | 1 | 3 | LAB687 | 0.79 | 1.10E−02 | 2 | 1 |
| LAB691 | 0.73 | 2.47E−02 | 2 | 4 | LAB700 | 0.72 | 2.99E−02 | 2 | 5 |
| LAB706 | 0.71 | 3.10E−02 | 2 | 6 | LAB713 | 0.78 | 2.33E−02 | 1 | 3 |

Table 66. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 67

Correlation between the expression level of selected genes of some embodiments of the invention in various tissues and the phenotypic performance under salinity conditions across Maize accessions

| Gene Name | R | P value | Exp. set | Corr. Set ID | Gene Name | R | P value | Exp. set | Corr. Set ID |
|---|---|---|---|---|---|---|---|---|---|
| LAB675 | 0.76 | 1.69E−02 | 2 | 3 | LAB676 | 0.71 | 2.21E−02 | 1 | 1 |
| LAB683 | 0.72 | 2.01E−02 | 1 | 2 | LAB691 | 0.71 | 3.30E−02 | 2 | 5 |
| LAB703 | 0.80 | 1.02E−02 | 2 | 5 | LAB704 | 0.86 | 1.31E−03 | 1 | 1 |
| LAB710 | 0.89 | 5.71E−04 | 1 | 5 | LAB712 | 0.70 | 3.49E−02 | 2 | 5 |

Table 67. Correlations (R) between the genes expression levels in various tissues and the phenotypic performance.
"Corr. ID"—correlation set ID according to the correlated parameters Table above.
"Exp. Set"—Expression set.
"R"= Pearson correlation coefficient;
"P" = p value.

Example 9

Production of Maize Transcriptom and High Throughput Correlation Analysis when Grown Under Normal and Defoliation Conditions Using 60K Maize Oligonucleotide Micro-Array To produce a high throughput correlation analysis, the present inventors utilized a Maize oligonucleotide microarray, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 13 different Maize hybrids were analyzed under normal and defoliation conditions. Same hybrids were subjected to RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Thirteen maize hybrids lines were grown in 6 repetitive plots, in field. Maize seeds were planted and plants were grown in the field using commercial fertilization and irrigation protocols. After silking, 3 plots in every hybrid line underwent the defoliation treatment. In this treatment all the leaves above the ear were removed. After the treatment all the plants were grown according to the same commercial fertilization and irrigation protocols.

Three tissues at flowering (R1) and grain filling (R3) developmental stages including leaf (flowering—R1), stem (flowering—R1 and grain filling—R3), and flowering meristem (flowering—R1) representing different plant characteristics, were sampled from treated and untreated plants. RNA was extracted as described in "GENERAL EXPERIMENTAL AND BIOINFORMATICS METHODS". For convenience, each micro-array expression information tissue type has received a Set ID as summarized in Tables 68-69 below.

TABLE 68

Tissues used for Maize transcriptom expression sets (Under normal conditions)

| Expression Set | Set ID |
| --- | --- |
| Ear at flowering stage under normal conditions | 1 |
| leaf at flowering stage under normal conditions | 2 |
| stem at flowering stage under normal conditions | 3 |
| stem at grain filling stage under normal conditions | 4 |

Table 68. Provided are the identification (ID) number of each of the Maize transcriptome expression sets.

TABLE 69

Tissues used for Maize transcriptom expression sets (Under defoliation conditions)

| Expression Set | Set ID |
| --- | --- |
| Ear at flowering stage under defoliation conditions | 1 |
| leaf at flowering stage under defoliation conditions | 2 |
| stem at flowering stage under defoliation conditions | 3 |
| stem at grain filling stage under defoliation conditions | 4 |

Table 69 Provided are the identification (ID) number of each of the Maize transcriptome expression sets.

The following parameters were collected by imaging.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

1000 grain weight (gr.)—At the end of the experiment all seeds from all plots were collected and weighed and the weight of 1000 was calculated.

Ear Area ($cm^2$)—At the end of the growing period Sears were, photographed and images were processed using the below described image processing system. The Ear area was measured from those images and was divided by the number of ears.

Ear Length and Ear Width (cm)—At the end of the growing period 6 ears were, photographed and images were processed using the below described image processing system. The Ear length and width (longest axis) was measured from those images and was divided by the number of ears.

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weight, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains were weight, photographed and images were processed using the below described image processing system. The sum of grain perimeter was measured from those images and was divided by the number of grains.

Ear filled grain area ($cm^2$)—At the end of the growing period 5 ears were photographed and images were processed using the below described image processing system. The Ear area filled with kernels was measured from those images and was divided by the number of Ears.

Filled per Whole Ear—was calculated as the length of the ear with grains out of the total ear.

Additional parameters were collected either by sampling 6 plants per plot (SP) or by measuring the parameter across all the plants within the plot.

Cob width [mm]—The diameter of the cob without grains was measured using a ruler.

Ear average (avr.) weight [gr.]—At the end of the experiment (when ears were harvested) total and 6 selected ears per plots were collected. The ears were weighted and the average ear per plant was calculated. The ear weight was normalized using the relative humidity to be 0%.

Plant height and Ear height (cm)—Plants were characterized for height at harvesting. In each measure, 6 plants were measured for their height using a measuring tape. Height was measured from ground level to top of the plant below the tassel. Ear height was measured from the ground level to the place were the main ear is located.

Ear row number (num)—The number of rows per ear was counted.

Ear fresh weight per plant (GF)—During the grain filling period (GF) and total and 6 selected ears per plot were collected separately. The ears were weighted and the average ear weight per plant was calculated.

Ears dry weight (Kg)—At the end of the experiment (when ears were harvested) total and 6 selected ears per plots were collected and weighted. The ear weight was normalized using the relative humidity to be 0%.

Ears fresh weight (Kg)—At the end of the experiment (when ears were harvested) total and 6 selected ears per plots were collected and weighted.

Ears per plant (num)—the number of ears per plant was counted.

Grains yield (Kg.)—At the end of the experiment all ears were collected. Ears from 6 plants from each plot were separately threshed and grains were weighted.

Grains dry yield (Kg.)—At the end of the experiment all ears were collected. Ears from 6 plants from each plot were separately threshed and grains were weighted. The grain weight was normalized using the relative humidity to be 0%.

Grain yield per ear (Kg.)—At the end of the experiment all ears were collected. 5 ears from each plot were separately threshed and grains were weighted. The average grain weight per ear was calculated by dividing the total grain weight by the number of ears.

Leaves area cm$^2$) per plant (GF, and HD) [LAI]=Total leaf area of 6 plants in a plot. This parameter was measured using a Leaf area-meter at two time points during the course of the experiment: at heading (HD) and during the grain filling period (GF).

Leaves fresh weight (gr.) (GF, and HD)—This parameter was measured at two time points during the course of the experiment: at heading (HD) and during the grain filling period (GF). Leaves used for measurement of the LAI were weighted.

Lower stem fresh weight (gr.) (GF, HD, and H)—This parameter was measured at three time points during the course of the experiment: at heading (HD), during the grain filling period (GF) and at harvest (H). Lower internodes from at least 4 plants per plot were separated from the plant and weighted. The average internode weight per plant was calculated by dividing the total grain weight by the number of plants.

Lower stem length (cm) (GF, HD, and H)—This parameter was measured at three time points during the course of the experiment: at heading (HD), during the grain filling period (GF) and at harvest (H). Lower internodes from at least 4 plants per plot were separated from the plant and their length was measured using a ruler. The average internode length per plant was calculated by dividing the total grain weight by the number of plants.

Lower stem width (mm) (GF, HD, and H)—This parameter was measured at three time points during the course of the experiment: at heading (HD), during the grain filling period (GF) and at harvest (H). Lower internodes from at least 4 plants per plot were separated from the plant and their diameter was measured using a caliber. The average internode width per plant was calculated by dividing the total grain weight by the number of plants.

Plant height growth—the relative growth rate (RGR) of Plant Height was calculated using Formula IX above, by Regression coefficient of Plant height along time course, measured in cm/day).

SPAD [SPAD unit]—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Stem fresh weight (gr.) (GF and HD)—This parameter was measured at two time points during the course of the experiment: at heading (HD) and during the grain filling period (GF). Stems of the plants used for measurement of the LAI were weighted.

Total dry matter (kg)—Total dry matter was calculated as follows:

$$\text{Normalized ear weight per plant+vegetative dry weight.} \quad \text{Formula X:}$$

Upper stem fresh weight (gr.) (GF, HD and H)—This parameter was measured at three time points during the course of the experiment: at heading (HD), during the grain filling period (GF) and at harvest (H). Upper internodes from at least 4 plants per plot were separated from the plant and weighted. The average internode weight per plant was calculated by dividing the total grain weight by the number of plants.

Upper stem length (cm) (GF, HD and H)—This parameter was measured at three time points during the course of the experiment: at heading (HD), during the grain filling period (GF) and at harvest (H). Upper internodes from at least 4 plants per plot were separated from the plant and their length was measured using a ruler.

Upper stem width (mm) (GF, HD and H)—This parameter was measured at three time points during the course of the experiment: at heading (HD), during the grain filling period (GF) and at harvest (H). Upper internodes from at least 4 plants per plot were separated from the plant and their diameter was measured using a caliber.

Vegetative dry weight (Kg.)—total weight of the vegetative portion of 6 plants (above ground excluding roots) after drying at 70° C. in oven for 48 hours divided by the number of plants.

Vegetative fresh weight (Kg.)—total weight of the vegetative portion of 6 plants (above ground excluding roots).

Node number—nodes on the stem were counted at the heading stage of plant development.

TABLE 70

Maize correlated parameters (vectors) under normal conditions and under defoliation

| Normal conditions | | Defoliation | |
| --- | --- | --- | --- |
| Correlated parameter with | Correlation ID | Correlated parameter with | Correlation ID |
| 1000 grains weight (gr.) | 1 | 1000 grains weight (gr.) | 1 |
| Cob width (mm) | 2 | Cob width (mm) | 2 |
| Ear Area (cm$^2$) | 3 | Ear Area (cm$^2$) | 3 |

TABLE 70-continued

Maize correlated parameters (vectors) under normal conditions and under defoliation

| Normal conditions | | Defoliation | |
|---|---|---|---|
| Correlated parameter with | Correlation ID | Correlated parameter with | Correlation ID |
| Ear Filled Grain Area (cm$^2$) | 4 | Ear Filled Grain Area (cm$^2$) | 4 |
| Ear Width (cm) | 5 | Ear Width (cm) | 5 |
| Ear avr. Weight (gr) | 6 | Ear avr weight (gr) | 6 |
| Ear height (cm) | 7 | Ear height (cm) | 7 |
| Ear length (feret's diameter) (cm) | 8 | Ear length (feret's diameter) (cm) | 8 |
| Ear row num (num) | 9 | Ear row num (num) | 9 |
| Ears FW per plant (GF) (gr/plant) | 10 | Ears dry weight (SP) | 10 |
| Ears dry weight (SP) (kg) | 11 | Ears fresh weight (SP) (kg) | 11 |
| Ears fresh weight (SP) (kg) | 12 | Ears per plant (SP) (num) | 12 |
| Ears per plant (SP) (num) | 13 | Filled/Whole Ear | 13 |
| Filled/Whole Ear | 14 | Grain Perimeter (cm) | 14 |
| Grain Perimeter (cm) | 15 | Grain area (cm$^2$) | 15 |
| Grain area (cm$^2$) | 16 | Grain length (cm) | 16 |
| Grain length (cm) | 17 | Grains dry yield (SP) (kg) | 17 |
| Grain width (cm) | 18 | Grains yield (SP) (kg) | 18 |
| Grains dry yield (SP) (kg) | 19 | Grains yield per ear (SP) (kg) | 20 |
| Grains yield (SP) (kg) | 20 | Leaves FW (HD) (gr) | 21 |
| Grains yield per ear (SP) (kg) | 21 | Leaves area PP (HD) (cm$^2$) | 22 |
| Leaves FW (GF) (gr) | 22 | Lower Stem FW (H) (gr) | 23 |
| Leaves FW (HD) (gr) | 23 | Lower Stem FW (HD) (gr) | 23 |
| Leaves area PP (GF) (cm$^2$) | 24 | Lower Stem length (H) (cm) | 24 |
| Leaves area PP (HD) (cm$^2$) | 25 | Lower Stem length (HD) (cm) | 25 |
| Leaves temperature (GF) (° c.) | 26 | Lower Stem width (H) (mm) | 26 |
| Lower Stem FW (GF) (gr) | 27 | Lower Stem width (HD) (mm) | 27 |
| Lower Stem FW (H) (gr) | 28 | Node number (num) | 28 |
| Lower Stem FW (HD) (gr) | 29 | Plant height (cm) | 29 |
| Lower Stem length (GF) (cm) | 30 | Plant height growth (cm/day) | 30 |
| Lower Stem length (H) (cm) | 31 | SPAD (GF) (SPAD unit) | 31 |
| Lower Stem length (HD) (cm) | 32 | Stem FW (HD) (gr) | 32 |
| Lower Stem width (GF) (mm) | 33 | Total dry matter (SP) (kg) | 33 |
| Lower Stem width (H) (mm) | 34 | Upper Stem FW (H) (gr) | 34 |
| Lower Stem width (HD) (mm) | 35 | Upper Stem length (H) (cm) | 35 |
| Node number (num) | 36 | Upper Stem width (H) (mm) | 36 |
| Plant height (cm) | 37 | Vegetative DW (SP) (kg) | 37 |
| Plant height growth (cm/day) | 38 | Vegetative FW (SP) (kg) | 38 |
| SPAD (GF) (SPAD unit) | 39 | | |
| Stem FW (GF) (gr) | 40 | | |
| Stem FW (HD) (gr) | 41 | | |
| Total dry matter (SP) (kg) | 42 | | |
| Upper Stem FW (GF) (gr) | 43 | | |
| Upper Stem FW (H) (gr) | 44 | | |
| Upper Stem length (GF) (cm) | 45 | | |
| Upper Stem length (H) (cm) | 46 | | |
| Upper Stem width (GF) (mm) | 47 | | |
| Upper Stem width (H) (mm) | 48 | | |
| Vegetative DW (SP) (kg) | 49 | | |
| Vegetative FW (SP) (kg) | 50 | | |

Table 70. Provided are the maize correlated parameters (vectors).
"SPAD" = chlorophyll levels;
"FW" = Plant Fresh weight;
"DW" = Plant Dry weight;
"GF" = grain filling growth stage;
"HD" = heading stage;
"H" = harvest stage.
"SP" = selected 6 plants for phenotyping.

Thirteen maize varieties were grown, and characterized for parameters as described above. The average for each parameter was calculated using the JMP software, and values are summarized in Tables 71-74 below. Subsequent correlation between the various transcriptom sets for all or sub set of lines was done by the bioinformatic unit and results were integrated into the database (Tables 75 and 76 below).

TABLE 71

Measured parameters in Maize Hybrid under normal conditions

| Ecotype/Treatment | Line-1 | Line-2 | Line-3 | Line-4 | Line-5 | Line-6 |
|---|---|---|---|---|---|---|
| 1 | 296.50251 | 263.24954 | 303.61446 | 304.69706 | 281.18264 | 330.45207 |
| 2 | 24.63333 | 25.10583 | 23.20667 | 23.68889 | 22.81083 | 22.40167 |
| 3 | 82.29635 | 74.62558 | 76.99696 | 90.15090 | 83.80019 | 96.62837 |
| 4 | 80.88746 | 72.41504 | 73.43049 | 85.96127 | 80.64266 | 95.03413 |
| 5 | 4.65586 | 4.78698 | 4.96127 | 4.99750 | 4.64984 | 4.80226 |
| 6 | 209.50000 | 164.62698 | 177.44444 | 218.52778 | 205.58333 | 135.77149 |
| 7 | 121.66667 | 134.23529 | 149.63889 | 152.13889 | 143.83333 | 133.64706 |
| 8 | 22.09059 | 19.62220 | 20.02428 | 23.20903 | 22.62695 | 23.73754 |
| 9 | 13.00000 | 14.94444 | 14.55556 | 14.55556 | 13.55556 | 13.05882 |
| 10 | 351.26167 | 323.07727 | 307.87417 | 330.60000 | 320.51333 | 434.59583 |
| 11 | 1.25700 | 1.08733 | 1.06467 | 1.31117 | 1.23350 | 1.35350 |
| 12 | 1.68667 | 1.45667 | 1.41200 | 1.69933 | 1.51933 | 1.73933 |
| 13 | 1.00000 | 1.11111 | 1.00000 | 1.00000 | 1.00000 | 1.05556 |
| 14 | 0.98232 | 0.96921 | 0.95254 | 0.95283 | 0.94929 | 0.93737 |
| 15 | 3.29898 | 3.23282 | 3.27539 | 3.33768 | 3.17788 | 3.38166 |
| 16 | 0.72008 | 0.66656 | 0.70570 | 0.72205 | 0.67116 | 0.75337 |
| 17 | 1.12471 | 1.12272 | 1.13333 | 1.16981 | 1.08080 | 1.15931 |
| 18 | 0.80820 | 0.75252 | 0.78920 | 0.78174 | 0.78711 | 0.82253 |
| 19 | 0.90706 | 0.79995 | 0.76552 | 0.92313 | 0.83336 | 0.98626 |
| 20 | 1.03690 | 0.91277 | 0.86947 | 1.05777 | 0.95347 | 1.12280 |
| 21 | 0.15118 | 0.13333 | 0.12759 | 0.15386 | 0.13889 | 0.16438 |
| 22 | 230.12917 | 197.63636 | 201.03083 | 205.52500 | 224.81250 | 204.48636 |
| 23 | 110.96750 | 80.57000 | 157.21000 | 128.83250 | 100.57250 | 111.80000 |
| 24 | 7034.59600 | 6402.79500 | 6353.07400 | 6443.92300 | 6835.49583 | 6507.33333 |
| 25 | 4341.25000 | 3171.00000 | 4205.50000 | 4347.50000 | 3527.00000 | 4517.33333 |
| 26 | 33.11111 | 33.51668 | 33.86852 | 34.17593 | 33.77963 | 32.85187 |
| 27 | 35.40333 | 25.02545 | 26.51417 | 21.74333 | 26.12500 | 34.44417 |
| 28 | 23.51722 | 20.34000 | 25.08333 | 14.17889 | 17.53056 | 25.73556 |
| 29 | 72.98750 | 59.90000 | 74.71500 | 90.47500 | 69.52000 | 66.91000 |
| 30 | 19.35000 | 20.40000 | 20.92500 | 21.37500 | 20.03333 | 20.30833 |
| 31 | 16.76111 | 20.02222 | 22.59444 | 21.67778 | 22.34444 | 21.39444 |
| 32 | 14.50000 | 17.75000 | 20.00000 | 19.35000 | 20.33333 | 20.75000 |
| 33 | 19.85500 | 16.84091 | 16.13917 | 16.36917 | 17.01167 | 17.52500 |
| 34 | 19.42333 | 17.18778 | 16.08611 | 16.92000 | 17.51667 | 17.87611 |
| 35 | 24.13750 | 20.53250 | 20.97250 | 24.43000 | 21.70000 | 19.49250 |
| 36 | 15.22222 | 14.55556 | 14.61111 | 14.83333 | 15.00000 | 13.83333 |
| 37 | 265.11111 | 255.94444 | 271.11111 | 283.88889 | 279.72222 | 268.77778 |
| 38 | 5.42547 | 5.58918 | 6.14928 | 5.98862 | 6.36719 | 6.47215 |
| 39 | 59.77222 | 53.17037 | 53.20555 | 54.94814 | 53.99073 | 55.23889 |
| 40 | 649.02583 | 489.31818 | 524.05500 | 512.65833 | 542.15667 | 627.75833 |
| 41 | 758.61000 | 587.87500 | 801.32000 | 794.80000 | 721.86500 | 708.38000 |
| 42 | 2.56533 | 2.05800 | 2.31600 | 2.44183 | 2.36117 | 2.56683 |
| 43 | 19.61417 | 15.53909 | 17.82417 | 10.79250 | 14.41333 | 20.31000 |
| 44 | 12.93667 | 11.21222 | 12.97500 | 6.50222 | 7.98500 | 12.08111 |
| 45 | 16.63333 | 18.75455 | 18.37500 | 17.91667 | 17.60000 | 18.79167 |
| 46 | 16.92778 | 18.75556 | 18.71667 | 20.01111 | 19.40000 | 19.65000 |
| 47 | 15.99583 | 14.10636 | 13.50333 | 11.88917 | 13.08167 | 14.33917 |
| 48 | 14.93333 | 12.99778 | 12.44444 | 12.04000 | 12.88667 | 13.28389 |
| 49 | 1.30833 | 0.97067 | 1.25133 | 1.13067 | 1.12767 | 1.21333 |
| 50 | 3.15667 | 2.25200 | 2.60733 | 2.59600 | 2.41600 | 2.64000 |

Table 71. Provided are the values of each of the parameters (as described above) measured in Maize accessions (line) under normal growth conditions. Growth conditions are specified in the experimental procedure section

TABLE 72

Measured parameters in Maize Hybrid under normal conditions, additional maize lines

| Ecotype/Treatment | Line-7 | Line-8 | Line-9 | Line-10 | Line-11 | Line-12 | Line-13 |
|---|---|---|---|---|---|---|---|
| 1 | 290.88088 | 250.25662 | 306.20085 | 253.18855 | 277.03453 | 269.53039 | 274.80688 |
| 2 | 23.18417 | 24.87647 | 26.46833 | 23.08500 | 22.69333 | 23.55000 | 26.30611 |
| 3 | 78.35527 | 93.91409 | 96.77248 | 85.44022 | 76.77075 | NA | 97.99277 |
| 4 | 74.41062 | 92.31220 | 95.42920 | 83.28003 | 74.34624 | NA | 96.87625 |
| 5 | 4.78636 | 5.18156 | 5.00122 | 4.95161 | 4.78611 | NA | 5.42638 |
| 6 | 147.49022 | 207.11111 | 228.44444 | 215.91667 | 198.69444 | 188.50000 | 254.41667 |
| 7 | 118.38889 | 145.23529 | 133.77778 | 143.70588 | 134.16667 | 143.00000 | 147.77778 |

TABLE 72-continued

Measured parameters in Maize Hybrid under normal conditions, additional maize lines

| Ecotype/Treatment | Line-7 | Line-8 | Line-9 | Line-10 | Line-11 | Line-12 | Line-13 |
|---|---|---|---|---|---|---|---|
| 8 | 20.31309 | 22.60133 | 23.83731 | 21.74047 | 20.04489 | NA | 22.41225 |
| 9 | 16.11765 | 15.88889 | 14.00000 | 15.44444 | 14.88889 | 14.94444 | 16.77778 |
| 10 | 325.08333 | 327.14545 | 363.70417 | 405.72083 | 338.24167 | 345.32083 | 369.68750 |
| 11 | 1.15933 | 1.29167 | 1.37067 | 1.29550 | 1.19217 | 1.13100 | 1.52650 |
| 12 | 1.79967 | 1.59533 | 1.73867 | 1.68133 | 1.56467 | 1.42133 | 1.89067 |
| 13 | 1.00000 | 1.05556 | 1.00000 | 1.00000 | 1.00000 | 1.00000 | 1.00000 |
| 14 | 0.93033 | 0.98246 | 0.98585 | 0.97443 | 0.96633 | NA | 0.98859 |
| 15 | 3.24588 | 3.18218 | 3.29132 | 3.26875 | 3.21585 | 3.15483 | 3.38357 |
| 16 | 0.66499 | 0.64595 | 0.70466 | 0.67820 | 0.66995 | 0.65171 | 0.72309 |
| 17 | 1.14189 | 1.11850 | 1.15068 | 1.16333 | 1.12373 | 1.08997 | 1.20621 |
| 18 | 0.73957 | 0.72970 | 0.77352 | 0.73881 | 0.75647 | 0.75748 | 0.75969 |
| 19 | 0.81991 | 0.92149 | 1.01686 | 0.94248 | 0.85244 | 0.81325 | 1.14172 |
| 20 | 0.93960 | 1.04993 | 1.15477 | 1.07557 | 0.97430 | 0.92433 | 1.28740 |
| 21 | 0.13665 | 0.15358 | 0.16948 | 0.15708 | 0.14207 | 0.13554 | 0.19029 |
| 22 | 212.41250 | 181.43182 | 199.22083 | 206.90833 | 168.54167 | 199.42083 | 200.12083 |
| 23 | 116.75000 | 106.94500 | 85.97333 | 102.70750 | 105.73250 | 102.11750 | 143.06250 |
| 24 | 7123.47500 | 6075.20556 | 6597.66625 | 6030.40000 | 6307.05667 | 6617.64889 | 6848.03429 |
| 25 | 3984.75000 | 3696.75000 | 3926.66667 | 3127.66667 | 3942.75000 | 3955.00000 | 4854.00000 |
| 26 | 33.18518 | 33.65926 | 33.78147 | 32.63890 | 33.95001 | 33.27778 | 33.90186 |
| 27 | 27.60583 | 25.26364 | 26.17833 | 34.31182 | 25.49917 | 23.06292 | 25.58750 |
| 28 | 20.60278 | 16.34667 | 18.90059 | 27.30389 | 22.34833 | 19.25500 | 22.81556 |
| 29 | 60.35750 | 63.06667 | 55.88500 | 82.12500 | 60.02250 | 58.69500 | 116.11500 |
| 30 | 18.08333 | 20.18182 | 19.80833 | 22.89167 | 19.80833 | 19.53333 | 21.40000 |
| 31 | 17.07222 | 20.69444 | 18.47778 | 23.30556 | 19.38889 | 19.65556 | 19.96667 |
| 32 | 15.00000 | 18.67500 | 20.50000 | 22.56667 | 19.82500 | 14.50000 | 20.33333 |
| 33 | 18.10500 | 17.09364 | 16.86750 | 17.49167 | 16.61583 | 17.09917 | 17.37583 |
| 34 | 17.96167 | 18.42111 | 17.43444 | 18.07111 | 17.68111 | 17.61278 | 18.93333 |
| 35 | 23.47333 | 20.97250 | 21.45750 | 21.40500 | 22.11500 | 23.24750 | 24.31000 |
| 36 | 14.27778 | 14.72222 | 15.44444 | 14.33333 | 14.44444 | 14.88889 | 14.38889 |
| 37 | 244.25000 | 273.55556 | 273.22222 | 295.33333 | 259.25000 | 257.88889 | 277.19444 |
| 38 | 4.82134 | 6.01201 | 5.98694 | 6.66171 | 5.98578 | 5.61817 | 6.53028 |
| 39 | 55.37593 | 56.75925 | 55.81176 | 58.54074 | 51.67778 | 55.15741 | 54.15556 |
| 40 | 507.78333 | 549.33636 | 509.73750 | 662.12917 | 527.43333 | 474.67833 | 544.03182 |
| 41 | 660.69500 | 724.57500 | 618.46000 | 837.56250 | 612.80500 | 727.99750 | 950.28750 |
| 42 | 2.23267 | 2.72650 | 2.33133 | 2.39550 | 2.19950 | 2.08367 | 2.83983 |
| 43 | 15.84909 | 14.39455 | 17.84833 | 20.42333 | 13.92917 | 13.05250 | 16.45083 |
| 44 | 9.72333 | 6.98056 | 9.39556 | 13.58278 | 9.20222 | 7.68667 | 10.17059 |
| 45 | 17.06667 | 17.51818 | 18.15000 | 18.60833 | 17.69167 | 18.15000 | 18.64167 |
| 46 | 16.41667 | 18.33889 | 16.62778 | 19.38333 | 16.71111 | 16.26667 | 15.92222 |
| 47 | 15.04250 | 13.62818 | 14.73333 | 14.60750 | 13.16917 | 12.77000 | 14.15333 |
| 48 | 13.09556 | 13.48176 | 13.41722 | 13.27111 | 13.13556 | 12.53000 | 13.79222 |
| 49 | 1.07333 | 1.43800 | 0.96067 | 1.10000 | 1.00733 | 0.95267 | 1.31333 |
| 50 | 2.21967 | 2.89733 | 2.22400 | 2.82667 | 2.29467 | 2.15133 | 2.90000 |

Table 72. Provided are the values of each of the parameters (as described above) measured in Maize accessions (line) under normal growth conditions. Growth conditions are specified in the experimental procedure section.

TABLE 73

Measured parameters in Maize Hybrid under defoliation

| Ecotype/Treatment | Line-1 | Line-2 | Line-3 | Line-4 | Line-5 | Line-6 |
|---|---|---|---|---|---|---|
| 1 | 280.0253 | 251.8588 | 294.2919 | 295.3616 | 288.3955 | 308.2517 |
| 2 | 19.0275 | 22.1153 | 16.3058 | 21.5365 | 19.8383 | 18.2094 |
| 3 | 53.6001 | 45.5028 | 38.3068 | 58.4717 | 53.8938 | 63.5379 |
| 4 | 51.4969 | 42.9524 | 34.5905 | 55.6745 | 51.3574 | 61.4371 |
| 5 | 4.1811 | 4.2072 | 3.9194 | 4.7733 | 4.5058 | 4.6122 |
| 6 | 89.2020 | 100.7500 | 73.3889 | 129.8389 | 129.7778 | 115.0556 |
| 7 | 119.4444 | 131.5556 | 145.5278 | 156.0556 | 145.2778 | 129.5294 |
| 8 | 16.3379 | 13.6259 | 12.8890 | 15.9372 | 15.3364 | 17.5304 |
| 9 | 12.7059 | 14.3571 | 13.0000 | 14.1176 | 13.4706 | 13.0714 |
| 10 | 0.7470 | 0.5832 | 0.4403 | 0.7415 | 0.7787 | 0.5762 |
| 11 | 0.9727 | 0.8333 | 0.6287 | 0.9793 | 1.0100 | 0.8033 |
| 12 | 1.0000 | 0.9444 | 1.0000 | 0.9444 | 1.0000 | 0.9412 |
| 13 | 0.9539 | 0.9147 | 0.8725 | 0.9495 | 0.9477 | 0.9613 |
| 14 | 3.1085 | 3.1441 | 3.1793 | 3.2073 | 3.1963 | 3.2300 |
| 15 | 0.6485 | 0.6321 | 0.6692 | 0.6752 | 0.6767 | 0.6833 |
| 16 | 1.0517 | 1.0795 | 1.0787 | 1.1102 | 1.0869 | 1.0944 |
| 17 | 0.5227 | 0.4001 | 0.2890 | 0.5168 | 0.5465 | 0.3983 |
| 18 | 0.6042 | 0.4557 | 0.3308 | 0.5883 | 0.6236 | 0.4581 |

TABLE 73-continued

Measured parameters in Maize Hybrid under defoliation

| Ecotype/Treatment | Line-1 | Line-2 | Line-3 | Line-4 | Line-5 | Line-6 |
|---|---|---|---|---|---|---|
| 19 | 0.0871 | 0.0687 | 0.0482 | 0.0902 | 0.0911 | 0.0798 |
| 20 | 112.2700 | 94.9850 | 125.1375 | 144.4825 | 112.5025 | 116.1575 |
| 21 | 3914.0000 | 3480.0000 | 4276.5000 | 4985.5000 | 4643.5000 | 4223.0000 |
| 22 | 23.0211 | 26.5017 | 26.9750 | 15.2372 | 18.1917 | 37.2128 |
| 23 | 64.1600 | 53.8125 | 56.4125 | 80.9500 | 71.2700 | 66.6850 |
| 24 | 16.2944 | 21.4389 | 20.8500 | 22.5778 | 22.9389 | 21.6222 |
| 25 | 15.1500 | 18.5000 | 16.6667 | 18.0667 | 18.0000 | 19.8333 |
| 26 | 19.5389 | 16.8994 | 15.7933 | 17.0128 | 17.1206 | 18.1744 |
| 27 | 24.3000 | 20.5650 | 21.0575 | 24.8700 | 20.8525 | 20.4550 |
| 28 | 15.1667 | 14.3889 | 15.0000 | 15.1111 | 14.5000 | 14.2222 |
| 29 | 251.4167 | 248.6389 | 268.0556 | 285.1111 | 278.8333 | 261.8824 |
| 30 | 6.3849 | 6.3189 | 6.3147 | 6.9319 | 6.8319 | 7.1421 |
| 31 | 61.2130 | 57.3630 | 58.0222 | 62.3593 | 60.7204 | 62.2241 |
| 32 | 713.5400 | 538.0425 | 705.5250 | 803.3250 | 703.3575 | 664.2250 |
| 33 | 1.5393 | 1.3652 | 1.4403 | 1.5315 | 1.5707 | 1.5738 |
| 34 | 8.6794 | 11.0750 | 14.0950 | 4.8928 | 6.0350 | 13.9544 |
| 35 | 16.2389 | 18.8333 | 17.7444 | 19.6389 | 20.7389 | 20.1389 |
| 36 | 14.2722 | 12.8217 | 12.6861 | 11.0906 | 12.0039 | 13.0250 |
| 37 | 0.7923 | 0.7820 | 1.0000 | 0.7900 | 0.7920 | 0.9977 |
| 38 | 2.5113 | 1.9553 | 2.7967 | 2.1073 | 2.2047 | 2.7853 |

Table 73. Provided are the values of each of the parameters (as described above) measured in Maize accessions (line) under defoliation growth conditions. Growth conditions are specified in the experimental procedure section.

TABLE 74

Measured parameters in Maize Hybrid under defoliation, additional maize lines

| Ecotype/Treatment | Line-7 | Line-8 | Line-9 | Line-10 | Line-11 | Line-12 | Line-13 |
|---|---|---|---|---|---|---|---|
| 1 | 230.1190 | 271.2500 | 259.4268 | 243.9760 | 262.4103 | 248.6401 | 244.1569 |
| 2 | 19.7681 | 22.4406 | 20.2827 | 19.6433 | 22.3150 | 23.3117 | 27.7825 |
| 3 | 39.8275 | 47.3287 | 65.8961 | 43.8344 | 43.2839 | 52.2972 | 58.3135 |
| 4 | 36.3128 | 43.3387 | 64.8033 | 39.5577 | 40.4291 | 49.2795 | 55.6853 |
| 5 | 4.0992 | 4.2021 | 4.6641 | 4.0562 | 4.0122 | 4.4075 | 4.9751 |
| 6 | 85.0444 | 33.0998 | 161.7611 | 89.3611 | 87.6786 | 88.1833 | 124.5833 |
| 7 | 123.3750 | 135.0000 | 136.5000 | 136.3889 | 130.3235 | 139.7059 | 143.4444 |
| 8 | 13.2138 | 14.8181 | 17.6020 | 13.7844 | 13.7459 | 15.5304 | 14.8748 |
| 9 | 14.0625 | 13.7500 | 13.9375 | 12.7857 | 13.0000 | 14.2857 | 15.8333 |
| 10 | 0.4537 | 0.6302 | 0.8027 | 0.5362 | 0.5518 | 0.5122 | 0.7475 |
| 11 | 0.6480 | 0.8187 | 1.1480 | 0.8773 | 0.7913 | 0.6927 | 0.9913 |
| 12 | 0.8889 | 1.0000 | 0.8824 | 1.0000 | 1.0556 | 0.9444 | 1.0000 |
| 13 | 0.9051 | 0.9051 | 0.9827 | 0.8896 | 0.9177 | 0.9401 | 0.9502 |
| 14 | 3.1299 | 3.0157 | 3.1165 | 3.0856 | 3.0298 | 2.9757 | 3.1526 |
| 15 | 0.6308 | 0.6098 | 0.6230 | 0.6191 | 0.6004 | 0.5830 | 0.6306 |
| 16 | 1.0659 | 1.0242 | 1.0836 | 1.0543 | 1.0245 | 0.9952 | 1.0946 |
| 17 | 0.3015 | 0.4386 | 0.6670 | 0.3594 | 0.3771 | 0.3444 | 0.5309 |
| 18 | 0.3451 | 0.5050 | 0.7674 | 0.4115 | 0.4346 | 0.3942 | 0.6087 |
| 19 | 0.0564 | 0.0731 | 0.1239 | 0.0599 | 0.0628 | 0.0589 | 0.0885 |
| 20 | 113.7825 | 93.7375 | 89.8575 | 86.9825 | 117.2700 | 150.6825 | 161.6450 |
| 21 | 3436.0000 | 4593.0000 | 4315.5000 | 4020.5000 | 4154.0000 | 4851.5000 | 3750.0000 |
| 22 | 27.8847 | 17.3294 | 20.5100 | 25.3622 | 28.4144 | 23.1644 | 38.7961 |
| 23 | 64.1875 | 76.2333 | 57.8500 | 69.9750 | 67.3000 | 72.9000 | 83.5833 |
| 24 | 18.7588 | 20.8833 | 17.8278 | 20.7000 | 20.4278 | 20.1111 | 24.1278 |
| 25 | 16.1000 | 14.8333 | 17.5000 | 23.6667 | 19.0000 | 16.4500 | 20.6000 |
| 26 | 18.2147 | 17.2333 | 17.8822 | 17.1239 | 17.5256 | 18.6272 | 19.8653 |
| 27 | 20.9550 | 22.4700 | 21.2300 | 19.8475 | 21.2925 | 23.5800 | 21.3675 |
| 28 | 14.3889 | 14.6667 | 15.6111 | 14.3889 | 14.0556 | 14.6111 | 14.0000 |
| 29 | 254.6389 | 261.9444 | 268.8778 | 272.7059 | 262.5000 | 266.3333 | 279.1389 |
| 30 | 6.4818 | 6.2823 | 7.0439 | 7.2035 | 7.3391 | 6.9388 | 7.2743 |
| 31 | 59.6537 | 59.9852 | 56.7611 | 65.6963 | 57.9407 | 60.3056 | 57.7148 |
| 32 | 673.2375 | 738.3675 | 692.2250 | 619.7875 | 729.2250 | 794.6375 | 847.5167 |
| 33 | 1.3370 | 1.4742 | 1.6627 | 1.4765 | 1.3135 | 1.4762 | 1.7148 |
| 34 | 10.9339 | 6.4767 | 9.0072 | 10.6856 | 10.3789 | 8.4900 | 12.2878 |
| 35 | 17.1833 | 19.1167 | 16.7389 | 15.9556 | 17.3111 | 18.1944 | 17.7722 |
| 36 | 14.2539 | 12.7689 | 13.5206 | 13.0783 | 13.4317 | 13.2117 | 14.7244 |
| 37 | 0.8833 | 0.8440 | 0.8600 | 0.9403 | 0.7617 | 0.9640 | 0.9673 |
| 38 | 2.5413 | 2.4753 | 2.3500 | 2.5947 | 2.4060 | 2.6993 | 2.7207 |

Table 74. Provided are the values of each of the parameters (as described above) measured in Maize accessions (line) under defoliation growth conditions. Growth conditions are specified in the experimental procedure section.

Tables 75 and 76 hereinbelow provide the correlations (R) between the expression levels yield improving genes and their homologs in various tissues [Expression (Exp) sets] and the phenotypic performance [yield, biomass, growth rate and/or vigor components (Correlation vector (Cor))] under normal and defoliation conditions across maize varieties. P=p value.

TABLE 75

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LAB673 | 0.761 | 4.04E−03 | 3 | 46 | LAB673 | 0.700 | 1.12E−02 | 3 | 18 |
| LAB673 | 0.722 | 1.84E−02 | 4 | 5 | LAB676 | 0.786 | 4.12E−03 | 4 | 9 |
| LAB676 | 0.786 | 4.09E−03 | 4 | 45 | LAB676 | 0.760 | 1.08E−02 | 4 | 5 |
| LAB676 | 0.728 | 1.11E−02 | 2 | 7 | LAB677 | 0.710 | 1.44E−02 | 4 | 45 |
| LAB677 | 0.703 | 1.58E−02 | 4 | 10 | LAB677 | 0.767 | 9.68E−03 | 2 | 5 |
| LAB678 | 0.759 | 2.62E−03 | 1 | 26 | LAB678 | 0.829 | 8.64E−04 | 3 | 13 |
| LAB678 | 0.978 | 2.17E−07 | 4 | 13 | LAB678 | 0.867 | 5.55E−04 | 2 | 20 |
| LAB678 | 0.905 | 1.25E−04 | 2 | 11 | LAB678 | 0.712 | 1.40E−02 | 2 | 2 |
| LAB678 | 0.773 | 5.26E−03 | 2 | 42 | LAB678 | 0.849 | 1.88E−03 | 2 | 4 |
| LAB678 | 0.776 | 8.32E−03 | 2 | 8 | LAB678 | 0.841 | 2.28E−03 | 2 | 3 |
| LAB678 | 0.707 | 2.23E−02 | 2 | 5 | LAB678 | 0.866 | 5.74E−04 | 2 | 21 |
| LAB678 | 0.866 | 5.74E−04 | 2 | 19 | LAB679 | 0.741 | 5.85E−03 | 3 | 27 |
| LAB679 | 0.780 | 2.78E−03 | 3 | 43 | LAB679 | 0.818 | 1.15E−03 | 3 | 28 |
| LAB679 | 0.766 | 3.70E−03 | 3 | 10 | LAB679 | 0.749 | 5.06E−03 | 3 | 34 |
| LAB679 | 0.763 | 6.29E−03 | 4 | 41 | LAB679 | 0.731 | 1.06E−02 | 4 | 10 |
| LAB680 | 0.713 | 6.22E−03 | 1 | 48 | LAB680 | 0.766 | 2.28E−03 | 1 | 47 |
| LAB680 | 0.725 | 5.05E−03 | 1 | 27 | LAB680 | 0.723 | 7.83E−03 | 3 | 34 |
| LAB680 | 0.820 | 1.99E−03 | 2 | 41 | LAB681 | 0.731 | 1.06E−02 | 4 | 31 |
| LAB681 | 0.713 | 1.38E−02 | 2 | 46 | LAB682 | 0.707 | 1.50E−02 | 4 | 45 |
| LAB683 | 0.736 | 9.84E−03 | 4 | 20 | LAB683 | 0.785 | 4.17E−03 | 4 | 11 |
| LAB683 | 0.781 | 4.53E−03 | 4 | 29 | LAB683 | 0.715 | 1.34E−02 | 4 | 17 |
| LAB683 | 0.765 | 9.91E−03 | 4 | 5 | LAB683 | 0.733 | 1.03E−02 | 4 | 21 |
| LAB683 | 0.733 | 1.03E−02 | 4 | 19 | LAB683 | 0.724 | 1.17E−02 | 2 | 37 |
| LAB684 | 0.749 | 7.97E−03 | 4 | 41 | LAB684 | 0.719 | 1.27E−02 | 4 | 45 |
| LAB684 | 0.920 | 6.20E−05 | 4 | 29 | LAB684 | 0.815 | 2.23E−03 | 4 | 17 |
| LAB684 | 0.754 | 7.33E−03 | 4 | 15 | LAB684 | 0.782 | 4.45E−03 | 4 | 30 |
| LAB684 | 0.832 | 1.49E−03 | 2 | 9 | LAB685 | 0.758 | 4.28E−03 | 3 | 18 |
| LAB687 | 0.739 | 3.88E−03 | 1 | 27 | LAB687 | 0.784 | 1.52E−03 | 1 | 40 |
| LAB687 | 0.744 | 3.52E−03 | 1 | 15 | LAB687 | 0.759 | 6.75E−03 | 4 | 9 |
| LAB688 | 0.728 | 7.29E−03 | 3 | 45 | LAB688 | 0.713 | 9.30E−03 | 3 | 28 |
| LAB688 | 0.742 | 5.76E−03 | 3 | 10 | LAB688 | 0.715 | 1.34E−02 | 4 | 10 |
| LAB688 | 0.721 | 1.22E−02 | 4 | 18 | LAB689 | 0.780 | 4.66E−03 | 4 | 9 |
| LAB692 | 0.743 | 5.65E−03 | 3 | 13 | LAB692 | 0.746 | 8.45E−03 | 4 | 30 |
| LAB692 | 0.701 | 1.62E−02 | 2 | 38 | LAB692 | 0.803 | 5.16E−03 | 2 | 8 |
| LAB693 | 0.729 | 4.70E−03 | 1 | 33 | LAB693 | 0.724 | 5.18E−03 | 1 | 27 |
| LAB693 | 0.731 | 4.54E−03 | 1 | 10 | LAB693 | 0.719 | 5.65E−03 | 1 | 34 |
| LAB693 | 0.711 | 9.55E−03 | 3 | 16 | LAB693 | 0.707 | 1.02E−02 | 3 | 15 |
| LAB693 | 0.739 | 9.35E−03 | 2 | 24 | LAB693 | 0.822 | 1.91E−03 | 2 | 1 |
| LAB694 | 0.708 | 2.19E−02 | 2 | 8 | LAB696 | 0.860 | 3.35E−04 | 3 | 20 |
| LAB696 | 0.901 | 6.41E−05 | 3 | 11 | LAB696 | 0.723 | 7.90E−03 | 3 | 38 |
| LAB696 | 0.768 | 3.51E−03 | 3 | 37 | LAB696 | 0.896 | 8.03E−05 | 3 | 42 |
| LAB696 | 0.702 | 1.10E−02 | 3 | 6 | LAB696 | 0.741 | 5.80E−03 | 3 | 41 |
| LAB696 | 0.804 | 2.88E−03 | 3 | 4 | LAB696 | 0.776 | 3.02E−03 | 3 | 29 |
| LAB696 | 0.731 | 6.92E−03 | 3 | 17 | LAB696 | 0.808 | 2.65E−03 | 3 | 3 |
| LAB696 | 0.775 | 5.04E−03 | 3 | 5 | LAB696 | 0.708 | 1.00E−02 | 3 | 49 |
| LAB696 | 0.759 | 4.16E−03 | 3 | 50 | LAB696 | 0.852 | 4.38E−04 | 3 | 21 |
| LAB696 | 0.852 | 4.38E−04 | 3 | 19 | LAB696 | 0.733 | 1.02E−02 | 2 | 6 |
| LAB696 | 0.707 | 1.49E−02 | 2 | 41 | LAB696 | 0.807 | 2.70E−03 | 2 | 29 |
| LAB697 | 0.704 | 7.24E−03 | 1 | 13 | LAB697 | 0.718 | 8.53E−03 | 3 | 42 |
| LAB697 | 0.719 | 8.42E−03 | 3 | 34 | LAB697 | 0.731 | 1.06E−02 | 4 | 38 |
| LAB697 | 0.852 | 8.72E−04 | 4 | 41 | LAB697 | 0.849 | 9.52E−04 | 4 | 29 |
| LAB697 | 0.799 | 3.20E−03 | 4 | 30 | LAB697 | 0.702 | 1.61E−02 | 4 | 10 |
| LAB697 | 0.761 | 6.49E−03 | 2 | 10 | LAB698 | 0.731 | 4.56E−03 | 1 | 22 |
| LAB698 | 0.725 | 1.15E−02 | 2 | 40 | LAB698 | 0.800 | 3.13E−03 | 4 | 46 |
| LAB700 | 0.752 | 4.75E−03 | 3 | 25 | LAB700 | 0.749 | 5.06E−03 | 3 | 42 |
| LAB700 | 0.748 | 5.13E−03 | 3 | 29 | LAB700 | 0.840 | 6.35E−04 | 3 | 23 |
| LAB701 | 0.718 | 5.74E−03 | 1 | 48 | LAB701 | 0.737 | 4.06E−03 | 1 | 33 |
| LAB701 | 0.775 | 1.84E−03 | 1 | 34 | LAB702 | 0.817 | 2.15E−03 | 4 | 13 |
| LAB703 | 0.741 | 3.72E−03 | 1 | 33 | LAB704 | 0.720 | 8.26E−03 | 3 | 25 |
| LAB704 | 0.758 | 4.29E−03 | 3 | 23 | LAB704 | 0.705 | 1.54E−02 | 4 | 40 |
| LAB704 | 0.718 | 1.29E−02 | 4 | 28 | LAB704 | 0.712 | 1.39E−02 | 4 | 30 |
| LAB704 | 0.838 | 1.29E−03 | 4 | 10 | LAB705 | 0.711 | 9.50E−03 | 3 | 1 |
| LAB706 | 0.745 | 8.50E−03 | 4 | 9 | LAB706 | 0.802 | 2.99E−03 | 2 | 24 |

TABLE 75-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LAB707 | 0.856 | 7.72E−04 | 2 | 25 | LAB707 | 0.727 | 1.13E−02 | 2 | 1 |
| LAB708 | 0.720 | 8.26E−03 | 3 | 25 | LAB708 | 0.704 | 1.06E−02 | 3 | 16 |
| LAB708 | 0.725 | 7.61E−03 | 3 | 23 | LAB708 | 0.760 | 6.66E−03 | 4 | 38 |
| LAB708 | 0.737 | 9.71E−03 | 4 | 31 | LAB708 | 0.827 | 1.71E−03 | 4 | 37 |
| LAB708 | 0.734 | 1.00E−02 | 4 | 41 | LAB708 | 0.763 | 6.33E−03 | 4 | 30 |
| LAB708 | 0.754 | 7.35E−03 | 2 | 35 | LAB709 | 0.707 | 1.01E−02 | 3 | 10 |
| LAB709 | 0.728 | 7.25E−03 | 3 | 44 | LAB709 | 0.731 | 1.06E−02 | 4 | 27 |
| LAB709 | 0.745 | 8.57E−03 | 4 | 40 | LAB709 | 0.717 | 1.30E−02 | 4 | 43 |
| LAB709 | 0.794 | 3.51E−03 | 4 | 28 | LAB709 | 0.835 | 1.37E−03 | 4 | 44 |
| LAB710 | 0.774 | 5.19E−03 | 4 | 47 | LAB710 | 0.715 | 1.34E−02 | 4 | 12 |
| LAB710 | 0.704 | 1.56E−02 | 4 | 39 | LAB710 | 0.862 | 6.39E−04 | 2 | 24 |
| LAB712 | 0.701 | 1.11E−02 | 3 | 37 | LAB712 | 0.716 | 8.87E−03 | 3 | 50 |
| LAB712 | 0.815 | 2.22E−03 | 4 | 40 | LAB712 | 0.760 | 6.68E−03 | 2 | 18 |
| LAB713 | 0.762 | 2.48E−03 | 1 | 10 | LAB713 | 0.735 | 6.51E−03 | 3 | 25 |
| LAB713 | 0.735 | 6.52E−03 | 3 | 29 | LAB713 | 0.736 | 6.36E−03 | 3 | 15 |
| LAB713 | 0.757 | 4.33E−03 | 3 | 23 | LAB713 | 0.713 | 1.38E−02 | 4 | 20 |
| LAB713 | 0.759 | 6.74E−03 | 4 | 29 | LAB713 | 0.724 | 1.17E−02 | 4 | 17 |
| LAB713 | 0.707 | 2.23E−02 | 4 | 5 | LAB713 | 0.726 | 1.15E−02 | 4 | 21 |
| LAB713 | 0.726 | 1.15E−02 | 4 | 19 | LAB714 | 0.808 | 2.63E−03 | 4 | 46 |

Table 75. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 76

Correlation between the expression level of selected genes of some embodiments of the invention in various tissues and the phenotypic performance under defoliation conditions across maize varieties

| Gene Name | R | P value | Exp. set | Corr. Set ID | Gene Name | R | P value | Exp. set | Corr. Set ID |
|---|---|---|---|---|---|---|---|---|---|
| LAB673 | 0.782 | 2.63E−03 | 1 | 31 | LAB673 | 0.774 | 3.15E−03 | 3 | 1 |
| LAB673 | 0.718 | 8.57E−03 | 2 | 16 | LAB673 | 0.820 | 1.09E−03 | 2 | 14 |
| LAB673 | 0.847 | 5.02E−04 | 2 | 15 | LAB676 | 0.807 | 1.51E−03 | 1 | 35 |
| LAB676 | 0.720 | 8.30E−03 | 1 | 14 | LAB676 | 0.701 | 1.11E−02 | 1 | 15 |
| LAB676 | 0.746 | 5.37E−03 | 3 | 35 | LAB676 | 0.754 | 4.61E−03 | 3 | 24 |
| LAB676 | 0.774 | 3.13E−03 | 2 | 25 | LAB677 | 0.708 | 1.48E−02 | 4 | 22 |
| LAB678 | 0.725 | 7.67E−03 | 3 | 24 | LAB678 | 0.792 | 2.11E−03 | 3 | 12 |
| LAB679 | 0.762 | 3.97E−03 | 1 | 38 | LAB679 | 0.855 | 7.89E−04 | 4 | 38 |
| LAB679 | 0.858 | 7.25E−04 | 4 | 37 | LAB680 | 0.723 | 7.87E−03 | 1 | 36 |
| LAB680 | 0.750 | 4.99E−03 | 2 | 38 | LAB680 | 0.738 | 6.13E−03 | 2 | 37 |
| LAB681 | 0.816 | 1.19E−03 | 2 | 35 | LAB681 | 0.753 | 7.47E−03 | 4 | 1 |
| LAB684 | 0.825 | 9.66E−04 | 1 | 20 | LAB684 | 0.719 | 8.45E−03 | 1 | 32 |
| LAB685 | 0.772 | 3.23E−03 | 1 | 35 | LAB688 | 0.876 | 1.84E−04 | 1 | 30 |
| LAB688 | 0.717 | 8.71E−03 | 1 | 25 | LAB688 | 0.712 | 9.40E−03 | 3 | 30 |
| LAB688 | 0.720 | 8.34E−03 | 3 | 25 | LAB688 | 0.815 | 2.24E−03 | 4 | 30 |
| LAB688 | 0.825 | 1.79E−03 | 4 | 25 | LAB689 | 0.758 | 6.84E−03 | 4 | 26 |
| LAB690 | 0.710 | 9.61E−03 | 3 | 30 | LAB690 | 0.889 | 1.08E−04 | 3 | 25 |
| LAB692 | 0.770 | 3.41E−03 | 2 | 30 | LAB693 | 0.850 | 4.62E−04 | 2 | 31 |
| LAB693 | 0.778 | 4.78E−03 | 4 | 25 | LAB697 | 0.810 | 1.39E−03 | 1 | 15 |
| LAB697 | 0.809 | 1.44E−03 | 1 | 1 | LAB697 | 0.706 | 1.03E−02 | 1 | 10 |
| LAB697 | 0.720 | 8.22E−03 | 3 | 24 | LAB700 | 0.737 | 6.22E−03 | 1 | 1 |
| LAB700 | 0.766 | 3.67E−03 | 3 | 27 | LAB700 | 0.816 | 1.20E−03 | 2 | 2 |
| LAB700 | 0.732 | 6.78E−03 | 2 | 9 | LAB701 | 0.742 | 5.69E−03 | 3 | 36 |
| LAB701 | 0.771 | 3.30E−03 | 3 | 26 | LAB701 | 0.751 | 7.74E−03 | 4 | 36 |
| LAB701 | 0.891 | 2.28E−04 | 4 | 26 | LAB701 | 0.795 | 3.45E−03 | 4 | 38 |
| LAB701 | 0.752 | 7.59E−03 | 4 | 37 | LAB702 | 0.724 | 7.79E−03 | 1 | 14 |
| LAB702 | 0.768 | 3.54E−03 | 1 | 15 | LAB702 | 0.717 | 8.72E−03 | 2 | 8 |
| LAB703 | 0.755 | 4.51E−03 | 1 | 28 | LAB703 | 0.756 | 4.46E−03 | 1 | 19 |
| LAB703 | 0.772 | 3.28E−03 | 1 | 8 | LAB703 | 0.769 | 3.45E−03 | 3 | 7 |
| LAB703 | 0.765 | 6.13E−03 | 4 | 1 | LAB706 | 0.740 | 9.21E−03 | 4 | 36 |
| LAB706 | 0.713 | 1.39E−02 | 4 | 26 | LAB708 | 0.702 | 1.60E−02 | 4 | 27 |
| LAB710 | 0.751 | 4.88E−03 | 3 | 26 | LAB710 | 0.738 | 6.13E−03 | 3 | 38 |

TABLE 76-continued

Correlation between the expression level of selected genes of some embodiments of the invention in various tissues and the phenotypic performance under defoliation conditions across maize varieties

| Gene Name | R | P value | Exp. set | Corr. Set ID | Gene Name | R | P value | Exp. set | Corr. Set ID |
|---|---|---|---|---|---|---|---|---|---|
| LAB712 | 0.728 | 7.29E−03 | 1 | 30 | LAB712 | 0.799 | 1.83E−03 | 2 | 12 |
| LAB712 | 0.787 | 4.06E−03 | 4 | 1 | LAB713 | 0.770 | 3.41E−03 | 1 | 33 |
| LAB713 | 0.806 | 1.54E−03 | 1 | 37 | LAB713 | 0.745 | 5.46E−03 | 2 | 16 |
| LAB713 | 0.826 | 9.24E−04 | 2 | 6 | LAB713 | 0.723 | 7.88E−03 | 2 | 19 |
| LAB713 | 0.792 | 3.65E−03 | 4 | 5 | LAB713 | 0.740 | 9.16E−03 | 4 | 4 |
| LAB713 | 0.711 | 1.42E−02 | 4 | 16 | LAB713 | 0.707 | 1.50E−02 | 4 | 33 |
| LAB713 | 0.782 | 4.44E−03 | 4 | 11 | LAB713 | 0.725 | 1.15E−02 | 4 | 9 |
| LAB713 | 0.848 | 9.74E−04 | 4 | 19 | LAB713 | 0.833 | 1.44E−03 | 4 | 18 |
| LAB713 | 0.737 | 9.63E−03 | 4 | 3 | LAB713 | 0.796 | 3.39E−03 | 4 | 10 |
| LAB713 | 0.839 | 1.25E−03 | 4 | 17 | LAB714 | 0.730 | 1.07E−02 | 4 | 27 |

Table 76. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 10

Production of Foxtail Millet Transcriptom and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K foxtail millet genes and transcripts. In order to define correlations between the levels of RNA expression and yield or vigor related parameters, various plant characteristics of 14 different foxtail millet accessions were analyzed. Among them, 11 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Fourteen foxtail millet varieties were grown in 5 repetitive plots, in field. Briefly, the growing protocol was as follows:

1. Regular growth conditions: foxtail millet plants were grown in the field using commercial fertilization and irrigation protocols, which include 283 m³ water per dunam (100 square meters) per entire growth period and fertilization of 16 units of URAN® 32% (Nitrogen Fertilizer Solution; PCS Sales, Northbrook, Ill., USA) (normal growth conditions).

2. Drought conditions: foxtail millet seeds were sown in soil and grown under normal condition until the heading stage (22 days from sowing), and then drought treatment was imposed by irrigating plants with 50% water relative to the normal treatment (171 m³ water per dunam per entire growth period).

Analyzed Foxtail millet tissues—All 15 (Above you indicated there were only 14 foxtail millet accessions) foxtail millet lines were sample per each treatment. Three tissues [leaf, flower, and stem] at 2 different developmental stages [flowering, grain filling], representing different plant characteristics were sampled and RNA was extracted as described above. Each micro-array expression information tissue type has received a Set ID as summarized in Tables 77-78 below.

TABLE 77

Foxtail millet transcriptom expression sets under drought conditions

| Expression Set | Set ID |
|---|---|
| flower: flowering stage, drought | 1 |
| leaf: flowering stage, drought | 2 |
| stem: flowering stage, drought | 3 |
| grain: grain filling stage, drought | 4 |
| leaf: grain filling stage, drought | 5 |
| stem: grain filling stage, drought | 6 |

Table 77. Provided are the barley transcriptome expression sets under drought conditions.

TABLE 78

Foxtail millet transcriptom expression sets under normal conditions

| Expression Set | Set ID |
|---|---|
| flower: flowering stage, normal | 1 |
| leaf: flowering stage, normal | 2 |
| grain: grain filling stage, normal | 4 |
| leaf: grain filling stage, normal | 5 |
| stem: grain filling stage, normal | 6 |

Table 78. Provided are the barley transcriptome expression sets under normal conditions.

Foxtail millet yield components and vigor related parameters assessment—Plants were continuously phenotyped during the growth period and at harvest (Table 80-85, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

Average Grain Area (cm$^2$)—A sample of ~200 grains was weighted, photographed and images were processed using the below described image processing system. The grain area was measured from those images and was divided by the number of grains.

Average Grain Length and width (cm)—A sample of ~200 grains was weighted, photographed and images were processed using the below described image processing system. The sum of grain lengths and width (longest axis) were measured from those images and were divided by the number of grains.

At the end of the growing period 14 'Heads' were photographed and images were processed using the below described image processing system.

Average Grain Perimeter (cm)—At the end of the growing period the grains were separated from the Plant 'Head'. A sample of ~200 grains were weighted, photographed and images were processed using the below described image processing system. The sum of grain perimeter was measured from those images and was divided by the number of grains.

Head Average Area (cm$^2$)—The 'Head' area was measured from those images and was divided by the number of 'Heads'.

Head Average Length and width (cm)—The 'Head' length and width (longest axis) were measured from those images and were divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Head weight (Kg.) and head number (num.)—At the end of the experiment, heads were harvested from each plot and were counted and weighted.

Total Grain Yield (gr.)—At the end of the experiment (plant 'Heads') heads from plots were collected, the heads were threshed and grains were weighted. In addition, the average grain weight per head was calculated by dividing the total grain weight by number of total heads per plot (based on plot).

1000 Seeds weight [gr]—weight of 1000 seeds per plot

Biomass at harvest [kg]—At the end of the experiment the vegetative portion above ground (excluding roots) from plots was weighted.

Total dry mater per plot [kg]—Calculated as Vegetative portion above ground plus all the heads dry weight per plot.

Number (num) of days to anthesis—Calculated as the number of days from sowing till 50% of the plot arrives anthesis.

Maintenance of performance under drought conditions: Represent ratio for the specified parameter of Drought condition results divided by Normal conditions results (maintenance of phenotype under drought in comparison to normal conditions).

Data parameters collected are summarized in Table 79, herein below.

TABLE 79

| Foxtail millet correlated parameters (vectors) | |
|---|---|
| Correlated parameter with | Correlation ID |
| 1000 grain weight (gr) | 1 |
| Biomass at harvest (1M) (Kg.) | 2 |
| Grain Perimeter (cm) | 3 |
| Grain area (cm$^2$) | 4 |
| Grain length (cm) | 5 |
| Grain width (cm) | 6 |
| Grains yield per Head (plot) (gr) | 7 |
| Head Area (cm$^2$) | 8 |
| Head Width (cm) | 9 |
| Head length (cm) | 10 |
| Heads num | 11 |
| Num days to Anthesis | 12 |
| Total Grains yield (gr) | 13 |
| Total dry matter (1M) (Kg.) | 14 |
| Total heads weight (Kg) | 15 |

Table 79. Provided are the foxtail millet collected parameters.

Experimental Results

Fourteen different foxtail millet accessions were grown and characterized for different parameters as described above (Table 79). The average for each of the measured parameter was calculated using the JMP software and values are summarized in Tables 80-85 below. Subsequent correlation analysis between the various transcriptom sets and the average parameters (Tables 80-85) was conducted (Tables 86-88). Follow, results were integrated to the database.

TABLE 80

Measured parameters of correlation IDs in foxtail millet accessions under drought conditions

| Line | Corr. ID | | | | | | | |
|---|---|---|---|---|---|---|---|---|
| | 1 | 2 | 3 | 4 | 5 | 6 | 7 | 8 |
| Line-1 | 2.6392 | 1.5284 | 0.6825 | 0.0333 | 0.2416 | 0.1755 | 3.0533 | 35.7477 |
| Line-2 | 3.3285 | 3.4592 | 0.7215 | 0.0373 | 0.2445 | 0.1943 | 8.8318 | 50.7137 |
| Line-3 | 2.6105 | 2.8720 | 0.6888 | 0.0335 | 0.2496 | 0.1707 | 1.3364 | 18.3997 |
| Line-4 | 2.2948 | 2.9348 | 0.6827 | 0.0319 | 0.2543 | 0.1597 | 1.0933 | 14.9379 |
| Line-5 | 2.3036 | 3.0224 | 0.6902 | 0.0326 | 0.2568 | 0.1618 | 1.3094 | 17.6865 |
| Line-6 | 2.6419 | 2.6648 | 0.6923 | 0.0334 | 0.2504 | 0.1701 | 0.4864 | 9.9107 |
| Line-7 | 2.2151 | 2.9750 | 0.6481 | 0.0297 | 0.2331 | 0.1626 | 1.6279 | 20.9859 |
| Line-8 | 1.8374 | 0.7652 | 0.5695 | 0.0238 | 0.1944 | 0.1561 | 3.7375 | 39.9290 |
| Line-9 | 2.5396 | 2.6616 | 0.6607 | 0.0317 | 0.2230 | 0.1807 | 9.9001 | 42.1487 |

TABLE 80-continued

Measured parameters of correlation IDs in foxtail millet accessions under drought conditions

| | Corr. ID | | | | | | | |
|---|---|---|---|---|---|---|---|---|
| Line | 1 | 2 | 3 | 4 | 5 | 6 | 7 | 8 |
| Line-10 | 1.6912 | 2.9464 | 0.5929 | 0.0252 | 0.2034 | 0.1581 | 4.1426 | 43.5237 |
| Line-11 | 3.0961 | 3.2304 | 0.7204 | 0.0365 | 0.2608 | 0.1782 | 2.9746 | 26.9309 |
| Line-12 | 2.5413 | 3.3032 | 0.6747 | 0.0321 | 0.2448 | 0.1665 | 1.3047 | 21.2295 |
| Line-13 | 3.2382 | 2.6316 | 0.7484 | 0.0391 | 0.2700 | 0.1842 | 0.3629 | 7.3024 |
| Line-14 | 2.2454 | 0.8856 | 0.6593 | 0.0301 | 0.2417 | 0.1586 | 1.7407 | 13.1262 |

Table 80: Correlation IDs: 1, 2, 3, 4, 5, ... etc. refer to those described in Table 79 above [Foxtail millet correlated parameters (vectors)]. Provided are the values of each of the parameters (as described above) measured in Foxtail millet accessions (line) under drought growth conditions. Growth conditions are specified in the experimental procedure section

TABLE 81

Additional measured parameters of correlation IDs in foxtail millet accessions under drought conditions

| | Corr. ID | | | | | | |
|---|---|---|---|---|---|---|---|
| Line | 9 | 10 | 11 | 12 | 13 | 14 | 15 |
| Line-1 | 1.8708 | 22.3630 | 374.4 | 34 | 1141.4938 | 0.5038 | 2.8880 |
| Line-2 | 2.6767 | 21.8851 | 127 | 41 | 1116.1782 | 0.7328 | 6.0868 |
| Line-3 | 1.3254 | 16.5045 | 737.8 | 51 | 988.2113 | 0.7984 | 5.3252 |
| Line-4 | 1.3341 | 13.3077 | 1100.8 | 41 | 1202.7733 | 0.6160 | 5.4020 |
| Line-5 | 1.5008 | 13.9981 | 1047.2 | 41 | 1360.5106 | 0.7079 | 5.5700 |
| Line-6 | 1.1661 | 9.1123 | 2050 | 30 | 995.1714 | 0.4700 | 5.2800 |
| Line-7 | 1.6655 | 15.0971 | 581.5 | 38 | 946.8482 | 0.6075 | 5.1205 |
| Line-8 | 2.1528 | 21.1335 | 311.6 | 30 | 1159.7839 | 0.3491 | 2.2884 |
| Line-9 | 2.3622 | 20.0249 | 147.2 | 38 | 1391.3882 | 0.4366 | 5.8340 |
| Line-10 | 2.3216 | 21.7995 | 95.4 | NA | 394.5104 | 0.6448 | 4.3164 |
| Line-11 | 1.5449 | 20.7968 | 414.4 | 44 | 1199.5016 | 0.7484 | 5.6392 |
| Line-12 | 1.5902 | 15.8491 | 667.8 | 51 | 872.4820 | 0.8724 | 5.1316 |
| Line-13 | 1.2536 | 6.4468 | 2441 | 31 | 873.9356 | 0.5228 | 5.1264 |
| Line-14 | 1.7376 | 9.1779 | 687.5 | 27 | 1187.9820 | 0.3605 | 2.3065 |

Table 81: Correlation IDs: 1, 2, 3, 4, 5, ... etc. refer to those described in Table 79 above [Foxtail millet correlated parameters (vectors)]. Provided are the values of each of the parameters (as described above) measured in Foxtail millet accessions (line) under drought growth conditions. Growth conditions are specified in the experimental procedure section.

TABLE 82

Measured parameters of correlation IDs in foxtail millet accessions for Maintenance of performance under drought conditions

| | Corr. ID | | | | | | |
|---|---|---|---|---|---|---|---|
| Line | 1 | 2 | 3 | 4 | 5 | 6 | 7 |
| Line-1 | 107.28492 | 63.80296 | 101.14903 | 103.09389 | 100.71910 | 102.26639 | 89.85420 |
| Line-2 | 97.44009 | 86.66199 | 100.63477 | 101.05865 | 101.13165 | 100.03126 | 121.19054 |
| Line-3 | 99.89264 | 90.61080 | 101.03545 | 102.80522 | 100.39213 | 102.38873 | 76.40597 |
| Line-4 | 97.29088 | 81.97765 | 100.28207 | 100.87451 | 100.43193 | 100.42313 | 83.95708 |
| Line-5 | 95.73134 | 84.03025 | 100.56979 | 101.56544 | 100.17700 | 101.33417 | 83.22790 |
| Line-6 | 99.52308 | 87.17613 | 99.36660 | 99.75367 | 99.50116 | 100.23080 | 70.03712 |
| Line-7 | 101.38380 | 73.57305 | 100.86771 | 101.13885 | 101.03305 | 100.21823 | 77.37223 |
| Line-8 | 102.16287 | 66.77138 | 99.64822 | 99.96068 | 99.16887 | 100.78369 | 111.74037 |
| Line-9 | 94.53807 | 83.21661 | 99.83736 | 98.88644 | 100.70881 | 98.15907 | 86.38569 |
| Line-10 | 102.69124 | 75.47131 | 101.82094 | 102.67156 | 102.00421 | 100.61236 | 57.78836 |
| Line-11 | 97.60676 | 90.15405 | 98.93543 | 97.94887 | 99.40096 | 98.50410 | 68.36558 |
| Line-12 | 97.81459 | 89.80968 | 97.98844 | 96.37703 | 97.77776 | 98.54474 | 57.64576 |
| Line-13 | 101.68636 | 89.51020 | 100.39095 | 101.18981 | 100.33465 | 100.85848 | 83.16443 |
| Line-14 | 99.50250 | 59.88639 | 99.19422 | 99.24780 | 98.98318 | 100.25762 | 132.38018 |

Table 82: Correlation IDs: 1, 2, 3, 4, 5, ... etc. refer to those described in Table 79 above [Foxtail millet correlated parameters (vectors)]. Provided are the values of each of the parameters (as described above) measured in Foxtail millet accessions (line) for maintenance of performance under drought (calculated as % of change under drought vs normal growth conditions). Growth conditions are specified in the experimental procedure section.

TABLE 83

Additional measured parameters of correlation IDs in foxtail millet accessions for Maintenance of performance under drought conditions

| Line | Corr. ID | | | | | | |
|---|---|---|---|---|---|---|---|
| | 8 | 9 | 10 | 11 | 12 | 13 | 14 |
| Line-1 | 94.50182 | 98.17799 | 96.68963 | 87.55847 | 78.74402 | 71.70254 | 75.80848 |
| Line-2 | 87.63360 | 98.29102 | 90.24976 | 85.12064 | 104.52251 | 85.76779 | 102.30604 |
| Line-3 | 93.93199 | 99.87804 | 93.97174 | 85.09804 | 64.38181 | 82.89037 | 85.90141 |
| Line-4 | 87.35732 | 98.42025 | 89.95839 | 91.42857 | 76.74662 | 66.68110 | 95.83452 |
| Line-5 | 89.50996 | 97.94159 | 91.00586 | 91.34682 | 75.80281 | 78.32485 | 88.82439 |
| Line-6 | 105.26046 | 98.75548 | 106.44273 | 96.15385 | 67.41849 | 98.01877 | 86.91644 |
| Line-7 | 91.55461 | 98.97568 | 93.88055 | 77.30657 | 59.82989 | 66.27755 | 81.03596 |
| Line-8 | 97.65054 | 101.33701 | 96.59358 | 79.04617 | 88.00374 | 77.03001 | 81.18348 |
| Line-9 | 93.05666 | 94.53334 | 98.09741 | 78.88532 | 65.27431 | 73.53882 | 80.43346 |
| Line-10 | 88.21016 | 95.66287 | 93.49773 | 72.38240 | 42.06192 | 64.63512 | 82.30493 |
| Line-11 | 97.27140 | 99.48243 | 99.65504 | 95.43989 | 63.79603 | 81.97152 | 85.75426 |
| Line-12 | 87.80382 | 100.35077 | 88.13167 | 103.31064 | 61.13590 | 84.96299 | 87.70167 |
| Line-13 | 102.45818 | 100.81763 | 101.47055 | 87.24712 | 71.85533 | 83.88960 | 91.15220 |
| Line-14 | 89.37679 | 95.46426 | 93.80683 | 69.12327 | 91.61620 | 77.76100 | 84.42533 |

Table 83: Correlation IDs: 1, 2, 3, 4, 5, . . . etc. refer to those described in Table 79 above [Foxtail millet correlated parameters (vectors)]. Provided are the values of each of the parameters (as described above) measured in Foxtail millet accessions (line) for maintenance of performance under drought (calculated as % of change under drought vs normal growth conditions). Growth conditions are specified in the experimental procedure section.

TABLE 84

Measured parameters of correlation IDs in foxtail millet accessions under normal conditions

| Line | Corr. ID | | | | | | |
|---|---|---|---|---|---|---|---|
| | 1 | 2 | 3 | 4 | 5 | 6 | 7 |
| Line-1 | 2.45995 | 2.39550 | 0.67477 | 0.03230 | 0.23989 | 0.17157 | 3.39810 |
| Line-2 | 3.41596 | 3.99160 | 0.71695 | 0.03689 | 0.24172 | 0.19428 | 7.28754 |
| Line-3 | 2.61327 | 3.16960 | 0.68170 | 0.03255 | 0.24860 | 0.16670 | 1.74902 |
| Line-4 | 2.35874 | 3.58000 | 0.68083 | 0.03161 | 0.25317 | 0.15900 | 1.30220 |
| Line-5 | 2.40635 | 3.59680 | 0.68626 | 0.03213 | 0.25634 | 0.15968 | 1.57325 |
| Line-6 | 2.65459 | 3.05680 | 0.69667 | 0.03353 | 0.25168 | 0.16966 | 0.69451 |
| Line-7 | 2.18488 | 4.04360 | 0.64249 | 0.02941 | 0.23076 | 0.16223 | 2.10395 |
| Line-8 | 1.79847 | 1.14600 | 0.57148 | 0.02386 | 0.19607 | 0.15493 | 3.34479 |
| Line-9 | 2.68629 | 3.19840 | 0.66174 | 0.03201 | 0.22145 | 0.18410 | 11.46040 |
| Line-10 | 1.64690 | 3.90400 | 0.58226 | 0.02458 | 0.19936 | 0.15712 | 7.16855 |
| Line-11 | 3.17197 | 3.58320 | 0.72818 | 0.03729 | 0.26240 | 0.18093 | 4.35102 |
| Line-12 | 2.59803 | 3.67800 | 0.68858 | 0.03326 | 0.25037 | 0.16901 | 2.26328 |
| Line-13 | 3.18446 | 2.94000 | 0.74550 | 0.03864 | 0.26910 | 0.18267 | 0.43640 |
| Line-14 | 2.25661 | 1.47880 | 0.66464 | 0.03032 | 0.24416 | 0.15822 | 1.31493 |

Table 84: Correlation IDs: 1, 2, 3, 4, 5, . . . etc. refer to those described in Table 79 above [Foxtail millet correlated parameters (vectors)]. Provided are the values of each of the parameters (as described above) measured in Foxtail millet accessions (line) under normal growth conditions. Growth conditions are specified in the experimental procedure section.

TABLE 85

Additional measured parameters of correlation IDs in foxtail millet accessions under normal conditions

| Line | Corr. ID | | | | | | |
|---|---|---|---|---|---|---|---|
| | 8 | 9 | 10 | 11 | 12 | 13 | 14 |
| Line-1 | 37.82752 | 1.90548 | 23.12861 | 427.60000 | 1449.62604 | 0.70263 | 3.80960 |
| Line-2 | 57.87014 | 2.72325 | 24.24950 | 149.20000 | 1067.88312 | 0.85440 | 5.94960 |
| Line-3 | 19.58832 | 1.32700 | 17.56325 | 867.00000 | 1534.92310 | 0.96320 | 6.19920 |
| Line-4 | 17.09980 | 1.35550 | 14.79317 | 1204.00000 | 1567.20040 | 0.92380 | 5.63680 |
| Line-5 | 19.75921 | 1.53239 | 15.38157 | 1146.40000 | 1794.80240 | 0.90380 | 6.27080 |
| Line-6 | 9.41542 | 1.18075 | 8.56073 | 2132.00000 | 1476.11048 | 0.47950 | 6.07480 |
| Line-7 | 22.92173 | 1.68275 | 16.08119 | 752.20000 | 1582.56728 | 0.91660 | 6.31880 |
| Line-8 | 40.88973 | 2.12436 | 21.87883 | 394.20000 | 1317.88024 | 0.45320 | 2.81880 |
| Line-9 | 45.29355 | 2.49875 | 20.41332 | 186.60000 | 2131.60156 | 0.59370 | 7.25320 |

TABLE 85-continued

Additional measured parameters of correlation IDs in foxtail millet accessions under normal conditions

| Line | Corr. ID | | | | | | |
|---|---|---|---|---|---|---|---|
| | 8 | 9 | 10 | 11 | 12 | 13 | 14 |
| Line-10 | 49.34091 | 2.42686 | 23.31557 | 131.80000 | 937.92760 | 0.99760 | 5.24440 |
| Line-11 | 27.68630 | 1.55289 | 20.86882 | 434.20000 | 1880.21340 | 0.91300 | 6.57600 |
| Line-12 | 24.17832 | 1.58464 | 17.98348 | 646.40000 | 1427.11884 | 1.02680 | 5.85120 |
| Line-13 | 7.12724 | 1.24343 | 6.35334 | 2797.80000 | 1216.24320 | 0.62320 | 5.62400 |
| Line-14 | 14.68632 | 1.82013 | 9.78380 | 994.60000 | 1296.69424 | 0.46360 | 2.73200 |

Table 85: Correlation IDs: 1, 2, 3, 4, 5, . . . etc. refer to those described in Table 79 above [Foxtail millet correlated parameters (vectors)]. Provided are the values of each of the parameters (as described above) measured in Foxtail millet accessions (line) under normal growth conditions. Growth conditions are specified in the experimental procedure section.

TABLE 86

Correlation between the expression level of selected genes of some embodiments of the invention in various tissues and the phenotypic performance under drought conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LAB651 | 0.808 | 8.49E−03 | 3 | 15 | LAB651 | 0.825 | 6.21E−03 | 3 | 2 |
| LAB653 | 0.726 | 1.15E−02 | 2 | 13 | LAB653 | 0.798 | 3.25E−03 | 2 | 9 |
| LAB653 | 0.810 | 2.52E−03 | 2 | 7 | LAB653 | 0.773 | 8.79E−03 | 1 | 14 |
| LAB653 | 0.778 | 8.04E−03 | 1 | 12 | LAB654 | 0.796 | 5.92E−03 | 1 | 13 |
| LAB655 | 0.754 | 1.17E−02 | 1 | 1 | LAB655 | 0.740 | 1.44E−02 | 1 | 10 |
| LAB655 | 0.775 | 8.52E−03 | 1 | 4 | LAB655 | 0.735 | 1.55E−02 | 1 | 3 |
| LAB657 | 0.701 | 3.53E−02 | 3 | 6 | LAB660 | 0.718 | 1.93E−02 | 1 | 10 |
| LAB661 | 0.709 | 2.18E−02 | 1 | 13 | LAB662 | 0.751 | 1.98E−02 | 3 | 5 |
| LAB662 | 0.799 | 9.76E−03 | 3 | 11 | LAB663 | 0.724 | 2.74E−02 | 3 | 1 |
| LAB663 | 0.758 | 1.78E−02 | 3 | 6 | LAB665 | 0.758 | 1.12E−02 | 1 | 10 |
| LAB665 | 0.739 | 1.46E−02 | 1 | 7 | LAB665 | 0.735 | 1.54E−02 | 1 | 8 |
| LAB666 | 0.715 | 1.35E−02 | 2 | 13 | LAB669 | 0.735 | 9.90E−03 | 2 | 4 |
| LAB669 | 0.733 | 1.03E−02 | 2 | 3 | LAB669 | 0.816 | 3.97E−03 | 1 | 1 |
| LAB669 | 0.835 | 2.64E−03 | 1 | 4 | LAB669 | 0.777 | 8.15E−03 | 1 | 3 |
| LAB669 | 0.739 | 1.46E−02 | 1 | 6 | LAB670 | 0.765 | 9.91E−03 | 1 | 13 |
| LAB671 | 0.715 | 1.34E−02 | 2 | 15 | LAB671 | 0.725 | 1.77E−02 | 5 | 2 |
| LAB655 | 0.744 | 1.37E−02 | 5 | 9 | LAB657 | 0.700 | 2.41E−02 | 6 | 4 |
| LAB659 | 0.848 | 3.29E−02 | 4 | 1 | LAB659 | 0.798 | 5.72E−02 | 4 | 4 |
| LAB659 | 0.717 | 1.09E−01 | 4 | 3 | LAB659 | 0.897 | 1.53E−02 | 4 | 6 |
| LAB660 | 0.838 | 3.73E−02 | 4 | 14 | LAB660 | 0.736 | 9.52E−02 | 4 | 12 |
| LAB660 | 0.729 | 1.00E−01 | 4 | 9 | LAB661 | 0.710 | 2.15E−02 | 5 | 9 |
| LAB662 | 0.895 | 1.59E−02 | 4 | 11 | LAB662 | 0.803 | 5.19E−03 | 5 | 13 |
| LAB664 | 0.843 | 3.53E−02 | 4 | 1 | LAB664 | 0.754 | 8.31E−02 | 4 | 4 |
| LAB664 | 0.762 | 7.83E−02 | 4 | 9 | LAB664 | 0.796 | 5.80E−02 | 4 | 7 |
| LAB664 | 0.899 | 1.49E−02 | 4 | 6 | LAB664 | 0.818 | 3.85E−03 | 5 | 11 |
| LAB665 | 0.755 | 1.16E−02 | 5 | 9 | LAB666 | 0.804 | 5.40E−02 | 4 | 12 |
| LAB666 | 0.707 | 2.21E−02 | 6 | 13 | LAB667 | 0.734 | 1.57E−02 | 5 | 9 |
| LAB667 | 0.702 | 2.38E−02 | 5 | 7 | LAB667 | 0.775 | 8.45E−03 | 6 | 13 |
| LAB668 | 0.823 | 3.47E−03 | 5 | 9 | LAB668 | 0.797 | 5.78E−03 | 5 | 7 |
| LAB668 | 0.726 | 1.75E−02 | 5 | 8 | LAB669 | 0.706 | 1.17E−01 | 4 | 5 |
| LAB669 | 0.936 | 5.92E−03 | 4 | 11 | LAB671 | 0.719 | 1.92E−02 | 5 | 5 |

Table 86. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 87

Correlation between the expression level of selected genes of some embodiments of the invention in various tissues and the phenotypic performance of maintenance of performance under drought conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LAB653 | 0.948 | 1.01E−04 | 3 | 13 | LAB653 | 0.788 | 1.17E−02 | 3 | 7 |
| LAB653 | 0.705 | 2.27E−02 | 1 | 11 | LAB654 | 0.723 | 1.19E−02 | 2 | 7 |
| LAB654 | 0.723 | 1.83E−02 | 1 | 13 | LAB654 | 0.770 | 9.22E−03 | 1 | 7 |
| LAB657 | 0.800 | 9.67E−03 | 3 | 7 | LAB661 | 0.744 | 8.67E−03 | 2 | 13 |
| LAB661 | 0.707 | 2.23E−02 | 1 | 13 | LAB662 | 0.821 | 3.59E−03 | 1 | 10 |
| LAB662 | 0.894 | 4.94E−04 | 1 | 8 | LAB663 | 0.882 | 1.63E−03 | 3 | 13 |
| LAB663 | 0.866 | 2.51E−03 | 3 | 7 | LAB666 | 0.878 | 1.86E−03 | 3 | 11 |
| LAB668 | 0.752 | 7.61E−03 | 2 | 5 | LAB668 | 0.863 | 1.29E−03 | 1 | 3 |
| LAB668 | 0.866 | 1.20E−03 | 1 | 4 | LAB668 | 0.773 | 8.75E−03 | 1 | 5 |
| LAB669 | 0.742 | 8.91E−03 | 2 | 13 | LAB669 | 0.709 | 1.46E−02 | 2 | 7 |
| LAB652 | 0.829 | 4.14E−02 | 4 | 1 | LAB652 | 0.849 | 3.26E−02 | 4 | 6 |
| LAB652 | 0.734 | 1.56E−02 | 5 | 6 | LAB652 | 0.800 | 5.47E−03 | 6 | 13 |
| LAB652 | 0.921 | 1.57E−04 | 6 | 7 | LAB653 | 0.756 | 8.22E−02 | 4 | 9 |
| LAB653 | 0.707 | 2.23E−02 | 6 | 13 | LAB653 | 0.710 | 2.14E−02 | 6 | 7 |
| LAB654 | 0.735 | 9.59E−03 | 4 | 1 | LAB654 | 0.940 | 5.30E−03 | 4 | 3 |
| LAB654 | 0.884 | 1.95E−02 | 4 | 5 | LAB654 | 0.735 | 1.55E−02 | 5 | 7 |
| LAB654 | 0.816 | 4.00E−03 | 6 | 13 | LAB654 | 0.792 | 6.32E−03 | 6 | 7 |
| LAB656 | 0.728 | 1.70E−02 | 5 | 13 | LAB656 | 0.784 | 7.28E−03 | 5 | 15 |
| LAB660 | 0.956 | 2.87E−03 | 4 | 3 | LAB660 | 0.838 | 3.70E−02 | 4 | 4 |
| LAB660 | 0.800 | 5.60E−02 | 4 | 7 | LAB660 | 0.900 | 1.44E−02 | 4 | 5 |
| LAB660 | 0.861 | 1.39E−03 | 6 | 3 | LAB660 | 0.872 | 1.01E−03 | 6 | 4 |
| LAB660 | 0.735 | 1.55E−02 | 6 | 5 | LAB660 | 0.872 | 1.01E−03 | 6 | 6 |
| LAB661 | 0.718 | 1.08E−01 | 4 | 1 | LAB661 | 0.815 | 4.10E−03 | 6 | 13 |
| LAB661 | 0.796 | 5.84E−03 | 6 | 7 | LAB662 | 0.832 | 3.98E−02 | 4 | 10 |
| LAB662 | 0.851 | 3.16E−02 | 4 | 11 | LAB662 | 0.811 | 5.00E−02 | 4 | 8 |
| LAB662 | 0.746 | 1.32E−02 | 6 | 6 | LAB664 | 0.860 | 2.81E−02 | 4 | 13 |
| LAB664 | 0.916 | 1.03E−02 | 4 | 7 | LAB665 | 0.856 | 1.59E−03 | 6 | 15 |
| LAB667 | 0.708 | 1.15E−01 | 4 | 1 | LAB667 | 0.731 | 9.91E−02 | 4 | 3 |
| LAB667 | 0.794 | 5.90E−02 | 4 | 4 | LAB667 | 0.718 | 1.08E−01 | 4 | 6 |
| LAB667 | 0.711 | 2.11E−02 | 6 | 3 | LAB667 | 0.771 | 9.06E−03 | 6 | 13 |
| LAB668 | 0.815 | 4.79E−02 | 4 | 4 | LAB668 | 0.836 | 2.57E−03 | 5 | 13 |
| LAB668 | 0.815 | 4.06E−03 | 5 | 7 | LAB668 | 0.727 | 1.73E−02 | 5 | 5 |
| LAB669 | 0.724 | 1.04E−01 | 4 | 10 | LAB669 | 0.770 | 7.31E−02 | 4 | 9 |
| LAB669 | 0.758 | 8.09E−02 | 4 | 6 | LAB669 | 0.779 | 6.76E−02 | 4 | 8 |
| LAB671 | 0.716 | 1.99E−02 | 5 | 2 | LAB671 | 0.715 | 2.02E−02 | 5 | 9 |

Table 87. Correlations (R) between the genes expression levels in various tissues and the phenotypic performance. "Corr. ID"—correlation set ID according to the correlated parameters Table above.
"Exp. Set"—Expression set.
"R" = Pearson correlation coefficient;
"P" = p value.

TABLE 88

Correlation between the expression level of selected genes of some embodiments of the invention in various tissues and the phenotypic performance under normal conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LAB652 | 0.730 | 1.64E−02 | 2 | 13 | LAB653 | 0.750 | 7.83E−03 | 1 | 5 |
| LAB653 | 0.786 | 4.17E−03 | 1 | 4 | LAB653 | 0.803 | 2.89E−03 | 1 | 3 |
| LAB665 | 0.734 | 1.57E−02 | 2 | 13 | LAB667 | 0.855 | 1.60E−03 | 2 | 13 |
| LAB669 | 0.724 | 1.17E−02 | 1 | 14 | LAB671 | 0.775 | 7.01E−02 | 3 | 7 |
| LAB651 | 0.812 | 1.43E−02 | 5 | 13 | LAB651 | 0.836 | 9.68E−03 | 5 | 10 |
| LAB651 | 0.748 | 3.27E−02 | 5 | 8 | LAB651 | 0.902 | 1.38E−02 | 3 | 15 |
| LAB653 | 0.739 | 3.60E−02 | 5 | 13 | LAB653 | 0.708 | 4.94E−02 | 4 | 9 |
| LAB653 | 0.807 | 1.55E−02 | 5 | 7 | LAB653 | 0.821 | 4.50E−02 | 3 | 15 |
| LAB653 | 0.746 | 8.84E−02 | 3 | 13 | LAB653 | 0.811 | 5.01E−02 | 3 | 7 |
| LAB654 | 0.759 | 8.03E−02 | 3 | 1 | LAB654 | 0.709 | 1.14E−01 | 3 | 10 |
| LAB654 | 0.931 | 6.98E−03 | 3 | 9 | LAB654 | 0.796 | 5.81E−02 | 3 | 7 |
| LAB654 | 0.906 | 1.29E−02 | 3 | 6 | LAB654 | 0.883 | 1.96E−02 | 3 | 8 |
| LAB655 | 0.747 | 3.32E−02 | 5 | 11 | LAB655 | 0.905 | 1.32E−02 | 3 | 10 |
| LAB655 | 0.814 | 4.87E−02 | 3 | 9 | LAB655 | 0.766 | 7.58E−02 | 3 | 7 |
| LAB655 | 0.818 | 4.67E−02 | 3 | 6 | LAB655 | 0.869 | 2.46E−02 | 3 | 8 |
| LAB656 | 0.777 | 6.89E−02 | 3 | 2 | LAB656 | 0.728 | 1.01E−01 | 3 | 7 |
| LAB657 | 0.727 | 1.73E−02 | 4 | 4 | LAB657 | 0.787 | 2.05E−02 | 5 | 1 |
| LAB657 | 0.786 | 2.08E−02 | 5 | 4 | LAB657 | 0.729 | 4.03E−02 | 5 | 3 |
| LAB657 | 0.723 | 4.26E−02 | 5 | 6 | LAB657 | 0.844 | 3.46E−02 | 3 | 11 |

TABLE 88-continued

Correlation between the expression level of selected genes of some embodiments of the invention in various tissues and the phenotypic performance under normal conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LAB659 | 0.829 | 4.14E−02 | 3 | 1 | LAB659 | 0.890 | 1.75E−02 | 3 | 10 |
| LAB659 | 0.711 | 1.13E−01 | 3 | 4 | LAB659 | 0.911 | 1.16E−02 | 3 | 9 |
| LAB659 | 0.913 | 1.09E−02 | 3 | 6 | LAB659 | 0.941 | 5.14E−03 | 3 | 8 |
| LAB660 | 0.899 | 1.47E−02 | 3 | 15 | LAB660 | 0.721 | 1.06E−01 | 3 | 2 |
| LAB660 | 0.815 | 4.79E−02 | 3 | 9 | LAB660 | 0.901 | 1.41E−02 | 3 | 7 |
| LAB660 | 0.737 | 9.48E−02 | 3 | 6 | LAB661 | 0.903 | 1.37E−02 | 3 | 9 |
| LAB661 | 0.941 | 5.13E−03 | 3 | 7 | LAB661 | 0.835 | 3.85E−02 | 3 | 6 |
| LAB661 | 0.803 | 5.45E−02 | 3 | 8 | LAB662 | 0.777 | 8.20E−03 | 4 | 7 |
| LAB662 | 0.739 | 1.46E−02 | 4 | 6 | LAB662 | 0.913 | 1.09E−02 | 3 | 1 |
| LAB662 | 0.779 | 6.77E−02 | 3 | 10 | LAB662 | 0.919 | 9.61E−03 | 3 | 4 |
| LAB662 | 0.864 | 2.63E−02 | 3 | 3 | LAB662 | 0.716 | 1.09E−01 | 3 | 6 |
| LAB662 | 0.714 | 1.11E−01 | 3 | 8 | LAB664 | 0.837 | 3.79E−02 | 3 | 1 |
| LAB664 | 0.745 | 8.90E−02 | 3 | 9 | LAB664 | 0.785 | 6.42E−02 | 3 | 6 |
| LAB664 | 0.734 | 9.68E−02 | 3 | 8 | LAB665 | 0.720 | 1.06E−01 | 3 | 1 |
| LAB665 | 0.847 | 3.33E−02 | 3 | 9 | LAB665 | 0.815 | 4.80E−02 | 3 | 7 |
| LAB665 | 0.792 | 6.05E−02 | 3 | 6 | LAB665 | 0.729 | 1.00E−01 | 3 | 8 |
| LAB666 | 0.737 | 3.68E−02 | 5 | 13 | LAB666 | 0.701 | 1.21E−01 | 3 | 9 |
| LAB666 | 0.818 | 4.66E−02 | 3 | 7 | LAB667 | 0.710 | 4.84E−02 | 5 | 13 |
| LAB667 | 0.832 | 1.05E−02 | 5 | 11 | LAB667 | 0.709 | 1.15E−01 | 3 | 1 |
| LAB667 | 0.789 | 6.24E−02 | 3 | 9 | LAB667 | 0.702 | 1.20E−01 | 3 | 7 |
| LAB667 | 0.757 | 8.15E−02 | 3 | 6 | LAB667 | 0.720 | 1.07E−01 | 3 | 8 |
| LAB668 | 0.739 | 1.47E−02 | 4 | 9 | LAB668 | 0.849 | 7.72E−03 | 5 | 11 |
| LAB668 | 0.872 | 2.37E−02 | 3 | 10 | LAB668 | 0.766 | 7.57E−02 | 3 | 9 |
| LAB668 | 0.728 | 1.01E−01 | 3 | 6 | LAB668 | 0.802 | 5.47E−02 | 3 | 8 |
| LAB669 | 0.835 | 3.85E−02 | 3 | 1 | LAB669 | 0.953 | 3.32E−03 | 3 | 13 |
| LAB669 | 0.827 | 4.24E−02 | 3 | 9 | LAB669 | 0.805 | 5.35E−02 | 3 | 6 |
| LAB669 | 0.753 | 8.39E−02 | 3 | 8 | LAB670 | 0.777 | 6.91E−02 | 3 | 10 |
| LAB670 | 0.801 | 5.56E−02 | 3 | 7 | LAB671 | 0.751 | 3.19E−02 | 5 | 13 |

Table 88. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 11

Production of Barley Transcriptom and High Throughput Correlation Analysis Using 44K Barley Oligonucleotide Micro-Array In order to produce a high throughput correlation analysis comparing between plant phenotype and gene expression level under normal conditions, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley tissues—Five tissues at different developmental stages [meristem, flower, booting spike, stem and flag leaf], representing different plant characteristics, were sampled and RNA was extracted as described above. Each micro-array expression information tissue type has received a Set ID as summarized in Table 89 below.

TABLE 89

Barley transcriptom expression sets

| Expression Set | Set ID |
|---|---|
| booting spike | 1 |
| flowering spike | 2 |
| meristem | 3 |
| Stem | 4 |

Table 89. Provided are the Barley transcriptom expression sets.

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 90, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 [Java based image processing program, which was developed at the U.S. National Institutes of Health and freely available on the internet

[Hypertext Transfer Protocol://rsbweb (dot) nih (dot) gov/]. Next, analyzed data was saved to text files and processed using the JMP statistical analysis software (SAS institute).

TABLE 90

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 90.

Grains per spike—At the end of the experiment (50% of the spikes were dry) all spikes from plots within blocks A-D were collected. The total number of grains from 5 spikes that were manually threshed was counted. The average grain per spike is calculated by dividing the total grain number by the number of spikes.

Grain average size (cm)—At the end of the experiment (50% of the spikes were dry) all spikes from plots within blocks A-D were collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D were collected. The total grains from 5 spikes that were manually threshed were counted and weight. The average weight was calculated by dividing the total weight by the total grain number. "Mgr"=milligrams.

Grain yield per spike (gr.)—At the end of the experiment (50% of the spikes were dry) all spikes from plots within blocks A-D were collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D were collected. The five chosen spikes per plant were measured using measuring tape excluding the awns.

Spike number analysis—At the end of the experiment (50% of the spikes were dry) all spikes from plots within blocks A-D were collected. The spikes per plant were counted.

Growth habit scoring—At the growth stage 10 (booting), each of the plants was scored for its growth habit nature. The scale that was used was 1 for prostrate nature till 9 for erect.

Hairiness of basal leaves—At the growth stage 5 (leaf sheath strongly erect; end of tillering), each of the plants was scored for its hairiness nature of the leaf before the last. The scale that was used was 1 for prostate nature till 9 for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours.

Spike yield per plant=total spike weight per plant (gr.) after drying at 30° C. in oven for 48 hours.

Harvest Index (for barley)—The harvest index is calculated using Formula XI.

Harvest Index=Average spike dry weight per plant/ (Average vegetative dry weight per plant+Average spike dry weight per plant)  Formula XI Data parameters collected are summarized in Table 91, herein below

TABLE 91

Barley correlated parameters (vectors)

| Correlated parameter with | Correlation ID |
|---|---|
| Grain weight (milligrams) | 1 |
| Grains size (mm$^2$) | 2 |
| Grains per spike (numbers) | 3 |
| Growth habit (scores 1-9) | 4 |
| Hairiness of basal leaves (scoring 1-2) | 5 |
| Plant height (cm) | 6 |
| Grain Yield per spike (gr./spike) | 7 |
| Spike length (cm) | 8 |
| Spikes per plant (number) | 9 |
| Stem pigmentation (scoring 1-5) | 10 |
| Vegetative dry weight (gram) | 11 |
| Days to flowering (days) | 12 |

Table 91. Provided are the barley correlated parameters.
"mm$^2$" square millimeters;
"gr." = Grams;
"cm" = centimeters;

Experimental Results 13 different Barley accessions were grown and characterized for parameters as described above. The average for each of the measured parameters was calculated using the JMP software and values are summarized in Table 92 below. Subsequent correlation analysis between the various transcriptom sets and the measured parameters was conducted (Table 93). Follow, results were integrated to the database.

TABLE 92

Measured parameters of correlation IDs in Barley accessions

| Line | \multicolumn{12}{c}{Corr. ID} |
|---|---|---|---|---|---|---|---|---|---|---|---|---|
| | 1 | 2 | 3 | 4 | 5 | 6 | 7 | 8 | 9 | 10 | 11 | 12 |
| Line-1 | 35.05 | 0.27 | 20.23 | 2.60 | 1.53 | 134.27 | 3.56 | 12.04 | 48.85 | 1.13 | 78.87 | 62.40 |
| Line-2 | 28.06 | 0.23 | 17.98 | 2.00 | 1.33 | 130.50 | 2.54 | 10.93 | 48.27 | 2.50 | 66.14 | 64.08 |
| Line-3 | 28.76 | 0.24 | 17.27 | 1.92 | 1.69 | 138.77 | 2.58 | 11.83 | 37.42 | 1.69 | 68.49 | 65.15 |
| Line-4 | 17.87 | 0.17 | 17.73 | 3.17 | 1.08 | 114.58 | 1.57 | 9.90 | 61.92 | 1.75 | 53.39 | 58.92 |
| Line-5 | 41.22 | 0.29 | 14.47 | 4.33 | 1.42 | 127.75 | 3.03 | 11.68 | 33.27 | 2.33 | 68.30 | 63.00 |
| Line-6 | 29.73 | 0.28 | 16.78 | 2.69 | 1.69 | 129.38 | 2.52 | 11.53 | 41.69 | 2.31 | 74.17 | 70.54 |
| Line-7 | 25.22 | 0.22 | 12.12 | 3.60 | 1.30 | 103.89 | 1.55 | 8.86 | 40.00 | 1.70 | 35.35 | 52.80 |
| Line-8 | 34.99 | 0.28 | 14.07 | 3.50 | 1.19 | 121.63 | 2.62 | 11.22 | 40.63 | 2.19 | 58.33 | 60.88 |
| Line-9 | 20.58 | 0.19 | 21.54 | 3.00 | 1.00 | 126.80 | 2.30 | 11.11 | 62.00 | 2.30 | 62.23 | 58.10 |
| Line-10 | 27.50 | 0.22 | 12.10 | 3.67 | 1.17 | 99.83 | 1.68 | 8.58 | 49.33 | 1.83 | 38.32 | 53.00 |
| Line-11 | 37.13 | 0.27 | 13.40 | 2.47 | 1.60 | 121.40 | 2.68 | 10.18 | 50.60 | 3.07 | 68.31 | 60.40 |
| Line-12 | 29.56 | 0.27 | 15.28 | 3.50 | 1.08 | 118.42 | 2.35 | 10.51 | 43.09 | 1.58 | 56.15 | 64.58 |
| Line-13 | 19.58 | 0.18 | 17.07 | 3.00 | 1.17 | 117.17 | 1.67 | 9.80 | 51.40 | 2.17 | 42.68 | 56.00 |

Table 92. Provided are the values of each of the parameters (as described above) measured in Barley accessions (line). Growth conditions are specified in the experimental procedure section

TABLE 93

Correlation between the expression level of selected LAB genes of some embodiments of the invention in various tissues and the phenotypic performance under normal fertilization conditions across barley accessions

| Gene Name | R | P value | Exp. set | Corr. Set ID | Gene Name | R | P value | Exp. set | Corr. Set ID |
|---|---|---|---|---|---|---|---|---|---|
| LAB622 | 0.83 | 2.99E−03 | 2 | 9 | LAB623 | 0.74 | 8.92E−03 | 3 | 6 |
| LAB624 | 0.78 | 4.73E−03 | 3 | 9 | LAB629 | 0.73 | 1.11E−02 | 3 | 9 |
| LAB633 | 0.83 | 1.38E−03 | 1 | 6 | LAB633 | 0.73 | 1.13E−02 | 1 | 8 |
| LAB635 | 0.74 | 8.55E−03 | 1 | 2 | LAB635 | 0.79 | 4.05E−03 | 1 | 1 |
| LAB638 | 0.83 | 1.43E−03 | 3 | 2 | LAB638 | 0.86 | 6.03E−04 | 3 | 1 |
| LAB638 | 0.78 | 4.28E−03 | 3 | 8 | LAB638 | 0.85 | 9.35E−04 | 3 | 7 |

Table 93. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value

Example 12

Production of Barley Transcriptom and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley tissues—six tissues stages [leaf, meristem, root tip, adventitious root, spike, stem] at different developmental stages [vegetative, reproductive], representing different plant characteristics, were sampled and RNA was extracted as described above. Each micro-array expression information tissue type has received a Set ID as summarized in Tables 94-96 below.

TABLE 94

Barley transcriptom expression sets under drought and recovery conditions

| Expression Set | Set ID |
|---|---|
| Booting spike under drought conditions | 1 |
| Leaf at reproductive stage under drought conditions | 2 |
| Leaf at vegetative stage under drought conditions | 3 |
| Meristem at vegetative stage under drought conditions | 4 |
| Root tip at vegetative stage under drought conditions | 5 |
| Root tip at vegetative stage under recovery from drought conditions | 6 |

Table 94. Provided are the barley transcriptome expression sets under drought and recovery conditions.

TABLE 95

Barley transcriptom expression sets under normal and low nitrogen conditions (set 1)

| Expression Set | Set ID |
|---|---|
| Adventitious roots under low nitrogen conditions | 1 |
| Adventitious roots under normal conditions | 2 |
| Leaf under low nitrogen conditions | 3 |
| Leaf under normal conditions | 4 |
| Root tip under low nitrogen conditions | 5 |
| Root tip under normal conditions | 6 |

Table 95. Provided are the barley transcriptome expression sets under normal and low nitrogen conditions (set 1 - vegetative stage).

TABLE 96

Barley transcriptom expression sets under normal and low nitrogen conditions (set 2)

| Expression Set | Set ID |
|---|---|
| Booting spike under low nitrogen conditions | 1 |
| Booting spike under normal conditions | 2 |
| Leaf under low nitrogen conditions | 3 |
| Leaf under normal conditions | 4 |
| Stem under low nitrogen conditions | 5 |
| Stem under normal conditions | 6 |

Table 96. Provided are the barley transcriptome expression sets under normal and low nitrogen conditions (set 2 - reproductive stage).

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting (as recommended for commercial growth, normal growth conditions which included irrigation 2-3 times a week, and fertilization given in the first 1.5 months of the growth period); under low Nitrogen (80% percent less Nitrogen); or under drought stress (cycles of drought and re-irrigating were conducted throughout the whole experiment, overall 40% less water were given in the drought treatment). Plants were phenotyped on a daily basis following the parameters listed in Tables 97-100 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Spikelet per spike=number of spikelets per spike was counted.

Root/Shoot Ratio—The Root/Shoot Ratio is calculated using Formula XII.

$$\text{Root/Shoot Ratio} = \text{total weight of the root at harvest/total weight of the vegetative portion above ground at harvest.} \quad \text{Formula XII}$$

Total No. of tillers—all tillers were counted per plot at two time points at the Vegetative growth (30 days after sowing) and at harvest.

Percent of reproductive tillers—the number of reproductive tillers barring a spike at harvest was divided by the total numbers o tillers.

SPAD [SPAD unit]—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area ($cm^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) is calculated according to Formula I above.

Harvest Index (for barley)—The harvest index is calculated using Formula XI above.

Relative growth rate: the relative growth rate (RGR) of Plant Height (Formula IX above), SPAD (Formula XIII below) and number of tillers (Formula XIII) are calculated as follows:

Relative growth rate of SPAD=Regression coefficient of SPAD measurements along time course.   Formula XIII Relative growth rate of Number of tillers=Regression coefficient of Number of tillers along time course (measured in units of "number of tillers/day").   Formula XIV RATIO Drought/Normal: Represent ratio for the specified parameter of Drought condition results divided by Normal conditions results (maintenance of phenotype under drought in comparison to normal conditions).

Data parameters collected are summarized in Table 97-100, hereinbelow

TABLE 97

Barley correlated parameters (vectors) under drought and recovery conditions

| Correlated parameter with | Correlation ID |
|---|---|
| Chlorophyll levels | 1 |
| Dry weight at harvest (gr) | 2 |
| Dry weight vegetative growth | 3 |
| Fresh weight (gr) | 4 |
| Grain number (num) | 5 |
| Grain weight (gr) | 6 |
| Harvest index [yield/yield + biomass] | 7 |
| Heading date (days) | 8 |
| Height Relative growth rate (cm/day) | 9 |
| Number of tillers Relative growth rate (num/day) | 10 |
| Plant height (cm) | 11 |
| Root/shoot (ratio gr root/gr shoot) | 12 |
| Relative water content (%) | 13 |
| Root dry weight (gr) | 14 |
| Root fresh weight (gr) | 15 |
| Root length (cm) | 16 |
| SPAD Relative growth rate | 17 |
| Spike length (cm) | 18 |
| Spike number (num) | 19 |
| Spike weight per plant (gr) | 20 |
| Spike width (cm) | 21 |
| Tillers number (num) | 22 |
| lateral root number (num) | 23 |

Table 97. Provided are the barley correlated parameters. ""DW" = dry weight;"

TABLE 98

Barley correlated parameters (vectors) for maintenance of performance under drought conditions

| Correlated parameter with | Correlation ID |
|---|---|
| Chlorophyll levels ratio | 1 |
| Dry weight at harvest ratio | 2 |
| Dry weight vegetative growth ratio | 3 |
| Fresh weight ratio | 4 |
| Grain number ratio | 5 |
| Grain weight ratio | 6 |
| Harvest index ratio | 7 |
| Heading date ratio | 8 |
| Plant height ratio | 9 |
| Root/shoot ratio | 10 |
| Relative water content ratio | 11 |
| Root dry weight ratio | 12 |
| Root fresh weight ratio | 13 |
| Root length ratio | 14 |
| Spike length ratio | 15 |
| Spike number ratio | 16 |
| Spike weight per plant ratio | 17 |
| Spike width ratio | 18 |
| Tillers number ratio | 19 |
| lateral root number ratio | 20 |

Table 98. Provided are the barley correlated parameters. ""DW" = dry weight; "ratio"—ratio for the specified parameter of Drought condition results divided by Normal conditions results (maintenance of phenotype under drought in comparison to normal conditions.

TABLE 99

Barley correlated parameters (vectors) under low nitrogen and normal conditions (set 1)

| Correlated parameter with | Correlation ID |
|---|---|
| Lateral Roots, Normal (num) | 1 |
| Leaf Area, Normal (mm$^2$) | 2 |
| Leaf Number, TP4, Low N (num) | 3 |
| Max Length, Normal (mm) | 4 |
| Max Width, Normal (mm) | 5 |
| Max Length (mm), TP4, Low N | 6 |
| Max Width (mm), TP4, Low N | 7 |
| No of lateral roots, Low N, TP2 (num) | 8 |
| No of tillers, Low N, TP2 (num) | 9 |
| Num Leaves, Normal (num) | 10 |
| Num Seeds, Normal (num) | 11 |
| Number of Spikes, Normal (num) | 12 |
| Num Tillers, Normal (num) | 13 |
| Plant Height, Normal (cm) | 14 |
| Plant Height (cm), Low N | 15 |
| Plant Height (cm), Low N-TP2 | 16 |
| Root FW, Normal (gr) | 17 |
| Root Length, Normal (cm) | 18 |
| Root FW (gr.), Low N, TP2 | 19 |
| Root length (cm), Low N-TP2 | 20 |
| SPAD, Normal (SPAD unit) | 21 |
| SPAD, Low N, TP2 (SPAD unit) | 22 |
| Seed Yield, Normal (gr) | 23 |
| Seed Number (per plot) Low N (num) | 24 |
| Seed Yield (gr.), Low N | 25 |
| Seed Yield (gr.), Normal | 26 |
| Shoot FW, Normal (gr) | 27 |
| Spike Length, Normal (cm) | 28 |
| Spike Width, Normal (cm) | 29 |
| Spike weight, Normal (gr) | 30 |
| Spike Length (cm) Low N | 31 |
| Spike Width (cm) Low N | 32 |
| Spike total weight (per plot) Low N (gr) | 33 |
| Total Tillers, Normal (num) | 34 |
| Total Leaf Area (mm$^2$) TP4, Low N | 35 |
| Total No of Spikes per plot Low N (num) | 36 |
| Total No of tillers per plot Low N (num) | 37 |
| shoot FW (gr.), Low N, TP2 | 38 |

Table 99. Provided are the barley correlated parameters. "TP" = time point; "DW" = dry weight; "FW" = fresh weight; "Low N" = Low Nitrogen; "Normal" = regular growth conditions. "Max" = maximum.

TABLE 100

Barley correlated parameters (vectors) under low nitrogen and normal conditions (set 2)

| Correlated parameter with | Correlation ID |
|---|---|
| Grain Perimeter (cm) | 1 |
| Grain area (cm$^2$) | 2 |
| Grain length (cm) | 3 |
| Grain width (cm) | 4 |
| Grains DW/Shoots DW (ratio) | 5 |

TABLE 100-continued

Barley correlated parameters (vectors) under low nitrogen and normal conditions (set 2)

| Correlated parameter with | Correlation ID |
|---|---|
| Grains per plot (num) | 6 |
| Grains weight per plant (gr) | 7 |
| Grains weight per plot (gr) | 8 |
| Plant Height (cm) | 9 |
| Roots DW (mg) | 10 |
| Row number (num) | 11 |
| Spikes FW (Harvest) (gr) | 12 |
| Spikes num (num) | 13 |
| Tillering (Harvest) (num) | 14 |
| Vegetative DW (Harvest) (gr) | 15 |
| percent of reproductive tillers (%) | 16 |
| shoot/root ratio (ratio) | 17 |

Table 100. Provided are the barley correlated parameters. "TP" = time point; "DW" = dry weight; "FW" = fresh weight; "Low N" = Low Nitrogen; "Normal" = regular growth conditions. "Max" = maximum.

Experimental Results 15 different Barley accessions were grown and characterized for different parameters as described above. Tables 97-100 describes the Barley correlated parameters. The average for each of the measured parameters was calculated using the JMP software and values are summarized in Tables 101-109 below. Subsequent correlation analysis between the various transcriptom sets and the average parameters (Tables 110-113) was conducted. Follow, results were integrated to the database.

TABLE 101

Measured parameters of correlation IDs in Barley accessions under drought and recovery conditions

| Line | Corr. ID | | | | | | | | | | | |
|---|---|---|---|---|---|---|---|---|---|---|---|---|
| | 1 | 2 | 3 | 4 | 5 | 6 | 7 | 8 | 9 | 10 | 11 | 12 |
| Line-1 | 41.33 | 6.15 | 0.21 | 1.90 | 170.00 | 5.55 | 0.47 | 75.00 | 0.27 | 0.07 | 46.00 | 0.01 |
| Line-2 | 33.57 | 5.05 | 0.21 | 1.52 | 267.50 | 9.80 | 0.66 | 71.00 | 0.86 | 0.10 | 52.80 | 0.01 |
| Line-3 | 36.57 | 3.20 | | 1.17 | 111.00 | 3.55 | 0.53 | 65.00 | 0.73 | 0.06 | 35.00 | 0.01 |
| Line-4 | 40.50 | 3.28 | | 1.95 | 205.33 | 7.20 | 0.69 | | 0.88 | 0.07 | 38.00 | 0.01 |
| Line-5 | 45.07 | 4.76 | | 1.90 | 153.60 | 5.28 | 0.53 | 66.75 | 0.40 | 0.16 | 45.20 | 0.03 |
| Line-6 | 39.73 | 3.55 | 0.17 | 1.22 | 252.50 | 7.75 | 0.69 | 90.00 | 0.94 | 0.06 | 48.00 | 0.02 |
| Line-7 | 38.33 | 4.52 | | 1.75 | 288.40 | 9.92 | 0.69 | 90.00 | 0.70 | 0.10 | 37.67 | 0.01 |
| Line-8 | 36.17 | 3.38 | | 1.58 | 274.50 | 10.25 | 0.75 | | 0.71 | 0.05 | 41.20 | 0.01 |
| Line-9 | 42.13 | 5.67 | 0.25 | 1.88 | 348.50 | 8.50 | 0.60 | 90.00 | 0.77 | 0.10 | 40.80 | 0.01 |
| Line-10 | 31.77 | 3.31 | | 1.73 | 358.00 | 14.03 | 0.81 | | 0.80 | 0.06 | 49.86 | 0.01 |
| Line-11 | 33.47 | 2.65 | | 1.00 | 521.39 | 17.52 | 0.87 | | 0.92 | 0.06 | 43.00 | 0.02 |
| Line-12 | 42.37 | 5.12 | 0.13 | 0.90 | 71.50 | 2.05 | 0.29 | 90.00 | 0.39 | 0.18 | 47.40 | 0.02 |
| Line-13 | 42.27 | 6.86 | 0.19 | 0.90 | 160.13 | 5.38 | 0.44 | 81.60 | 0.88 | 0.15 | 64.80 | 0.01 |
| Line-14 | 36.77 | 3.11 | 0.22 | 1.43 | 376.67 | 11.00 | 0.78 | 90.00 | −0.13 | 0.02 | 52.60 | 0.01 |
| Line-15 | 40.63 | 3.74 | | 0.83 | 105.00 | 2.56 | 0.41 | | 0.20 | 0.44 | 32.00 | 0.03 |

Table 101. Provided are the values of each of the parameters (as described above in Table 97) measured in Barley accessions (line) under drought growth conditions. Growth conditions are specified in the experimental procedure section.

TABLE 102

Additional measured parameters of correlation IDs in Barley accessions under drought and recovery conditions

| Line | Corr. ID | | | | | | | | | | |
|---|---|---|---|---|---|---|---|---|---|---|---|
| | 13 | 14 | 15 | 16 | 17 | 18 | 19 | 20 | 21 | 22 | 23 |
| Line-1 | 80.60 | 77.52 | 2.07 | 21.67 | 0.09 | 16.70 | 4.20 | 17.72 | 8.64 | 11.68 | 8.33 |
| Line-2 | 53.40 | 60.19 | 1.48 | 20.33 | −0.12 | 16.85 | 4.36 | 24.24 | 9.07 | 9.04 | 8.67 |
| Line-3 | 55.87 | 27.13 | 1.12 | 22.00 | 0.00 | 13.27 | 7.60 | 18.20 | 7.82 | 10.92 | 7.33 |
| Line-4 | | 18.62 | 1.87 | 24.00 | 0.01 | 13.55 | 8.44 | 18.00 | 7.32 | 10.16 | 7.67 |
| Line-5 | 43.21 | 117.42 | 1.67 | 20.67 | 0.04 | 14.19 | 4.92 | 19.50 | 8.74 | 10.32 | 6.67 |
| Line-6 | 69.78 | 70.72 | 1.68 | 18.33 | −0.07 | 15.64 | 3.43 | 15.00 | 7.62 | 8.78 | 6.67 |
| Line-7 | 45.49 | 37.34 | 1.62 | 21.00 | 0.01 | 15.66 | 6.90 | 23.40 | 6.98 | 13.00 | 7.67 |
| Line-8 | 76.51 | 25.56 | 0.85 | 20.33 | 0.00 | 17.49 | 5.80 | 28.16 | 8.05 | 7.44 | 6.67 |
| Line-9 | 87.41 | 66.18 | 1.45 | 21.67 | −0.06 | 16.00 | 8.55 | 21.96 | 6.06 | 13.92 | 6.00 |
| Line-10 | | 22.13 | 1.38 | 19.67 | 0.04 | 18.31 | 9.67 | 33.03 | 6.73 | 11.00 | 8.67 |
| Line-11 | | 41.12 | 0.82 | 16.67 | 0.05 | 17.42 | 5.42 | 34.80 | 9.55 | 6.78 | 7.67 |
| Line-12 | 58.32 | 116.95 | 0.58 | 17.00 | 0.00 | 14.23 | 3.05 | 11.73 | 7.84 | 8.45 | 6.33 |
| Line-13 | 80.58 | 84.10 | 0.63 | 15.17 | −0.07 | 14.81 | 4.07 | 18.78 | 7.81 | 9.15 | 7.00 |

TABLE 102-continued

Additional measured parameters of correlation IDs in Barley accessions under drought and recovery conditions

| | Corr. ID | | | | | | | | | | |
|---|---|---|---|---|---|---|---|---|---|---|---|
| Line | 13 | 14 | 15 | 16 | 17 | 18 | 19 | 20 | 21 | 22 | 23 |
| Line-14 | 73.09 | 37.46 | 1.07 | 27.00 | 0.03 | 16.54 | 3.72 | 21.00 | 8.35 | 5.12 | 7.00 |
| Line-15 | | 98.86 | 0.70 | 15.00 | −0.06 | 12.72 | 3.21 | 9.88 | 5.47 | 16.13 | 6.67 |

Table 102. Provided are the values of each of the parameters (as described above in Table 97) measured in Barley accessions (line) under drought growth conditions. Growth conditions are specified in the experimental procedure section.

TABLE 103

Measured parameters of correlation IDs in Barley accessions) for maintenance of performance under drought conditions

| | Corr. ID | | | | | | | | | |
|---|---|---|---|---|---|---|---|---|---|---|
| Line | 1 | 2 | 3 | 4 | 5 | 6 | 7 | 8 | 9 | 10 |
| Line-1 | 0.98 | 0.61 | 0.93 | 0.60 | 0.12 | 0.08 | 0.54 | 0.00 | 0.51 | 1.55 |
| Line-2 | 0.72 | 0.45 | 0.71 | 0.50 | 0.22 | 0.17 | 0.79 | 1.12 | 0.61 | 0.97 |
| Line-3 | 1.30 | 0.59 | 0.00 | 0.47 | 0.11 | 0.06 | 0.58 | 1.30 | 0.67 | 1.12 |
| Line-4 | 1.06 | 0.67 | 0.00 | 0.68 | 0.19 | 0.14 | 0.75 | 0.00 | 0.72 | 0.56 |
| Line-5 | 1.03 | 0.41 | 0.00 | 0.46 | 0.17 | 0.15 | 0.70 | 1.00 | 0.61 | 1.72 |
| Line-6 | 0.95 | 0.54 | 0.65 | 0.47 | 0.21 | 0.14 | 0.77 | 1.06 | 0.59 | 1.97 |
| Line-7 | 0.82 | 0.75 | 0.00 | 0.58 | 0.22 | 0.15 | 0.75 | 1.37 | 0.70 | 0.67 |
| Line-8 | 0.93 | 0.65 | 0.92 | 0.62 | 0.24 | 0.20 | 0.83 | 1.22 | 0.63 | 0.96 |
| Line-9 | 0.93 | 0.77 | 1.01 | 0.74 | 0.25 | 0.14 | 0.67 | 0.00 | 0.66 | 1.14 |
| Line-10 | 0.80 | 0.80 | 0.00 | | 0.58 | 0.47 | 0.92 | | 0.87 | 1.08 |
| Line-11 | 0.94 | 0.68 | 0.00 | 0.81 | 0.43 | 0.32 | 0.93 | | 0.86 | 1.38 |
| Line-12 | 0.96 | 0.42 | 0.94 | 0.72 | 0.10 | 0.07 | 0.41 | 1.20 | 0.64 | 1.84 |
| Line-13 | 1.01 | 0.65 | 0.00 | 0.37 | 0.10 | 0.07 | 0.50 | 1.00 | 0.79 | 1.31 |
| Line-14 | 0.93 | 0.52 | 0.70 | 0.40 | 0.28 | 0.20 | 0.87 | | 0.56 | 2.06 |
| Line-15 | 1.03 | 0.46 | 0.00 | | 0.43 | 0.32 | 0.82 | | 0.51 | 1.46 |

Table 103. Provided are the values of each of the parameters (as described above in Table 98) measured in Barley accessions (line) for maintenance of performance under drought (calculated as % of change under drought vs normal growth conditions). Growth conditions are specified in the experimental procedure section.

TABLE 104

Additional measured parameters of correlation IDs in Barley accessions) for maintenance of performance under drought conditions

| | Corr. ID | | | | | | | | | |
|---|---|---|---|---|---|---|---|---|---|---|
| Line | 11 | 12 | 13 | 14 | 15 | 16 | 17 | 18 | 19 | 20 |
| Line-1 | 0.78 | 0.94 | 1.10 | 0.66 | 0.83 | 0.73 | 0.16 | 0.75 | 1.87 | 1.09 |
| Line-2 | 0.58 | 0.44 | 1.00 | 0.74 | 0.82 | 0.96 | 0.23 | 0.77 | 1.57 | 0.74 |
| Line-3 | 0.90 | 0.66 | 1.02 | 1.16 | 0.86 | 1.11 | 0.19 | 0.68 | 1.72 | 0.79 |
| Line-4 | 0.00 | 0.37 | 1.67 | 0.78 | 0.77 | 1.30 | 0.23 | 0.67 | 1.80 | 0.88 |
| Line-5 | 0.65 | 0.71 | 0.80 | 0.76 | 0.78 | 0.83 | 0.25 | 0.87 | 1.60 | 0.71 |
| Line-6 | 0.56 | 1.06 | 0.81 | 0.76 | 0.94 | 0.62 | 0.18 | 0.66 | 1.61 | 0.65 |
| Line-7 | 0.78 | 0.50 | 1.13 | 0.68 | 0.83 | 0.87 | 0.23 | 0.75 | 1.63 | 0.85 |
| Line-8 | 0.83 | 0.62 | 0.34 | 0.77 | 0.89 | 1.12 | 0.34 | 0.74 | 1.59 | 0.77 |
| Line-9 | 0.50 | 0.88 | 0.85 | 1.12 | 0.78 | 1.09 | 0.22 | 0.74 | 1.75 | 0.58 |
| Line-10 | | 0.87 | 0.58 | 0.56 | 0.94 | 1.09 | 0.68 | 0.86 | 1.33 | 0.96 |
| Line-11 | 0.00 | 0.94 | 0.07 | 0.42 | 0.88 | 0.92 | 0.55 | 0.85 | 1.62 | 0.88 |
| Line-12 | 0.00 | 0.77 | 1.06 | 0.82 | 0.77 | 0.49 | 0.18 | 0.79 | 1.33 | 0.95 |
| Line-13 | 0.78 | 0.85 | 0.30 | 0.43 | 0.86 | 0.65 | 0.18 | 0.72 | 1.40 | 0.78 |
| Line-14 | 0.55 | 1.06 | 0.44 | 0.71 | 0.97 | 0.99 | 0.27 | 0.72 | 1.22 | 0.66 |
| Line-15 | | 0.68 | 0.93 | 0.80 | 0.78 | 0.52 | 0.25 | 0.88 | 1.96 | 0.87 |

Table 104. Provided are the values of each of the parameters (as described above in Table 98) measured in Barley accessions (line) for maintenance of performance under drought (calculated as % of change under drought vs normal growth conditions). Growth conditions are specified in the experimental procedure section.

TABLE 105

Measured parameters of correlation IDs in Barley accessions) under low nitrogen and normal conditions (set 1)

| Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 7.00 | 8.67 | 8.33 | 9.67 | 10.70 | 9.67 | 9.67 | 8.67 | 10.00 | 9.67 |
| 2 | 294.00 | 199.00 | 273.00 | 276.00 | 313.00 | 309.00 | 259.00 | 291.00 | 299.00 | 296.00 |
| 3 | 8.00 | 8.00 | 7.50 | 8.50 | 10.00 | 11.50 | 8.60 | 6.33 | 7.50 | 10.00 |
| 4 | 502.00 | 348.00 | 499.00 | 594.00 | 535.00 | 551.00 | 479.00 | 399.00 | 384.00 | 470.00 |
| 5 | 5.77 | 5.45 | 5.80 | 6.03 | 4.63 | 5.33 | 5.83 | 5.43 | 5.75 | 6.03 |
| 6 | 102.90 | 107.78 | 111.57 | 142.42 | 152.38 | 149.33 | 124.08 | 95.00 | 124.12 | 135.17 |
| 7 | 5.25 | 5.17 | 5.12 | 5.30 | 5.20 | 5.33 | 5.32 | 5.10 | 5.15 | 5.10 |
| 8 | 5.00 | 6.00 | 4.33 | 6.00 | 6.33 | 6.00 | 6.67 | 4.67 | 5.67 | 7.33 |
| 9 | 0.00 | 0.00 | 0.00 | 0.00 | 0.00 | 0.00 | 0.00 | 0.00 | 0.00 | 0.00 |
| 10 | 24.20 | 18.20 | 22.70 | 25.50 | 23.20 | 28.30 | 22.20 | 19.00 | 17.30 | 22.00 |
| 11 | 1090.00 | 510.00 | 242.00 | 582.00 | 621.00 | 1070.00 | 903.00 | 950.00 | 984.00 | 768.00 |
| 12 | 41.50 | 32.00 | 36.00 | 71.40 | 34.20 | 45.60 | 49.80 | 28.00 | 19.30 | 38.00 |
| 13 | 2.00 | 2.00 | 1.00 | 2.33 | 2.33 | 3.33 | 2.33 | 1.33 | 1.33 | 1.67 |
| 14 | 64.70 | 84.00 | 67.40 | 82.00 | 72.00 | 56.60 | 65.80 | 62.80 | 91.60 | 66.20 |
| 14 | 64.70 | 84.00 | 67.40 | 82.00 | 72.00 | 56.60 | 65.80 | 62.80 | 91.60 | 66.20 |
| 15 | 41.00 | 82.00 | 61.40 | 59.40 | 65.80 | 47.80 | 53.80 | 56.40 | 81.80 | 44.60 |
| 16 | 16.33 | 18.83 | 17.33 | 26.00 | 22.50 | 18.17 | 19.67 | 19.83 | 19.17 | 19.17 |
| 17 | 0.27 | 0.27 | 0.25 | 0.35 | 0.62 | 0.27 | 0.35 | 0.32 | 0.23 | 0.27 |
| 18 | 21.30 | 15.00 | 21.80 | 20.30 | 27.20 | 16.00 | 24.00 | 13.50 | 21.50 | 15.20 |
| 19 | 0.38 | 0.23 | 0.12 | 0.40 | 0.88 | 0.50 | 0.43 | 0.32 | 0.30 | 0.55 |
| 20 | 24.67 | 21.67 | 22.00 | 21.67 | 22.17 | 23.00 | 30.50 | 22.83 | 23.83 | 24.50 |
| 21 | 39.10 | 41.40 | 35.20 | 33.70 | 34.20 | 42.80 | 37.00 | 36.90 | 35.00 | 36.80 |
| 22 | 24.03 | 23.30 | 26.47 | 23.90 | 26.63 | 23.20 | 25.43 | 24.23 | 25.03 | 26.07 |
| 23 | 46.40 | 19.80 | 10.80 | 22.60 | 30.30 | 54.10 | 37.00 | 42.00 | 35.40 | 38.30 |
| 24 | 230.20 | 164.60 | 88.25 | 133.60 | 106.00 | 222.60 | 219.20 | 143.45 | 201.80 | 125.00 |
| 25 | 9.76 | 7.31 | 3.30 | 5.06 | 6.02 | 9.74 | 7.35 | 5.80 | 7.83 | 6.29 |
| 26 | 46.37 | 19.81 | 10.84 | 22.58 | 30.30 | 54.13 | 36.98 | 42.04 | 35.37 | 38.25 |
| 27 | 2.17 | 1.90 | 1.25 | 3.00 | 15.60 | 3.02 | 2.58 | 1.75 | 2.18 | 1.82 |
| 28 | 16.50 | 19.20 | 18.30 | 20.40 | 17.20 | 19.10 | 20.30 | 21.70 | 16.50 | 16.10 |
| 29 | 9.54 | 9.05 | 8.25 | 6.55 | 10.50 | 8.83 | 7.38 | 10.40 | 10.20 | 10.30 |
| 30 | 69.40 | 39.40 | 34.90 | 50.30 | 60.80 | 79.10 | 62.70 | 60.00 | 55.90 | 59.70 |
| 31 | 15.19 | 19.61 | 16.30 | 19.32 | 90.22 | 16.44 | 20.44 | 18.84 | 18.77 | 16.65 |
| 32 | 7.95 | 8.13 | 9.43 | 4.94 | 9.60 | 7.16 | 7.06 | 8.51 | 10.01 | 9.40 |
| 33 | 13.74 | 13.44 | 9.15 | 11.64 | 11.34 | 15.06 | 12.18 | 10.95 | 12.18 | 10.62 |
| 34 | 46.70 | 41.60 | 40.00 | 48.80 | 34.60 | 48.60 | 49.20 | 29.00 | 27.50 | 38.80 |
| 35 | 39.40 | 46.27 | 51.51 | 57.07 | 67.78 | 64.15 | 52.42 | 46.15 | 68.02 | 57.91 |
| 36 | 12.20 | 9.00 | 11.60 | 25.00 | 7.80 | 14.50 | 15.00 | 7.00 | 5.40 | 8.40 |
| 37 | 16.20 | 14.60 | 16.00 | 20.75 | 12.50 | 18.80 | 21.20 | 11.00 | 6.75 | 14.00 |
| 38 | 0.43 | 0.43 | 0.33 | 0.58 | 0.78 | 0.53 | 0.45 | 0.43 | 0.50 | 0.62 |

Table 105. Provided are the values of each of the parameters (as described above in Table 99) measured in Barley accessions (line) under low N and normal growth conditions. Growth conditions are specified in the experimental procedure section.

TABLE 106

Measured parameters of correlation IDs in Barley accessions) under normal conditions (set 2)

| Line | 1 | 2 | 3 | 4 | 5 | 6 | 7 | 8 | 9 |
|---|---|---|---|---|---|---|---|---|---|
| Line-1 | 2.24 | 0.25 | 0.89 | 0.35 | 0.40 | 683.40 | 6.65 | 33.24 | 76.40 |
| Line-2 | 2.24 | 0.24 | 0.87 | 0.35 | 0.16 | 510.50 | 3.96 | 19.81 | 84.00 |
| Line-3 | 2.18 | 0.24 | 0.86 | 0.35 | 1.01 | 1093.50 | 9.27 | 46.37 | 64.67 |
| Line-4 | 2.05 | 0.23 | 0.80 | 0.37 | 0.79 | 767.60 | 7.65 | 38.25 | 66.20 |
| Line-5 | 2.08 | 0.24 | 0.82 | 0.37 | 0.41 | 621.00 | 6.06 | 30.30 | 72.00 |
| Line-6 | 2.03 | 0.25 | 0.78 | 0.41 | 0.99 | 1069.00 | 10.83 | 54.13 | 56.60 |
| Line-7 | 2.25 | 0.24 | 0.90 | 0.35 | 0.66 | 987.75 | 7.94 | 39.69 | 68.00 |
| Line-8 | 1.88 | 0.22 | 0.72 | 0.39 | 0.61 | 903.20 | 7.40 | 36.98 | 65.80 |
| Line-9 | 2.09 | 0.23 | 0.82 | 0.36 | 0.28 | 581.80 | 4.52 | 22.58 | 82.00 |
| Line-10 | 2.03 | 0.22 | 0.79 | 0.36 | 1.04 | 904.40 | 8.41 | 39.68 | 62.80 |
| Line-11 | 2.02 | 0.23 | 0.80 | 0.37 | 0.12 | 242.40 | 2.00 | 10.84 | 67.40 |
| Line-12 | 1.98 | 0.21 | 0.80 | 0.34 | 0.86 | 928.40 | 8.05 | 40.26 | 76.20 |
| Line-13 | 1.69 | 0.18 | 0.65 | 0.35 | 0.58 | 984.20 | 7.07 | 35.37 | 91.60 |

TABLE 106-continued

Measured parameters of correlation IDs in Barley accessions) under normal conditions (set 2)

| Line | Corr. ID | | | | | | | | |
|---|---|---|---|---|---|---|---|---|---|
| | 1 | 2 | 3 | 4 | 5 | 6 | 7 | 8 | 9 |
| Line-14 | 1.98 | 0.19 | 0.82 | 0.29 | 0.05 | 157.67 | 0.75 | 3.73 | 44.00 |
| Line-15 | 1.89 | 0.17 | 0.77 | 0.29 | 0.08 | 263.25 | 1.14 | 5.68 | 52.75 |

Table 106. Provided are the values of each of the parameters (as described above in Table 100) measured in Barley accessions (line) under normal growth conditions. Growth conditions are specified in the experimental procedure section.

TABLE 107

Additional measured parameters of correlation IDs in Barley accessions) under normal conditions (set 2)

| Line | Corr. ID | | | | | | | |
|---|---|---|---|---|---|---|---|---|
| | 10 | 11 | 12 | 13 | 14 | 15 | 16 | 17 |
| Line-1 | 118.30 | 6.00 | 69.84 | 38.60 | 44.25 | 89.20 | 82.30 | 1.48 |
| Line-2 | 150.68 | 6.00 | 39.86 | 32.00 | 41.60 | 99.65 | 77.75 | 0.64 |
| Line-3 | 86.28 | 6.00 | 69.40 | 41.50 | 46.67 | 45.79 | 86.69 | 0.84 |
| Line-4 | 85.19 | 6.00 | 59.72 | 38.00 | 38.80 | 49.39 | 94.23 | 0.82 |
| Line-5 | 120.31 | 6.00 | 60.83 | 34.20 | 34.60 | 74.32 | 89.74 | 1.15 |
| Line-6 | 90.70 | 2.80 | 79.12 | 45.60 | 48.60 | 55.11 | 93.73 | 0.69 |
| Line-7 | 40.58 | 6.00 | 63.50 | 30.00 | 32.40 | 47.29 | 89.49 | 1.26 |
| Line-8 | 90.51 | 2.00 | 62.74 | 49.80 | 55.20 | 60.32 | 90.27 | 0.72 |
| Line-9 | 92.59 | 2.00 | 50.30 | 71.40 | 50.60 | 88.01 | 91.21 | 1.17 |
| Line-10 | 63.95 | 5.20 | 59.95 | 28.00 | 29.00 | 38.89 | 92.50 | 0.71 |
| Line-11 | 286.63 | 6.00 | 34.92 | 36.00 | 40.00 | 97.71 | 91.73 | 0.38 |
| Line-12 | 95.79 | 6.00 | 60.08 | 27.60 | 28.50 | 48.33 | 85.31 | 0.51 |
| Line-13 | 34.04 | 6.00 | 55.88 | 23.60 | 27.50 | 62.52 | | 2.16 |
| Line-14 | 121.27 | 4.67 | 16.93 | 54.67 | 26.00 | 57.97 | | 0.67 |
| Line-15 | 206.75 | 4.00 | 21.70 | 48.00 | | 72.78 | | 0.39 |

Table 107. Provided are the values of each of the parameters (as described above in Table 100) measured in Barley accessions (line) under normal growth conditions. Growth conditions are specified in the experimental procedure section.

TABLE 108

Measured parameters of correlation IDs in Barley accessions) under low nitrogen conditions (set 2)

| Line | Corr. ID | | | | | | | | |
|---|---|---|---|---|---|---|---|---|---|
| | 1 | 2 | 3 | 4 | 5 | 6 | 7 | 8 | 9 |
| Line-1 | 2.28 | 0.25 | 0.90 | 0.35 | 0.39 | 153.20 | 1.34 | 6.68 | 75.20 |
| Line-2 | 2.33 | 0.25 | 0.92 | 0.35 | 0.42 | 164.60 | 1.46 | 7.31 | 82.00 |
| Line-3 | 2.28 | 0.25 | 0.93 | 0.35 | 1.25 | 230.20 | 1.95 | 9.76 | 41.00 |
| Line-4 | 2.08 | 0.24 | 0.82 | 0.36 | 0.69 | 125.00 | 1.26 | 6.29 | 44.60 |
| Line-5 | 2.13 | 0.25 | 0.86 | 0.37 | 0.43 | 100.00 | 1.13 | 5.67 | 65.80 |
| Line-6 | 1.96 | 0.23 | 0.76 | 0.38 | 0.87 | 222.60 | 1.95 | 9.74 | 47.80 |
| Line-7 | 2.09 | 0.23 | 0.83 | 0.35 | 0.77 | 159.40 | 1.28 | 6.40 | 60.60 |
| Line-8 | 1.88 | 0.21 | 0.73 | 0.36 | 0.53 | 219.20 | 1.47 | 7.35 | 53.80 |
| Line-9 | 2.19 | 0.23 | 0.86 | 0.35 | 0.34 | 133.60 | 0.98 | 5.06 | 59.40 |
| Line-10 | 1.88 | 0.20 | 0.73 | 0.35 | 0.87 | 134.40 | 1.16 | 5.43 | 56.40 |
| Line-11 | 2.03 | 0.22 | 0.81 | 0.35 | 0.15 | 88.25 | 0.92 | 4.62 | 61.40 |
| Line-12 | 2.11 | 0.23 | 0.85 | 0.35 | 0.58 | 174.25 | 1.33 | 6.67 | 65.60 |
| Line-13 | 1.77 | 0.19 | 0.68 | 0.36 | 0.76 | 201.80 | 1.57 | 7.83 | 81.80 |
| Line-14 | 2.00 | 0.19 | 0.81 | 0.29 | 0.05 | 86.67 | 0.29 | 1.44 | 69.00 |
| Line-15 | 1.90 | 0.17 | 0.79 | 0.27 | 0.07 | 61.60 | 0.22 | 1.12 | 57.40 |

Table 108. Provided are the values of each of the parameters (as described above in Table 100) measured in Barley accessions (line) under low N growth conditions. Growth conditions are specified in the experimental procedure section.

TABLE 109

Additional measured parameters of correlation IDs in Barley accessions) under low nitrogen conditions (set 2)

| Ecotype | 10 | 11 | 12 | 13 | 14 | 15 | 16 | 17 |
|---|---|---|---|---|---|---|---|---|
| Line-1 | 39.91 | 6 | 11.4 | 10.8 | 16 | 17.42 | 68.68 | 0.69 |
| Line-2 | 26.24 | 6 | 13.44 | 9 | 14.6 | 17.76 | 61.85 | 1.08 |
| Line-3 | 17.31 | 6 | 13.74 | 12.2 | 16.2 | 8.248 | 76.94 | 0.77 |
| Line-4 | 32.91 | 6 | 10.62 | 8.4 | 14 | 7.275 | 59.63 | 0.38 |
| Line-5 | 33.87 | 6 | 11.34 | 7.8 | 12.5 | 13.25 | 65.63 | 0.83 |
| Line-6 | 83.84 | 2 | 15.06 | 14.5 | 18.8 | 11.318 | 79.84 | 0.42 |
| Line-7 | 29.65 | 6 | 11.64 | 8.4 | 11.6 | 8.95 | 73.85 | 0.28 |
| Line-8 | 37.21 | 2 | 12.18 | 15 | 21.2 | 14.18 | 71.01 | 0.57 |
| Line-9 | 44.38 | 2 | 11.64 | 25 | 23.5 | 15.678 | 95.83 | 0.60 |
| Line-10 | 14.46 | 5.2 | 8.76 | 7 | 11 | 6.418 | 64.87 | 0.55 |
| Line-11 | 41.54 | 6 | 9.15 | 11.6 | 16 | 55.92 | 68.75 | 2.88 |
| Line-12 | 23.75 | 6 | 12.42 | 7.6 | 10.75 | 11.54 | 74.24 | 1.36 |
| Line-13 | 20.87 | 6 | 12.18 | 5.4 | 6.75 | 10.88 | 81.40 | 0.89 |
| Line-14 | 49.69 | 2 | 5.68 | 16.4 | 35 | 58.92 | 37.14 | 2.49 |
| Line-15 | 54.02 | 2 | 5.04 | 12 | | 17.05 | | 0.40 |

Table 109. Provided are the values of each of the parameters (as described above in Table 100) measured in Barley accessions (line) under low N growth conditions. Growth conditions are specified in the experimental procedure section.

TABLE 110

Correlation between the expression level of selected LAB genes of some embodiments of the invention in various tissues and the phenotypic performance under drought stress conditions across Barley accessions

| Gene Name | R | P value | Exp. set | Corr. Set ID | Gene Name | R | P value | Exp. set | Corr. Set ID |
|---|---|---|---|---|---|---|---|---|---|
| LAB620 | 0.93 | 7.86E−04 | 3 | 11 | LAB620 | 0.73 | 1.02E−01 | 5 | 13 |
| LAB620 | 0.76 | 1.68E−02 | 4 | 17 | LAB621 | 0.75 | 8.35E−02 | 1 | 18 |
| LAB621 | 0.73 | 1.01E−01 | 1 | 6 | LAB621 | 0.96 | 2.43E−03 | 1 | 11 |
| LAB621 | 0.81 | 5.21E−02 | 1 | 20 | LAB621 | 0.79 | 1.92E−02 | 3 | 17 |
| LAB621 | 0.85 | 1.44E−02 | 2 | 19 | LAB621 | 0.72 | 6.87E−02 | 2 | 16 |
| LAB621 | 0.91 | 4.29E−03 | 2 | 4 | LAB621 | 0.78 | 3.97E−02 | 2 | 15 |
| LAB622 | 0.75 | 8.66E−02 | 1 | 18 | LAB622 | 0.85 | 3.37E−02 | 1 | 11 |
| LAB622 | 0.73 | 1.01E−01 | 1 | 20 | LAB622 | 0.83 | 1.13E−02 | 3 | 19 |
| LAB622 | 0.74 | 2.38E−02 | 6 | 16 | LAB622 | 0.89 | 2.81E−03 | 5 | 19 |
| LAB622 | 0.77 | 2.69E−02 | 5 | 22 | LAB622 | 0.78 | 2.13E−02 | 5 | 16 |
| LAB623 | 0.88 | 3.85E−03 | 3 | 11 | LAB623 | 0.73 | 6.32E−02 | 2 | 11 |
| LAB623 | 0.72 | 4.27E−02 | 5 | 11 | LAB624 | 0.88 | 8.42E−03 | 2 | 12 |
| LAB624 | 0.95 | 2.23E−04 | 5 | 17 | LAB624 | 0.74 | 2.34E−02 | 4 | 19 |
| LAB624 | 0.72 | 2.73E−02 | 4 | 17 | LAB625 | 0.83 | 4.28E−02 | 1 | 18 |
| LAB625 | 0.78 | 6.49E−02 | 1 | 6 | LAB625 | 0.85 | 3.40E−02 | 1 | 20 |
| LAB625 | 0.76 | 4.79E−02 | 2 | 6 | LAB625 | 0.75 | 5.05E−02 | 2 | 11 |
| LAB625 | 0.79 | 3.47E−02 | 2 | 20 | LAB625 | 0.79 | 1.99E−02 | 5 | 14 |
| LAB625 | 0.79 | 6.29E−02 | 5 | 8 | LAB626 | 0.82 | 4.75E−02 | 1 | 7 |
| LAB626 | 0.81 | 5.14E−02 | 1 | 18 | LAB626 | 0.81 | 5.01E−02 | 1 | 6 |
| LAB626 | 0.91 | 1.29E−02 | 1 | 11 | LAB626 | 0.93 | 7.31E−03 | 1 | 20 |
| LAB626 | 0.80 | 3.15E−02 | 2 | 21 | LAB626 | 0.72 | 6.97E−02 | 2 | 12 |
| LAB626 | 0.77 | 2.43E−02 | 5 | 18 | LAB626 | 0.79 | 3.52E−02 | 4 | 13 |
| LAB626 | 0.76 | 1.76E−02 | 4 | 14 | LAB626 | 0.92 | 4.09E−04 | 4 | 1 |
| LAB627 | 0.77 | 2.58E−02 | 3 | 12 | LAB627 | 0.86 | 5.76E−03 | 3 | 14 |
| LAB627 | 0.79 | 2.10E−02 | 5 | 14 | LAB627 | 0.79 | 1.06E−02 | 4 | 14 |
| LAB628 | 0.79 | 5.95E−02 | 1 | 23 | LAB628 | 0.76 | 7.98E−02 | 1 | 6 |
| LAB628 | 0.81 | 4.93E−02 | 1 | 11 | LAB628 | 0.76 | 7.93E−02 | 1 | 20 |
| LAB628 | 0.76 | 4.57E−02 | 2 | 6 | LAB628 | 0.83 | 1.08E−02 | 5 | 17 |
| LAB628 | 0.79 | 1.06E−02 | 4 | 19 | LAB629 | 0.74 | 9.54E−02 | 1 | 21 |
| LAB629 | 0.74 | 3.71E−02 | 3 | 21 | LAB629 | 0.78 | 4.07E−02 | 6 | 13 |
| LAB630 | 0.75 | 8.48E−02 | 1 | 21 | LAB630 | 0.80 | 3.16E−02 | 2 | 7 |
| LAB630 | 0.81 | 2.73E−02 | 2 | 17 | LAB630 | 0.72 | 6.81E−02 | 2 | 20 |
| LAB630 | 0.87 | 4.50E−03 | 5 | 19 | LAB630 | 0.78 | 2.19E−02 | 5 | 22 |
| LAB630 | 0.79 | 2.05E−02 | 5 | 4 | LAB630 | 0.84 | 5.09E−03 | 4 | 19 |
| LAB631 | 0.81 | 5.14E−02 | 1 | 10 | LAB631 | 0.82 | 4.39E−02 | 1 | 12 |
| LAB631 | 0.83 | 4.25E−02 | 1 | 2 | LAB631 | 0.82 | 4.36E−02 | 1 | 14 |
| LAB631 | 0.85 | 8.05E−03 | 3 | 11 | LAB631 | 0.84 | 4.26E−03 | 6 | 23 |
| LAB631 | 0.80 | 5.86E−02 | 5 | 13 | LAB631 | 0.76 | 1.72E−02 | 4 | 11 |
| LAB631 | 0.71 | 3.31E−02 | 4 | 14 | LAB633 | 0.75 | 8.53E−02 | 1 | 17 |
| LAB633 | 0.70 | 7.87E−02 | 3 | 13 | LAB633 | 0.71 | 4.70E−02 | 3 | 12 |
| LAB633 | 0.75 | 3.36E−02 | 3 | 14 | LAB633 | 0.73 | 4.05E−02 | 3 | 1 |
| LAB633 | 0.77 | 4.14E−02 | 3 | 8 | LAB633 | 0.74 | 5.97E−02 | 6 | 13 |
| LAB633 | 0.75 | 5.08E−02 | 2 | 7 | LAB633 | 0.71 | 7.38E−02 | 2 | 23 |
| LAB633 | 0.75 | 5.35E−02 | 2 | 17 | LAB634 | 0.94 | 1.57E−03 | 3 | 8 |
| LAB634 | 0.84 | 4.41E−03 | 6 | 5 | LAB634 | 0.81 | 8.50E−03 | 6 | 6 |
| LAB634 | 0.85 | 1.60E−02 | 6 | 8 | LAB634 | 0.72 | 2.93E−02 | 6 | 20 |
| LAB634 | 0.78 | 2.22E−02 | 5 | 17 | LAB634 | 0.83 | 5.37E−03 | 4 | 7 |
| LAB634 | 0.80 | 1.03E−02 | 4 | 5 | LAB634 | 0.84 | 4.42E−03 | 4 | 6 |
| LAB634 | 0.88 | 1.58E−03 | 4 | 20 | LAB635 | 0.81 | 5.08E−02 | 1 | 10 |
| LAB635 | 0.83 | 1.05E−02 | 3 | 11 | LAB635 | 0.77 | 4.49E−02 | 6 | 13 |
| LAB635 | 0.78 | 3.78E−02 | 2 | 7 | LAB635 | 0.81 | 2.87E−02 | 2 | 21 |

TABLE 110-continued

Correlation between the expression level of selected LAB genes of some embodiments of the invention in various tissues and the phenotypic performance under drought stress conditions across Barley accessions

| Gene Name | R | P value | Exp. set | Corr. Set ID | Gene Name | R | P value | Exp. set | Corr. Set ID |
|---|---|---|---|---|---|---|---|---|---|
| LAB635 | 0.83 | 2.23E−02 | 2 | 5 | LAB635 | 0.89 | 7.33E−03 | 2 | 6 |
| LAB635 | 0.80 | 3.26E−02 | 2 | 12 | LAB635 | 0.87 | 1.05E−02 | 2 | 20 |
| LAB635 | 0.73 | 3.95E−02 | 5 | 9 | LAB635 | 0.83 | 1.03E−02 | 5 | 11 |
| LAB635 | 0.83 | 1.09E−02 | 5 | 14 | LAB635 | 0.76 | 1.86E−02 | 4 | 11 |
| LAB636 | 0.73 | 1.01E−01 | 1 | 7 | LAB636 | 0.88 | 2.02E−02 | 1 | 11 |
| LAB636 | 0.70 | 3.53E−02 | 6 | 2 | LAB636 | 0.73 | 6.24E−02 | 2 | 16 |
| LAB636 | 0.70 | 5.21E−02 | 5 | 4 | LAB636 | 0.76 | 1.83E−02 | 4 | 19 |
| LAB636 | 0.85 | 3.51E−03 | 4 | 22 | LAB637 | 0.75 | 8.83E−02 | 1 | 7 |
| LAB637 | 0.88 | 2.15E−02 | 1 | 18 | LAB637 | 0.72 | 1.10E−01 | 1 | 6 |
| LAB637 | 0.86 | 2.63E−02 | 1 | 20 | LAB637 | 0.83 | 1.09E−02 | 3 | 21 |
| LAB637 | 0.78 | 3.80E−02 | 6 | 8 | LAB637 | 0.70 | 3.43E−02 | 4 | 10 |
| LAB637 | 0.85 | 4.12E−03 | 4 | 11 | LAB637 | 0.74 | 2.15E−02 | 4 | 14 |
| LAB638 | 0.94 | 5.44E−03 | 1 | 23 | LAB638 | 0.76 | 7.94E−02 | 1 | 6 |
| LAB638 | 0.86 | 2.91E−02 | 1 | 11 | LAB638 | 0.75 | 8.53E−02 | 1 | 17 |
| LAB638 | 0.81 | 5.11E−02 | 1 | 20 | LAB638 | 0.79 | 1.95E−02 | 3 | 12 |
| LAB638 | 0.86 | 3.26E−03 | 6 | 11 | LAB638 | 0.79 | 3.46E−02 | 2 | 23 |
| LAB638 | 0.86 | 1.24E−02 | 2 | 11 | LAB638 | 0.70 | 5.13E−02 | 5 | 23 |
| LAB638 | 0.75 | 3.36E−02 | 5 | 11 | LAB638 | 0.73 | 4.00E−02 | 5 | 14 |
| LAB640 | 0.93 | 7.87E−03 | 1 | 12 | LAB640 | 0.83 | 3.97E−02 | 1 | 2 |
| LAB640 | 0.93 | 8.06E−03 | 1 | 14 | LAB640 | 0.84 | 1.92E−02 | 3 | 13 |
| LAB640 | 0.81 | 1.50E−02 | 3 | 1 | LAB640 | 0.70 | 3.53E−02 | 6 | 5 |
| LAB640 | 0.77 | 4.40E−02 | 2 | 21 | LAB640 | 0.71 | 7.22E−02 | 2 | 6 |
| LAB640 | 0.71 | 7.13E−02 | 2 | 17 | LAB640 | 0.82 | 2.47E−02 | 2 | 14 |
| LAB640 | 0.84 | 5.08E−03 | 4 | 17 | LAB641 | 0.93 | 7.87E−03 | 1 | 12 |
| LAB641 | 0.83 | 3.97E−02 | 1 | 2 | LAB641 | 0.93 | 8.06E−03 | 1 | 14 |
| LAB641 | 0.84 | 1.92E−02 | 3 | 13 | LAB641 | 0.81 | 1.50E−02 | 3 | 1 |
| LAB641 | 0.78 | 1.29E−02 | 6 | 10 | LAB641 | 0.79 | 1.10E−02 | 6 | 11 |
| LAB641 | 0.82 | 2.53E−02 | 2 | 21 | LAB641 | 0.84 | 1.80E−02 | 2 | 12 |
| LAB641 | 0.82 | 2.47E−02 | 2 | 14 | LAB641 | 0.71 | 3.20E−02 | 4 | 19 |
| LAB641 | 0.84 | 5.08E−03 | 4 | 17 | LAB642 | 0.76 | 8.10E−02 | 1 | 10 |
| LAB642 | 0.78 | 2.11E−02 | 3 | 11 | LAB642 | 0.79 | 1.96E−02 | 3 | 2 |
| LAB642 | 0.71 | 5.08E−02 | 3 | 14 | LAB642 | 0.82 | 6.39E−03 | 6 | 20 |
| LAB642 | 0.77 | 2.65E−02 | 5 | 10 | LAB642 | 0.77 | 2.58E−02 | 5 | 11 |
| LAB642 | 0.74 | 3.71E−02 | 5 | 2 | LAB644 | 0.81 | 1.50E−02 | 3 | 14 |
| LAB644 | 0.75 | 1.93E−02 | 6 | 5 | LAB644 | 0.81 | 2.66E−02 | 2 | 5 |
| LAB644 | 0.71 | 7.10E−02 | 2 | 6 | LAB644 | 0.71 | 7.41E−02 | 2 | 11 |
| LAB644 | 0.71 | 7.62E−02 | 2 | 20 | LAB644 | 0.81 | 1.50E−02 | 5 | 11 |
| LAB644 | 0.71 | 4.78E−02 | 5 | 2 | LAB644 | 0.93 | 8.47E−04 | 5 | 14 |
| LAB644 | 0.77 | 4.41E−02 | 4 | 13 | LAB644 | 0.73 | 2.68E−02 | 4 | 14 |
| LAB645 | 0.84 | 3.59E−02 | 1 | 18 | LAB645 | 0.77 | 7.41E−02 | 1 | 6 |
| LAB645 | 0.95 | 4.39E−03 | 1 | 11 | LAB645 | 0.90 | 1.40E−02 | 1 | 20 |
| LAB645 | 0.84 | 8.53E−03 | 3 | 19 | LAB645 | 0.75 | 3.24E−02 | 3 | 20 |
| LAB645 | 0.87 | 1.14E−02 | 2 | 11 | LAB645 | 0.71 | 1.14E−01 | 5 | 13 |
| LAB645 | 0.70 | 5.26E−02 | 5 | 17 | LAB645 | 0.75 | 3.32E−02 | 5 | 20 |
| LAB645 | 0.77 | 1.49E−02 | 4 | 17 | LAB647 | 0.76 | 2.86E−02 | 3 | 2 |
| LAB647 | 0.76 | 1.66E−02 | 6 | 17 | LAB647 | 0.78 | 1.28E−02 | 6 | 20 |
| LAB647 | 0.82 | 1.29E−02 | 5 | 10 | | | | | |

Table 110. Correlations (R) between the genes expression levels in various tissues and the phenotypic performance.
"Corr. ID"—correlation set ID according to the correlated parameters Table 97 above.
"Exp. Set"—Expression set.
"R" = Pearson correlation coefficient;
"P" = p value.

TABLE 111

Correlation between the expression level of selected genes of some embodiments of the invention in various tissues and the phenotypic performance of maintenance of performance under drought conditions across Barley accessions

| Gene Name | R | P value | Exp. set | Corr. Set ID | Gene Name | R | P value | Exp. set | Corr. Set ID |
|---|---|---|---|---|---|---|---|---|---|
| LAB620 | 0.70 | 3.47E−02 | 6 | 15 | LAB620 | 0.73 | 3.91E−02 | 5 | 1 |
| LAB620 | 0.71 | 4.96E−02 | 5 | 12 | LAB620 | 0.74 | 2.31E−02 | 4 | 20 |
| LAB621 | 0.91 | 1.24E−02 | 1 | 6 | LAB621 | 0.92 | 9.67E−03 | 1 | 17 |
| LAB621 | 0.91 | 1.06E−02 | 1 | 5 | LAB621 | 0.70 | 1.21E−01 | 1 | 9 |
| LAB621 | 0.81 | 5.03E−02 | 1 | 18 | LAB621 | 0.71 | 1.12E−01 | 1 | 7 |
| LAB621 | 0.78 | 1.36E−02 | 6 | 3 | LAB621 | 0.74 | 3.43E−02 | 5 | 10 |
| LAB621 | 0.78 | 2.20E−02 | 5 | 15 | LAB621 | 0.76 | 2.73E−02 | 5 | 12 |

TABLE 111-continued

Correlation between the expression level of selected genes of some embodiments of the invention in various tissues and the phenotypic performance of maintenance of performance under drought conditions across Barley accessions

| Gene Name | R | P value | Exp. set | Corr. Set ID | Gene Name | R | P value | Exp. set | Corr. Set ID |
|---|---|---|---|---|---|---|---|---|---|
| LAB622 | 0.72 | 1.05E−01 | 1 | 6 | LAB622 | 0.74 | 9.15E−02 | 1 | 17 |
| LAB622 | 0.74 | 9.54E−02 | 1 | 5 | LAB622 | 0.75 | 8.53E−02 | 1 | 12 |
| LAB622 | 0.88 | 1.65E−03 | 6 | 13 | LAB622 | 0.75 | 3.20E−02 | 5 | 16 |
| LAB622 | 0.70 | 3.49E−02 | 4 | 2 | LAB624 | 0.70 | 5.25E−02 | 5 | 6 |
| LAB624 | 0.80 | 1.64E−02 | 5 | 17 | LAB624 | 0.75 | 3.21E−02 | 5 | 20 |
| LAB624 | 0.71 | 4.78E−02 | 5 | 5 | LAB624 | 0.77 | 2.61E−02 | 5 | 9 |
| LAB624 | 0.92 | 4.27E−04 | 4 | 2 | LAB625 | 0.71 | 1.13E−01 | 1 | 15 |
| LAB625 | 0.83 | 4.25E−02 | 1 | 18 | LAB625 | 0.85 | 7.79E−03 | 3 | 15 |
| LAB625 | 0.85 | 1.55E−02 | 2 | 6 | LAB625 | 0.88 | 9.85E−03 | 2 | 17 |
| LAB625 | 0.89 | 7.73E−03 | 2 | 5 | LAB625 | 0.91 | 4.50E−03 | 2 | 9 |
| LAB625 | 0.92 | 3.75E−03 | 2 | 18 | LAB625 | 0.70 | 7.77E−02 | 2 | 12 |
| LAB626 | 0.95 | 3.59E−03 | 1 | 6 | LAB626 | 0.98 | 6.55E−04 | 1 | 17 |
| LAB626 | 0.86 | 2.62E−02 | 1 | 15 | LAB626 | 0.90 | 1.39E−02 | 1 | 5 |
| LAB626 | 0.73 | 9.99E−02 | 1 | 9 | LAB626 | 0.86 | 2.79E−02 | 1 | 18 |
| LAB626 | 0.86 | 2.72E−02 | 1 | 7 | LAB626 | 0.73 | 9.63E−02 | 2 | 4 |
| LAB627 | 0.77 | 4.28E−02 | 2 | 16 | LAB627 | 0.76 | 2.83E−02 | 5 | 3 |
| LAB628 | 0.91 | 1.25E−02 | 1 | 6 | LAB628 | 0.90 | 1.48E−02 | 1 | 17 |
| LAB628 | 0.91 | 1.17E−02 | 1 | 5 | LAB628 | 0.93 | 7.36E−03 | 1 | 9 |
| LAB628 | 0.89 | 1.72E−02 | 1 | 18 | LAB628 | 0.70 | 1.20E−01 | 1 | 7 |
| LAB628 | 0.70 | 7.74E−02 | 2 | 9 | LAB628 | 0.74 | 5.81E−02 | 2 | 18 |
| LAB628 | 0.88 | 3.52E−03 | 5 | 20 | LAB628 | 0.77 | 2.50E−02 | 5 | 9 |
| LAB628 | 0.74 | 2.18E−02 | 4 | 17 | LAB628 | 0.71 | 3.19E−02 | 4 | 5 |
| LAB628 | 0.75 | 2.04E−02 | 4 | 9 | LAB628 | 0.89 | 1.42E−03 | 4 | 2 |
| LAB629 | 0.77 | 4.27E−02 | 2 | 1 | LAB629 | 0.85 | 7.14E−03 | 5 | 1 |
| LAB630 | 0.78 | 6.75E−02 | 1 | 16 | LAB630 | 0.73 | 1.02E−01 | 1 | 1 |
| LAB630 | 0.76 | 2.80E−02 | 3 | 6 | LAB630 | 0.74 | 3.67E−02 | 3 | 17 |
| LAB630 | 0.73 | 3.78E−02 | 3 | 15 | LAB630 | 0.81 | 2.62E−02 | 6 | 8 |
| LAB630 | 0.79 | 3.52E−02 | 2 | 6 | LAB630 | 0.86 | 1.34E−02 | 2 | 17 |
| LAB630 | 0.74 | 5.66E−02 | 2 | 20 | LAB630 | 0.73 | 6.02E−02 | 2 | 5 |
| LAB630 | 0.81 | 2.55E−02 | 2 | 9 | LAB630 | 0.80 | 2.98E−02 | 2 | 7 |
| LAB630 | 0.82 | 1.29E−02 | 5 | 2 | LAB631 | 0.80 | 5.37E−02 | 1 | 3 |
| LAB631 | 0.76 | 1.80E−02 | 6 | 20 | LAB631 | 0.80 | 5.85E−02 | 2 | 11 |
| LAB633 | 0.81 | 5.28E−02 | 1 | 20 | LAB633 | 0.80 | 3.11E−02 | 2 | 20 |
| LAB633 | 0.78 | 3.92E−02 | 2 | 7 | LAB633 | 0.78 | 2.36E−02 | 5 | 15 |
| LAB633 | 0.75 | 3.05E−02 | 5 | 12 | LAB634 | 0.72 | 4.59E−02 | 5 | 17 |
| LAB634 | 0.75 | 3.22E−02 | 5 | 9 | LAB634 | 0.76 | 1.79E−02 | 4 | 6 |
| LAB634 | 0.79 | 1.19E−02 | 4 | 17 | LAB634 | 0.78 | 1.26E−02 | 4 | 5 |
| LAB634 | 0.75 | 3.07E−02 | 4 | 4 | LAB634 | 0.78 | 1.22E−02 | 4 | 18 |
| LAB634 | 0.82 | 6.36E−03 | 4 | 7 | LAB635 | 0.81 | 2.57E−02 | 2 | 6 |
| LAB635 | 0.88 | 9.29E−03 | 2 | 17 | LAB635 | 0.85 | 1.58E−02 | 2 | 5 |
| LAB635 | 0.92 | 3.79E−03 | 2 | 9 | LAB635 | 0.91 | 4.27E−03 | 2 | 18 |
| LAB635 | 0.77 | 4.13E−02 | 2 | 7 | LAB635 | 0.72 | 6.91E−02 | 2 | 12 |
| LAB636 | 0.75 | 8.43E−02 | 1 | 16 | LAB636 | 0.83 | 4.32E−02 | 1 | 6 |
| LAB636 | 0.82 | 4.56E−02 | 1 | 17 | LAB636 | 0.80 | 5.42E−02 | 1 | 5 |
| LAB636 | 0.77 | 7.17E−02 | 1 | 7 | LAB636 | 0.77 | 7.60E−02 | 1 | 3 |
| LAB636 | 0.73 | 6.28E−02 | 2 | 16 | LAB636 | 0.79 | 3.56E−02 | 2 | 1 |
| LAB636 | 0.94 | 1.58E−03 | 2 | 14 | LAB637 | 0.71 | 1.12E−01 | 1 | 15 |
| LAB637 | 0.76 | 8.18E−02 | 1 | 7 | LAB638 | 0.94 | 5.27E−03 | 1 | 6 |
| LAB638 | 0.95 | 3.71E−03 | 1 | 17 | LAB638 | 0.77 | 7.20E−02 | 1 | 15 |
| LAB638 | 0.82 | 4.76E−02 | 1 | 20 | LAB638 | 0.93 | 6.87E−03 | 1 | 5 |
| LAB638 | 0.95 | 3.32E−03 | 1 | 9 | LAB638 | 0.90 | 1.50E−02 | 1 | 18 |
| LAB638 | 0.73 | 9.99E−02 | 1 | 7 | LAB638 | 0.75 | 3.15E−02 | 3 | 6 |
| LAB638 | 0.75 | 3.18E−02 | 3 | 17 | LAB638 | 0.91 | 1.60E−03 | 3 | 15 |
| LAB638 | 0.74 | 3.60E−02 | 3 | 5 | LAB638 | 0.74 | 2.14E−02 | 6 | 15 |
| LAB638 | 0.92 | 3.50E−03 | 2 | 6 | LAB638 | 0.88 | 9.85E−03 | 2 | 17 |
| LAB638 | 0.74 | 5.75E−02 | 2 | 15 | LAB638 | 0.70 | 7.82E−02 | 2 | 20 |
| LAB638 | 0.88 | 8.35E−03 | 2 | 5 | LAB638 | 0.77 | 4.28E−02 | 2 | 9 |
| LAB638 | 0.76 | 4.87E−02 | 2 | 18 | LAB638 | 0.71 | 7.42E−02 | 2 | 7 |
| LAB638 | 0.80 | 1.82E−02 | 5 | 20 | LAB638 | 0.77 | 2.41E−02 | 5 | 9 |
| LAB639 | 0.82 | 4.57E−02 | 1 | 3 | LAB639 | 0.71 | 4.87E−02 | 3 | 16 |
| LAB639 | 0.75 | 2.05E−02 | 6 | 9 | LAB639 | 0.71 | 5.06E−02 | 5 | 1 |
| LAB640 | 0.72 | 1.08E−01 | 1 | 14 | LAB640 | 0.73 | 6.27E−02 | 2 | 9 |
| LAB640 | 0.82 | 1.30E−02 | 4 | 4 | LAB640 | 0.71 | 3.28E−02 | 4 | 2 |
| LAB641 | 0.72 | 1.08E−01 | 1 | 14 | LAB641 | 0.72 | 1.07E−01 | 1 | 3 |
| LAB641 | 0.75 | 3.20E−02 | 3 | 16 | LAB641 | 0.82 | 1.30E−02 | 4 | 4 |
| LAB641 | 0.72 | 3.00E−02 | 4 | 2 | LAB642 | 0.76 | 1.65E−02 | 6 | 6 |
| LAB642 | 0.85 | 3.47E−03 | 6 | 17 | LAB642 | 0.71 | 3.05E−02 | 6 | 5 |
| LAB642 | 0.85 | 3.82E−03 | 6 | 18 | LAB642 | 0.80 | 5.67E−02 | 1 | 1 |
| LAB644 | 0.78 | 3.83E−02 | 2 | 10 | LAB644 | 0.71 | 7.50E−02 | 2 | 17 |
| LAB644 | 0.78 | 3.76E−02 | 2 | 5 | LAB644 | 0.72 | 1.05E−01 | 2 | 4 |
| LAB644 | 0.71 | 7.50E−02 | 2 | 9 | LAB644 | 0.83 | 1.98E−02 | 2 | 18 |
| LAB644 | 0.94 | 1.92E−03 | 2 | 12 | LAB644 | 0.76 | 1.81E−02 | 4 | 3 |
| LAB645 | 0.91 | 1.06E−02 | 1 | 6 | LAB645 | 0.94 | 6.08E−03 | 1 | 17 |

TABLE 111-continued

Correlation between the expression level of selected genes of some embodiments of the invention in various tissues and the phenotypic performance of maintenance of performance under drought conditions across Barley accessions

| Gene Name | R | P value | Exp. set | Corr. Set ID | Gene Name | R | P value | Exp. set | Corr. Set ID |
|---|---|---|---|---|---|---|---|---|---|
| LAB645 | 0.78 | 6.67E−02 | 1 | 15 | LAB645 | 0.92 | 8.24E−03 | 1 | 5 |
| LAB645 | 0.92 | 9.94E−03 | 1 | 18 | LAB645 | 0.76 | 8.00E−02 | 1 | 12 |
| LAB645 | 0.84 | 8.34E−03 | 3 | 6 | LAB645 | 0.88 | 3.72E−03 | 3 | 17 |
| LAB645 | 0.88 | 4.10E−03 | 3 | 5 | LAB645 | 0.76 | 2.95E−02 | 3 | 2 |
| LAB645 | 0.85 | 1.64E−02 | 2 | 6 | LAB645 | 0.79 | 3.42E−02 | 2 | 17 |
| LAB645 | 0.84 | 1.79E−02 | 2 | 5 | LAB645 | 0.74 | 8.93E−02 | 2 | 4 |
| LAB645 | 0.82 | 1.33E−02 | 5 | 6 | LAB645 | 0.90 | 2.64E−03 | 5 | 17 |
| LAB645 | 0.84 | 8.29E−03 | 5 | 5 | LAB645 | 0.72 | 6.57E−02 | 5 | 4 |
| LAB645 | 0.77 | 2.61E−02 | 5 | 9 | LAB645 | 0.70 | 5.30E−02 | 5 | 18 |
| LAB645 | 0.76 | 2.71E−02 | 4 | 4 | LAB645 | 0.78 | 1.34E−02 | 4 | 2 |
| LAB647 | 0.73 | 2.51E−02 | 6 | 17 | LAB647 | 0.75 | 3.07E−02 | 6 | 4 |
| LAB647 | 0.83 | 6.00E−03 | 6 | 18 | LAB647 | 0.76 | 1.84E−02 | 6 | 2 |
| LAB647 | 0.89 | 7.68E−03 | 2 | 3 | | | | | |

Table 111. Correlations (R) between the genes expression levels in various tissues and the phenotypic performance.
"Corr. ID"—correlation set ID according to the correlated parameters Table 98 above.
"Exp. Set"—Expression set.
"R" = Pearson correlation coefficient;
"P" = p value.

TABLE 112

Correlation between the expression level of selected LAB genes of some embodiments of the invention in various tissues and the phenotypic performance under normal and low nitrogen growth conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LAB620 | 0.74 | 3.66E−02 | 4 | 28 | LAB621 | 0.72 | 4.44E−02 | 6 | 21 |
| LAB622 | 0.70 | 5.23E−02 | 6 | 10 | LAB622 | 0.74 | 2.21E−02 | 1 | 20 |
| LAB623 | 0.70 | 5.22E−02 | 6 | 21 | LAB623 | 0.71 | 3.20E−02 | 1 | 26 |
| LAB623 | 0.73 | 2.54E−02 | 1 | 25 | LAB623 | 0.70 | 3.55E−02 | 2 | 11 |
| LAB623 | 0.88 | 1.91E−03 | 3 | 31 | LAB623 | 0.80 | 9.33E−03 | 3 | 19 |
| LAB623 | 0.82 | 6.83E−03 | 3 | 38 | LAB624 | 0.73 | 4.02E−02 | 4 | 1 |
| LAB624 | 0.83 | 9.95E−03 | 4 | 27 | LAB624 | 0.75 | 3.13E−02 | 4 | 17 |
| LAB625 | 0.72 | 2.87E−02 | 1 | 19 | LAB625 | 0.78 | 1.34E−02 | 1 | 35 |
| LAB625 | 0.89 | 1.29E−03 | 1 | 38 | LAB625 | 0.87 | 2.08E−03 | 1 | 6 |
| LAB626 | 0.95 | 6.52E−05 | 3 | 31 | LAB626 | 0.88 | 1.55E−03 | 3 | 19 |
| LAB626 | 0.88 | 1.60E−03 | 3 | 38 | LAB626 | 0.72 | 2.80E−02 | 3 | 6 |
| LAB628 | 0.83 | 6.18E−03 | 1 | 20 | LAB628 | 0.83 | 2.83E−03 | 5 | 20 |
| LAB628 | 0.70 | 3.39E−02 | 2 | 18 | LAB628 | 0.79 | 1.18E−02 | 2 | 17 |
| LAB629 | 0.88 | 1.54E−03 | 2 | 21 | LAB630 | 0.73 | 3.88E−02 | 4 | 10 |
| LAB630 | 0.70 | 3.47E−02 | 2 | 34 | LAB631 | 0.73 | 3.83E−02 | 6 | 17 |
| LAB631 | 0.71 | 4.98E−02 | 4 | 30 | LAB631 | 0.80 | 1.76E−02 | 4 | 2 |
| LAB631 | 0.80 | 5.70E−03 | 5 | 19 | LAB631 | 0.70 | 3.44E−02 | 2 | 21 |
| LAB633 | 0.77 | 8.57E−03 | 5 | 19 | LAB633 | 0.72 | 1.89E−02 | 5 | 3 |
| LAB633 | 0.71 | 2.16E−02 | 5 | 8 | LAB633 | 0.70 | 3.49E−02 | 2 | 21 |
| LAB634 | 0.73 | 1.58E−02 | 5 | 6 | LAB634 | 0.90 | 9.04E−04 | 2 | 27 |
| LAB634 | 0.88 | 1.63E−03 | 2 | 17 | LAB634 | 0.81 | 8.65E−03 | 3 | 31 |
| LAB635 | 0.73 | 2.49E−02 | 1 | 33 | LAB635 | 0.78 | 8.00E−03 | 5 | 25 |
| LAB635 | 0.92 | 4.27E−04 | 2 | 1 | LAB635 | 0.90 | 1.06E−03 | 3 | 7 |
| LAB635 | 0.74 | 2.18E−02 | 3 | 37 | LAB635 | 0.90 | 8.05E−04 | 3 | 36 |
| LAB636 | 0.70 | 3.56E−02 | 1 | 31 | LAB636 | 0.80 | 1.02E−02 | 1 | 19 |
| LAB636 | 0.85 | 3.39E−03 | 1 | 20 | LAB636 | 0.75 | 1.87E−02 | 1 | 38 |
| LAB636 | 0.72 | 4.39E−02 | 4 | 12 | LAB636 | 0.74 | 2.13E−02 | 3 | 31 |
| LAB636 | 0.74 | 2.38E−02 | 3 | 7 | LAB638 | 0.71 | 4.97E−02 | 6 | 28 |
| LAB638 | 0.87 | 2.18E−03 | 1 | 16 | LAB638 | 0.80 | 1.83E−02 | 4 | 21 |
| LAB638 | 0.77 | 2.44E−02 | 4 | 14 | LAB638 | 0.79 | 1.15E−02 | 3 | 36 |
| LAB639 | 0.71 | 4.71E−02 | 4 | 28 | LAB639 | 0.91 | 5.98E−04 | 2 | 29 |
| LAB640 | 0.76 | 1.76E−02 | 1 | 20 | LAB640 | 0.83 | 1.16E−02 | 4 | 4 |
| LAB640 | 0.72 | 4.39E−02 | 4 | 17 | LAB640 | 0.80 | 9.02E−03 | 2 | 14 |
| LAB640 | 0.91 | 7.30E−04 | 3 | 36 | LAB640 | 0.81 | 8.48E−03 | 3 | 16 |
| LAB641 | 0.76 | 1.76E−02 | 1 | 20 | LAB641 | 0.76 | 1.76E−02 | 1 | 38 |
| LAB641 | 0.83 | 1.16E−02 | 4 | 4 | LAB641 | 0.73 | 1.63E−02 | 5 | 3 |
| LAB641 | 0.80 | 9.02E−03 | 2 | 14 | LAB641 | 0.72 | 3.00E−02 | 3 | 19 |
| LAB641 | 0.79 | 1.19E−02 | 3 | 3 | LAB641 | 0.83 | 5.87E−03 | 3 | 38 |
| LAB641 | 0.71 | 3.26E−02 | 3 | 36 | LAB642 | 0.78 | 7.43E−03 | 5 | 3 |
| LAB644 | 0.78 | 2.14E−02 | 6 | 5 | LAB644 | 0.77 | 1.45E−02 | 1 | 26 |
| LAB644 | 0.79 | 2.04E−02 | 4 | 1 | LAB644 | 0.80 | 1.01E−02 | 3 | 31 |
| LAB644 | 0.81 | 8.26E−03 | 3 | 19 | LAB645 | 0.83 | 5.30E−03 | 1 | 16 |

TABLE 112-continued

Correlation between the expression level of selected LAB genes of some embodiments of the invention in various tissues and the phenotypic performance under normal and low nitrogen growth conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LAB645 | 0.73 | 4.01E−02 | 4 | 34 | LAB645 | 0.70 | 5.20E−02 | 4 | 12 |
| LAB645 | 0.73 | 3.90E−02 | 4 | 10 | LAB645 | 0.71 | 4.75E−02 | 4 | 11 |
| LAB645 | 0.74 | 3.69E−02 | 4 | 30 | LAB645 | 0.78 | 2.29E−02 | 4 | 13 |
| LAB645 | 0.71 | 4.63E−02 | 4 | 23 | LAB647 | 0.71 | 4.98E−02 | 4 | 12 |
| LAB647 | 0.72 | 2.86E−02 | 3 | 31 | LAB647 | 0.71 | 3.14E−02 | 3 | 19 |

Table 112. Correlations (R) between the genes expression levels in various tissues and the phenotypic performance.
"Corr. ID"—correlation set ID according to the correlated parameters Table 99 above.
"Exp. Set"—Expression set.
"R" = Pearson correlation coefficient;
"P" = p value.

TABLE 113

Correlation between the expression level of selected LAB genes of some embodiments of the invention in various tissues and the phenotypic performance under low nitrogen and normal growth conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LAB620 | 0.79 | 6.60E−03 | 4 | 5 | LAB621 | 0.74 | 1.45E−02 | 4 | 17 |
| LAB623 | 0.71 | 2.27E−02 | 2 | 6 | LAB623 | 0.79 | 6.46E−03 | 2 | 7 |
| LAB623 | 0.83 | 3.06E−03 | 2 | 8 | LAB624 | 0.72 | 1.86E−02 | 2 | 13 |
| LAB624 | 0.72 | 1.80E−02 | 3 | 2 | LAB624 | 0.74 | 1.48E−02 | 4 | 15 |
| LAB625 | 0.73 | 1.70E−02 | 3 | 1 | LAB625 | 0.71 | 2.05E−02 | 3 | 3 |
| LAB625 | 0.79 | 6.30E−03 | 5 | 17 | LAB626 | 0.76 | 1.04E−02 | 2 | 6 |
| LAB626 | 0.71 | 2.24E−02 | 2 | 8 | LAB626 | 0.73 | 1.76E−02 | 5 | 17 |
| LAB626 | 0.73 | 1.55E−02 | 1 | 17 | LAB628 | 0.78 | 8.17E−03 | 2 | 17 |
| LAB629 | 0.77 | 9.07E−03 | 5 | 9 | LAB630 | 0.81 | 4.94E−03 | 3 | 17 |
| LAB630 | 0.78 | 7.67E−03 | 5 | 17 | LAB631 | 0.87 | 1.15E−03 | 6 | 12 |
| LAB631 | 0.77 | 8.67E−03 | 5 | 10 | LAB631 | 0.72 | 1.99E−02 | 4 | 10 |
| LAB632 | 0.73 | 1.72E−02 | 3 | 4 | LAB632 | 0.73 | 1.58E−02 | 3 | 10 |
| LAB634 | 0.73 | 1.74E−02 | 5 | 17 | LAB635 | 0.79 | 6.82E−03 | 3 | 17 |
| LAB635 | 0.82 | 3.49E−03 | 3 | 9 | LAB635 | 0.76 | 1.11E−02 | 4 | 11 |
| LAB636 | 0.71 | 2.08E−02 | 2 | 6 | LAB636 | 0.73 | 1.57E−02 | 2 | 5 |
| LAB636 | 0.70 | 2.33E−02 | 2 | 8 | LAB636 | 0.78 | 8.41E−03 | 4 | 10 |
| LAB636 | 0.71 | 2.03E−02 | 1 | 9 | LAB637 | 0.84 | 2.49E−03 | 2 | 6 |
| LAB637 | 0.79 | 6.56E−03 | 2 | 7 | LAB637 | 0.83 | 3.22E−03 | 2 | 8 |
| LAB637 | 0.70 | 2.38E−02 | 2 | 12 | LAB637 | 0.77 | 9.60E−03 | 4 | 10 |
| LAB637 | 0.77 | 9.48E−03 | 1 | 12 | LAB639 | 0.76 | 1.13E−02 | 2 | 6 |
| LAB640 | 0.81 | 4.14E−03 | 2 | 6 | LAB640 | 0.71 | 2.17E−02 | 2 | 5 |
| LAB640 | 0.84 | 2.53E−03 | 2 | 7 | LAB640 | 0.84 | 2.27E−03 | 2 | 8 |
| LAB640 | 0.77 | 8.67E−03 | 4 | 5 | LAB640 | 0.76 | 1.74E−02 | 4 | 16 |
| LAB641 | 0.71 | 2.02E−02 | 5 | 4 | LAB641 | 0.77 | 8.67E−03 | 4 | 5 |
| LAB642 | 0.70 | 2.33E−02 | 2 | 14 | LAB642 | 0.85 | 1.78E−03 | 5 | 9 |
| LAB645 | 0.76 | 1.07E−02 | 3 | 6 | LAB645 | 0.71 | 2.20E−02 | 1 | 6 |
| LAB645 | 0.77 | 8.50E−03 | 1 | 12 | LAB647 | 0.76 | 1.14E−02 | 5 | 9 |
| LAB647 | 0.76 | 1.12E−02 | 1 | 9 | | | | | |

Table 113. Correlations (R) between the genes expression levels in various tissues and the phenotypic performance.
"Corr. ID"—correlation set ID according to the correlated parameters Table 100 above.
"Exp. Set"—Expression set.
"R" = Pearson correlation coefficient;
"P" = p value.

Example 13

Production of Tomato Transcriptom and High Throughput Correlation Analysis Using 44K Tomato Oligonucleotide Micro-Array In order to produce a high throughput correlation analysis between ABST and NUE related phenotypes and gene expression, the present inventors utilized a Tomato oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 44,000 Tomato genes and transcripts. In order to define correlations between the levels of RNA expression with ABST, NUE, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

I. Correlation of Tomato Varieties Across Ecotypes Grown Under Drought, Low Nitrogen and Regular Growth Conditions Experimental Procedures:

Ten Tomato varieties were grown in 3 repetitive blocks, each containing 6 plants per plot, at net house. Briefly, the growing protocol was as follows:

1. Regular growth conditions: Tomato varieties were grown under normal conditions: 4-6 Liters/m$^2$ of water per day and fertilized with NPK (nitrogen, phosphorous and potassium at a ratio 6:6:6, respectively) as recommended in protocols for commercial tomato production.

2. Drought stress: Tomato varieties were grown under normal conditions (4-6 Liters/m$^2$ per day with fertilizers) until flowering. At this time, irrigation was reduced to 50% compared to normal conditions.

3. Low Nitrogen fertilization conditions: Tomato varieties were grown under normal conditions (4-6 Liters/m$^2$ per day and fertilized with NPK as recommended in protocols for commercial tomato production) until flowering. At this time, Nitrogen fertilization was stopped.

Plants were phenotyped on a daily basis following the standard descriptor of tomato (Table 115). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute).

Analyzed tomato tissues—Two tissues at different developmental stages [flower and leaf], representing different plant characteristics, were sampled and RNA was extracted as described above. For convenience, each micro-array expression information tissue type has received a Set ID as summarized in Table 114 below.

TABLE 114

Tomato transcriptom expression sets

| Expression Set | Set IDs |
|---|---|
| Leaf, normal conditions | 1 |
| Flower, normal conditions | 2 |
| Leaf, low nitrogen conditions | 3 |
| Flower, low nitrogen conditions | 4 |
| Leaf, drought conditions | 5 |
| Flower, drought conditions | 6 |
| Leaf, drought conditions | 7 |
| Flower, drought conditions | 8 |
| Leaf, low nitrogen conditions | 9 |
| Flower, low nitrogen conditions | 10 |
| Leaf, normal conditions | 11 |
| Flower, normal conditions | 12 |

Table 114: Provided are the tomato transcriptome expression sets.

The average for each of the measured parameters was calculated using the JMP software and values are summarized in Tables 116-122 below. Subsequent correlation analysis was conducted (Table 123) with the correlation coefficient (R) and the p-values. Results were integrated to the database.

TABLE 115

Tomato correlated parameters (vectors)

| Correlated parameter with | Correlation ID |
|---|---|
| 100 weight green fruit (Drought) [gr] | 1 |
| 100 weight green fruit (Low N) [gr] | 2 |
| 100 weight green fruit (Normal) [gr] | 3 |
| 100 weight red fruit (Drought) [gr] | 4 |
| 100 weight red fruit (Low N) [gr] | 5 |
| 100 weight red fruit (Normal) [gr] | 6 |
| Cluster (flower) Weight NUE/Normal [gr] | 7 |
| FW NUE/Normal | 8 |
| FW drought/Normal | 9 |
| FW/Plant (NUE) [gr] | 10 |
| FW/Plant (Normal) [gr] | 11 |
| FW/Plant Drought [gr] | 12 |
| Fruit Drought/NUE | 13 |
| Fruit NUE/Normal | 14 |
| Fruit Yield Drought/Normal | 15 |
| Fruit Yield/Plant (NUE) [gr] | 16 |
| Fruit Yield/Plant Drought [gr] | 17 |
| Fruit yield/Plant (Normal) [gr] | 18 |
| HI [yield/yield + biomass] (Low N) | 19 |
| HI [yield/yield + biomass] (Normal) | 20 |
| Leaflet Length [cm] (Low N) | 21 |
| Leaflet Length [cm] (Normal) | 22 |
| Leaflet Length [cm]) (Drought) | 23 |
| Leaflet Width (Low N) [cm] | 24 |
| Leaflet Width (Normal) [cm] | 25 |
| Leaflet Width [cm] (Drought) | 26 |
| NUE [yield/SPAD] (Low N) | 27 |
| NUE [yield/SPAD] (Normal) | 28 |
| NUE2 [total biomass/SPAD] (Low N) | 29 |
| NUE2 [total biomass/SPAD] (Normal) | 30 |
| NUpE [biomass/SPAD] (Low N) | 31 |
| NUpE [biomass/SPAD] (Normal) | 32 |
| No flowers (NUE) [num] | 33 |
| No flowers (Normal) [num] | 34 |
| Num of Flower Drought/NUE | 35 |
| Num of Flower Drought/Normal | 36 |
| Num of flowers (Drought) [num] | 37 |
| Num. Flowers NUE/Normal | 38 |
| RWC (Normal) [%] | 39 |
| RWC Drought [%] | 40 |
| RWC Drought/Normal | 41 |
| RWC NUE [%] | 42 |
| RWC NUE/Normal | 43 |
| SAPD 100% RWC NUE/Normal | 44 |
| SLA [leaf area/plant biomass] (Low N) | 45 |
| SLA [leaf area/plant biomass] (Normal) | 46 |
| SPAD (Normal) (SPAD unit) | 47 |
| SPAD 100% RWC (NUE) | 48 |
| SPAD 100% RWC (Normal) | 49 |
| SPAD NUE (SPAD unit) | 50 |
| SPAD NUE/Normal | 51 |
| Total Leaf Area [cm$^2$] (Low N) | 52 |
| Total Leaf Area [cm$^2$] (Normal) | 53 |
| Total Leaf Area [cm$^2$]) (Drought) | 54 |
| Weight Flower clusters (Normal) | 55 |
| Weight clusters (flowers) (NUE) | 56 |
| Weight flower clusters (Drought) | 57 |
| Yield/SLA (Low N) | 58 |
| Yield/SLA (Normal) | 59 |
| Yield/total leaf area (Low N) | 60 |
| Yield/total leaf area (Normal) | 61 |
| average red fruit weight (NUE) [gr] | 62 |
| average red fruit weight (Normal) [gr] | 63 |
| average red fruit weight Drought [gr] | 64 |
| flower cluster weight Drought/NUE | 65 |
| flower cluster weight Drought/Normal | 66 |
| red fruit weight Drought/Normal | 67 |

Table 115. Provided are the tomato correlated parameters, "gr." = grams; "FW" = fresh weight; "NUE" = nitrogen use efficiency; "RWC" = relative water content; "NUpE" = nitrogen uptake efficiency; "SPAD" = chlorophyll levels; "HI" = harvest index (vegetative weight divided on yield); "SLA" = specific leaf area (leaf area divided by leaf dry weight).

Fruit Yield (grams)—At the end of the experiment [when 50% of the fruit were ripe (red)] all fruits from plots within blocks A-C were collected. The total fruits were counted and weighted. The average fruits weight was calculated by dividing the total fruit weight by the number of fruits.

Yield/SLA—Fruit yield divided by the specific leaf area, gives a measurement of the balance between reproductive and vegetative processes.

Yield/total leaf area—Fruit yield divided by the total leaf area, gives a measurement of the balance between reproductive and vegetative processes.

Plant Fresh Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two inflorescence from plots within blocks A-C were collected. The inflorescence weight (gr.) and number of flowers per inflorescence were counted.

SPAD [SPAD unit]—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content Experimental Results

TABLE 116

Measured parameters in Tomato accessions under drought conditions

| Line | Corr. ID | | | | | | | | | |
|---|---|---|---|---|---|---|---|---|---|---|
| | 1 | 4 | 9 | 12 | 13 | 15 | 17 | 23 | 26 | 35 |
| Line-1  |      |       | 1.72 | 2.62 | 1.15 | 0.57 | 0.47 |      |      | 0.88 |
| Line-2  |      |       | 0.34 | 1.09 | 0.73 | 1.41 | 0.48 |      |      | 1.22 |
| Line-3  |      |       | 0.61 | 1.85 | 1.32 | 1.27 | 0.63 |      |      | 1.74 |
| Line-4  |      |       | 2.63 | 2.22 | 0.76 | 2.88 | 0.35 |      |      | 1.56 |
| Line-5  |      |       | 1.18 | 2.63 | 1.51 | 4.20 | 2.04 |      |      | 1.09 |
| Line-6  |      |       | 1.36 | 2.71 | 0.71 | 0.55 | 0.25 |      |      | 1.52 |
| Line-7  |      |       | 4.02 | 3.41 | 5.06 | 0.09 | 0.05 |      |      | 4.96 |
| Line-8  |      |       | 1.01 | 2.11 | 0.89 | 1.03 | 0.45 |      |      | 1.08 |
| Line-9  |      |       | 0.61 | 1.95 | 0.67 | 1.39 | 0.29 |      |      | 0.98 |
| Line-10 |      |       | 0.64 | 1.76 | 2.17 | 3.28 | 1.02 |      |      | 4.94 |
| Line-11 |      |       | 0.95 | 1.72 | 0.38 | 0.91 | 0.60 |      |      | 0.88 |
| Line-12 | 0.80 | 0.89  | 0.51 | 1.92 | 1.27 | 2.62 | 0.49 | 5.15 | 2.55 | 0.79 |
| Line-13 | 0.28 | 0.35  | 1.17 | 2.21 | 0.84 | 0.32 | 0.27 | 3.38 | 2.04 | 2.12 |
| Line-14 | 0.38 | 0.63  | 1.94 | 3.73 | 1.51 | 2.48 | 0.68 | 7.14 | 4.17 | 1.29 |
| Line-15 | 0.63 | 2.27  | 0.35 | 0.75 | 0.98 | 0.41 | 0.14 | 5.48 | 3.09 | 1.61 |
| Line-16 | 2.86 | 7.40  | 1.06 | 1.76 | 1.34 | 1.62 | 0.53 | 8.62 | 4.69 | 1.90 |
| Line-17 | 1.16 | 2.94  | 0.21 | 0.63 | 0.38 | 1.76 | 0.55 | 6.35 | 3.87 | 1.36 |
| Line-18 | 4.40 | 11.60 | 0.48 | 1.11 | 0.84 | 1.42 | 0.41 | 6.77 | 2.91 | 1.42 |

Table 116: Provided are the values of each of the parameters (as described above) measured in Tomato accessions (Seed ID) under drought conditions. Growth conditions are specified in the experimental procedure section.

TABLE 117

Additional Measured parameters in Tomato accessions under drought conditions

| Line | Corr. ID | | | | | |
|---|---|---|---|---|---|---|
| | 36 | 37 | 40 | 41 | 54 | 57 |
| Line-1 | 2.94 | 16.67 | 72.12 | 0.99 | | 0.37 |
| Line-2 | 0.34 | 6.50 | 74.51 | 0.97 | | 0.41 |
| Line-3 | 2.47 | 15.67 | 65.33 | 1.02 | | 0.33 |
| Line-4 | 2.65 | 20.33 | 72.22 | 1.08 | | 0.29 |
| Line-5 | 1.21 | 11.67 | 66.13 | 1.21 | | 0.55 |
| Line-6 | 3.04 | 25.33 | 68.33 | 0.88 | | 0.31 |
| Line-7 | 5.95 | 29.73 | 78.13 | 1.34 | | 0.45 |
| Line-8 | 2.08 | 17.33 | 18.46 | 0.28 | | 0.56 |
| Line-9 | 1.47 | 14.67 | 73.21 | 1.13 | | 0.30 |
| Line-10 | 4.24 | 29.67 | 62.50 | 0.83 | | 0.31 |
| Line-11 | 1.67 | 15.00 | 67.21 | 1.01 | | 0.31 |
| Line-12 | 1.29 | 10.33 | 75.76 | 1.20 | 337.63 | 0.31 |
| Line-13 | 3.44 | 18.33 | 62.82 | 1.11 | 130.78 | 8.36 |
| Line-14 | 1.50 | 12.00 | 70.69 | 1.97 | 557.93 | 0.29 |
| Line-15 | 2.65 | 20.33 | 55.75 | 0.72 | 176.67 | 0.34 |
| Line-16 | 1.41 | 12.67 | 75.22 | 0.75 | 791.86 | 0.44 |
| Line-17 | 1.19 | 12.67 | 63.68 | 1.01 | 517.05 | 0.27 |
| Line-18 | 1.26 | 11.33 | 62.31 | 0.83 | 832.27 | 0.43 |

Table 117. Provided are the values of each of the parameters (as described above) measured in Tomato accessions (Seed ID) under drought conditions. Growth conditions are specified in the experimental procedure section.

TABLE 118

Measured parameters in Tomato accessions under normal conditions

| Line | Correlation ID | | | | | | | | | |
|---|---|---|---|---|---|---|---|---|---|---|
| | 3 | 6 | 11 | 18 | 20 | 22 | 25 | 28 | 30 | 32 |
| Line-1 | | | 1.53 | 0.83 | 0.35 | | | 0.017 | 0.05 | 0.03 |
| Line-2 | | | 3.17 | 0.34 | 0.10 | | | 0.009 | 0.09 | 0.09 |
| Line-3 | 0.56 | 0.82 | 3.02 | 0.49 | 0.14 | 6.34 | 3.69 | 0.009 | 0.06 | 0.05 |
| Line-4 | 3.05 | 2.46 | 0.84 | 0.12 | 0.12 | 7.99 | 4.77 | 0.003 | 0.02 | 0.02 |
| Line-5 | 0.24 | 0.50 | 2.24 | 0.49 | 0.18 | 5.59 | 3.43 | 0.010 | 0.06 | 0.05 |
| Line-6 | 2.58 | 2.76 | 1.98 | 0.45 | 0.19 | 7.70 | 4.56 | 0.008 | 0.06 | 0.05 |
| Line-7 | 6.32 | 5.32 | 0.85 | 0.53 | 0.38 | 7.85 | 4.44 | 0.012 | 0.03 | 0.02 |
| Line-8 | 5.75 | 5.24 | 2.09 | 0.44 | 0.17 | 6.22 | 3.15 | 0.008 | 0.05 | 0.04 |
| Line-9 | 0.38 | 0.61 | 3.21 | 0.21 | 0.06 | 6.16 | 3.37 | 0.004 | 0.06 | 0.05 |
| Line-10 | 0.30 | 0.66 | 2.75 | 0.31 | 0.10 | 5.65 | 3.13 | 0.006 | 0.06 | 0.05 |
| Line-11 | 1.95 | 2.70 | 1.81 | 0.66 | 0.27 | 4.39 | 2.40 | 0.017 | 0.06 | 0.05 |
| Line-12 | 2.53 | 0.70 | 3.77 | 0.19 | 0.05 | 4.44 | 2.02 | 0.004 | 0.08 | 0.08 |
| Line-13 | 1.42 | 2.64 | 1.89 | 0.85 | 0.31 | 6.77 | 3.80 | 0.015 | 0.05 | 0.03 |
| Line-14 | 2.03 | 4.67 | 1.93 | 0.27 | 0.12 | 7.42 | 3.74 | 0.006 | 0.05 | 0.04 |
| Line-15 | 1.39 | 2.17 | 2.14 | 0.35 | 0.14 | 6.71 | 2.98 | 0.008 | 0.06 | 0.05 |
| Line-16 | 2.27 | 0.49 | 1.65 | 0.33 | 0.17 | 5.87 | 3.22 | 0.006 | 0.04 | 0.03 |
| Line-17 | 0.45 | 0.34 | 3.01 | 0.31 | 0.09 | 4.16 | 2.09 | 0.008 | 0.08 | 0.07 |
| Line-18 | 0.42 | 0.75 | 2.29 | 0.29 | 0.11 | 10.29 | 5.91 | 0.005 | 0.04 | 0.04 |

Table 118: Provided are the values of each of the parameters (as described above) measured in Tomato accessions (Seed ID) under normal growth conditions. Growth conditions are specified in the experimental procedure section.

TABLE 119

Additional measured parameters in Tomato accessions under normal conditions

| Line | Corr. ID | | | | | | | | | |
|---|---|---|---|---|---|---|---|---|---|---|
| | 34 | 39 | 46 | 47 | 49 | 53 | 55 | 59 | 61 | 63 |
| Line-1 | 5.67 | 72.83 | | 49.70 | 36.17 | | 1.17 | | | 0.05 |
| Line-2 | 19.33 | 76.47 | | 37.20 | 28.45 | | 0.34 | | | 0.01 |
| Line-3 | 6.33 | 64.29 | 140.99 | 55.80 | 35.89 | 426.10 | 0.69 | 0.0035 | 0.0012 | 0.01 |
| Line-4 | 7.67 | 67.07 | 689.67 | 46.40 | 31.09 | 582.38 | 56.35 | 0.0002 | 0.0002 | 0.29 |
| Line-5 | 9.67 | 54.79 | 130.22 | 48.20 | 26.38 | 291.40 | 0.44 | 0.0037 | 0.0017 | 0.01 |
| Line-6 | 8.33 | 77.61 | 299.12 | 43.40 | 33.68 | 593.58 | 11.31 | 0.0015 | 0.0008 | 0.05 |
| Line-7 | 5.00 | 58.18 | 1117.74 | 42.90 | 24.98 | 947.59 | 0.79 | 0.0005 | 0.0006 | 0.23 |
| Line-8 | 8.33 | 66.51 | 111.77 | 53.30 | 35.47 | 233.35 | 0.58 | 0.0039 | 0.0019 | 0.29 |
| Line-9 | 10.00 | 64.71 | 106.29 | 58.50 | 37.87 | 340.73 | 0.73 | 0.0020 | 0.0006 | 0.01 |
| Line-10 | 7.00 | 75.25 | 123.14 | 51.10 | 38.43 | 339.11 | 0.83 | 0.0025 | 0.0009 | 0.01 |
| Line-11 | 9.00 | 66.23 | 104.99 | 40.00 | 26.49 | 190.14 | 0.86 | 0.0063 | 0.0035 | 0.06 |
| Line-12 | 8.00 | 63.21 | 111.88 | 47.60 | 30.07 | 421.79 | 0.50 | 0.0017 | 0.0004 | 0.01 |
| Line-13 | 5.33 | 56.77 | 307.95 | 57.90 | 32.89 | 581.33 | 1.02 | 0.0028 | 0.0015 | 0.03 |
| Line-14 | 8.00 | 35.96 | 419.37 | 48.30 | 17.35 | 807.51 | 0.70 | 0.0007 | 0.0003 | 0.26 |
| Line-15 | 7.67 | 77.62 | 365.81 | 43.60 | 33.82 | 784.06 | 0.38 | 0.0009 | 0.0004 | 0.03 |
| Line-16 | 9.00 | 100.00 | 212.93 | 54.50 | 54.47 | 351.80 | 0.66 | 0.0015 | 0.0009 | 0.00 |

TABLE 119-continued

Additional measured parameters in Tomato accessions under normal conditions

| | Corr. ID | | | | | | | | |
|---|---|---|---|---|---|---|---|---|---|
| Line | 34 | 39 | 46 | 47 | 49 | 53 | 55 | 59 | 61 | 63 |
| Line-17 | 10.67 | 63.16 | 84.94 | 41.60 | 26.25 | 255.78 | 0.70 | 0.0037 | 0.0012 | 0.00 |
| Line-18 | 9.00 | 75.13 | 469.87 | 59.10 | 44.43 | 1078.10 | 0.33 | 0.0006 | 0.0003 | 0.01 |

Table 119: Provided are the values of each of the parameters (as described above) measured in Tomato accessions (Seed ID) under normal growth conditions. Growth conditions are specified in the experimental procedure section.

TABLE 120

Measured parameters in Tomato accessions under low nitrogen conditions

| | Corr. ID | | | | | | | | |
|---|---|---|---|---|---|---|---|---|---|
| Line | 2 | 5 | 7 | 8 | 10 | 14 | 16 | 19 | 21 | 24 |
| Line-1 | 0.87 | 1.06 | 0.46 | 2.65 | 4.04 | 0.49 | 0.41 | 0.09 | 6.40 | 3.47 |
| Line-2 | 3.66 | 6.87 | 1.07 | 0.38 | 1.21 | 1.93 | 0.66 | 0.35 | 5.92 | 1.97 |
| Line-3 | 0.57 | 0.65 | 0.44 | 0.74 | 2.25 | 0.97 | 0.48 | 0.18 | 3.69 | 1.79 |
| Line-4 | 0.37 | 0.53 | 0.01 | 3.01 | 2.54 | 3.80 | 0.46 | 0.15 | 5.43 | 2.55 |
| Line-5 | 3.40 | 7.17 | 1.08 | 0.83 | 1.85 | 2.78 | 1.35 | 0.42 | 6.95 | 3.52 |
| Line-6 | 0.68 | 0.44 | 0.02 | 1.54 | 3.06 | 0.78 | 0.35 | 0.10 | 3.73 | 1.73 |
| Line-7 | 0.45 | | 0.37 | 3.70 | 3.13 | 0.02 | 0.01 | 0.00 | 4.39 | 1.87 |
| Line-8 | 0.47 | 0.55 | 0.81 | 1.22 | 2.54 | 1.16 | 0.51 | 0.17 | 6.72 | 3.54 |
| Line-9 | 0.54 | 0.75 | 0.55 | 0.58 | 1.84 | 2.07 | 0.44 | 0.19 | 6.66 | 3.28 |
| Line-10 | 0.39 | 0.58 | 0.36 | 0.55 | 1.52 | 1.51 | 0.47 | 0.24 | 4.39 | 2.52 |
| Line-11 | 0.97 | 1.27 | 0.95 | 1.06 | 1.91 | 2.41 | 1.59 | 0.45 | 3.90 | 2.61 |
| Line-12 | 0.91 | 1.34 | 0.80 | 0.49 | 1.86 | 2.06 | 0.39 | 0.17 | 5.29 | 2.61 |
| Line-13 | 0.36 | 0.52 | 0.34 | 1.31 | 2.47 | 0.38 | 0.32 | 0.12 | 6.32 | 3.58 |
| Line-14 | 0.35 | 0.57 | 0.61 | 1.36 | 2.62 | 1.64 | 0.45 | 0.15 | 5.11 | 2.56 |
| Line-15 | 0.57 | 0.94 | 0.94 | 0.51 | 1.08 | 0.41 | 0.14 | 0.12 | 4.72 | 2.48 |
| Line-16 | 4.38 | 6.17 | 0.68 | 0.71 | 1.17 | 1.21 | 0.40 | 0.25 | 6.85 | 3.43 |
| Line-17 | 2.02 | 3.67 | 0.40 | 0.31 | 0.92 | 4.59 | 1.44 | 0.61 | 7.10 | 3.30 |
| Line-18 | 8.13 | 11.33 | 1.44 | 0.47 | 1.09 | 1.70 | 0.50 | 0.31 | 8.21 | 3.69 |

Table 120: Provided are the values of each of the parameters (as described above) measured in Tomato accessions (Seed ID) under low nitrogen growth conditions. Growth conditions are specified in the experimental procedure section.

TABLE 121

Additional measured parameters in Tomato accessions under low nitrogen conditions

| | Corr. ID | | | | | | | | |
|---|---|---|---|---|---|---|---|---|---|
| Line | 27 | 29 | 31 | 33 | 38 | 42 | 43 | 44 | 45 | 48 |
| Line-1 | 0.01 | 0.16 | 0.14 | 19.00 | 3.35 | 74.07 | 1.02 | 0.79 | 149.04 | 28.47 |
| Line-2 | 0.02 | 0.05 | 0.03 | 5.33 | 0.28 | 99.08 | 1.30 | 1.37 | 317.12 | 39.04 |
| Line-3 | 0.01 | 0.08 | 0.07 | 9.00 | 1.42 | 69.49 | 1.08 | 0.92 | 131.29 | 33.01 |
| Line-4 | 0.02 | 0.13 | 0.11 | 13.00 | 1.70 | 63.24 | 0.94 | 0.75 | 148.82 | 23.42 |
| Line-5 | 0.04 | 0.09 | 0.05 | 10.67 | 1.10 | 77.36 | 1.41 | 1.31 | 257.51 | 34.53 |
| Line-6 | 0.01 | 0.11 | 0.09 | 16.67 | 2.00 | 77.91 | 1.00 | 0.97 | 64.34 | 32.51 |
| Line-7 | 0.00 | 0.11 | 0.11 | 6.00 | 1.20 | 80.49 | 1.38 | 1.11 | 144.60 | 27.66 |
| Line-8 | 0.02 | 0.09 | 0.08 | 16.00 | 1.92 | 67.40 | 1.01 | 0.95 | 246.05 | 33.68 |
| Line-9 | 0.01 | 0.08 | 0.06 | 15.00 | 1.50 | 67.16 | 1.04 | 0.79 | 405.55 | 30.04 |
| Line-10 | 0.01 | 0.06 | 0.04 | 6.00 | 0.86 | 66.07 | 0.88 | 0.92 | 299.32 | 35.50 |
| Line-11 | 0.06 | 0.14 | 0.08 | 17.00 | 1.89 | 69.57 | 1.05 | 0.94 | 86.19 | 24.81 |
| Line-12 | 0.01 | 0.06 | 0.05 | 13.00 | 1.63 | 69.30 | 1.10 | 1.36 | 182.32 | 40.77 |
| Line-13 | 0.01 | 0.06 | 0.05 | 8.67 | 1.63 | 100.00 | 1.76 | 1.44 | 160.18 | 47.47 |
| Line-14 | 0.02 | 0.12 | 0.10 | 9.33 | 1.17 | 57.66 | 1.60 | 1.50 | 96.10 | 26.06 |
| Line-15 | 0.00 | 0.03 | 0.03 | 12.67 | 1.65 | 90.79 | 1.17 | 1.05 | 160.99 | 35.38 |
| Line-16 | 0.01 | 0.05 | 0.04 | 6.67 | 0.74 | 68.00 | 0.68 | 0.56 | 379.03 | 30.60 |
| Line-17 | 0.04 | 0.06 | 0.02 | 9.33 | 0.88 | 59.65 | 0.94 | 1.48 | 531.08 | 38.97 |
| Line-18 | 0.01 | 0.04 | 0.03 | 8.00 | 0.89 | 72.17 | 0.96 | 0.84 | 650.68 | 37.46 |

Table 121: Provided are the values of each of the parameters (as described above) measured in Tomato accessions (Seed ID) under low nitrogen growth conditions. Growth conditions are specified in the experimental procedure section.

TABLE 122

Additional measured parameters in Tomato accessions under low nitrogen conditions

| Line | \multicolumn{7}{c}{Correlation ID} |
|---|---|---|---|---|---|---|---|

| Line | 50 | 51 | 52 | 56 | 58 | 60 | 62 |
|---|---|---|---|---|---|---|---|
| Line-1 | 38.40 | 0.77 | 565.93 | 0.53 | 0.0029 | 0.0007 | 0.02 |
| Line-2 | 39.40 | 1.06 | 384.77 | 0.37 | 0.0021 | 0.0017 | 0.19 |
| Line-3 | 47.50 | 0.85 | 294.83 | 0.31 | 0.0036 | 0.0016 | 0.01 |
| Line-4 | 37.00 | 0.80 | 378.00 | 0.35 | 0.0031 | 0.0012 | 0.01 |
| Line-5 | 44.60 | 0.93 | 476.39 | 0.47 | 0.0052 | 0.0028 | 0.10 |
| Line-6 | 41.70 | 0.96 | 197.08 | 0.25 | 0.0055 | 0.0018 | 0.00 |
| Line-7 | 34.40 | 0.80 | 453.24 | 0.29 | 0.0001 | 0.0000 | 0.01 |
| Line-8 | 50.00 | 0.94 | 625.51 | 0.47 | 0.0021 | 0.0008 | 0.01 |
| Line-9 | 44.70 | 0.76 | 748.01 | 0.40 | 0.0011 | 0.0006 | 0.01 |
| Line-10 | 53.70 | 1.05 | 453.96 | 0.30 | 0.0016 | 0.0010 | 0.01 |
| Line-11 | 35.70 | 0.89 | 164.85 | 0.82 | 0.0185 | 0.0097 | 0.02 |
| Line-12 | 58.80 | 1.24 | 338.30 | 0.40 | 0.0021 | 0.0011 | 0.01 |
| Line-13 | 47.50 | 0.82 | 396.00 | 0.35 | 0.0020 | 0.0008 | 0.01 |
| Line-14 | 45.20 | 0.94 | 236.15 | 0.43 | 0.0050 | 0.0019 | 0.05 |
| Line-15 | 39.00 | 0.89 | 174.58 | 0.35 | 0.0009 | 0.0008 | 0.36 |
| Line-16 | 45.00 | 0.83 | 441.78 | 0.45 | 0.0010 | 0.0009 | 0.04 |
| Line-17 | 65.30 | 1.57 | 489.18 | 0.28 | 0.0027 | 0.0029 | 0.63 |
| Line-18 | 51.90 | 0.88 | 707.80 | 0.47 | 0.0008 | 0.0007 | |

Table 122: Provided are the values of each of the parameters (as described above) measured in Tomato accessions (Seed ID) under low nitrogen growth conditions. Growth conditions are specified in the experimental procedure section.

TABLE 123

Correlation between the expression level of selected LAB genes of some embodiments of the invention in various tissues and the phenotypic performance under low nitrogen, normal or drought stress conditions across Tomato accessions

| Gene Name | R | P value | Exp. set | Corr. Set ID | Gene Name | R | P value | Exp. set | Corr. Set ID |
|---|---|---|---|---|---|---|---|---|---|
| LAB824 | 0.74 | 2.13E−02 | 11 | 32 | LAB824 | 0.79 | 1.05E−02 | 11 | 30 |
| LAB824 | 0.84 | 2.56E−03 | 10 | 19 | LAB824 | 0.72 | 1.84E−02 | 10 | 45 |
| LAB824 | 0.83 | 2.69E−03 | 4 | 14 | LAB824 | 0.83 | 2.69E−03 | 4 | 51 |
| LAB824 | 0.89 | 1.43E−03 | 4 | 62 | LAB824 | 0.75 | 1.32E−02 | 4 | 50 |
| LAB824 | 0.78 | 7.80E−03 | 9 | 2 | LAB824 | 0.71 | 2.24E−02 | 9 | 5 |
| LAB825 | 0.73 | 1.60E−02 | 3 | 42 | LAB825 | 0.71 | 2.09E−02 | 1 | 34 |
| LAB827 | 0.72 | 1.80E−02 | 3 | 33 | LAB827 | 0.78 | 7.77E−03 | 2 | 63 |
| LAB827 | 0.71 | 2.19E−02 | 10 | 31 | LAB827 | 0.84 | 2.20E−03 | 1 | 63 |
| LAB827 | 0.78 | 7.28E−03 | 6 | 9 | LAB827 | 0.81 | 4.93E−03 | 4 | 33 |
| LAB827 | 0.74 | 1.50E−02 | 5 | 12 | LAB827 | 0.81 | 4.16E−03 | 5 | 9 |
| LAB829 | 0.93 | 1.05E−04 | 3 | 48 | LAB829 | 0.79 | 6.65E−03 | 3 | 44 |
| LAB829 | 0.79 | 1.15E−02 | 11 | 20 | LAB829 | 0.70 | 3.39E−02 | 12 | 20 |
| LAB829 | 0.81 | 1.45E−02 | 12 | 3 | LAB829 | 0.83 | 1.10E−02 | 12 | 6 |
| LAB830 | 0.73 | 1.66E−02 | 3 | 48 | LAB830 | 0.76 | 1.78E−02 | 11 | 20 |
| LAB830 | 0.78 | 1.29E−02 | 11 | 28 | LAB830 | 0.81 | 1.56E−02 | 12 | 59 |
| LAB830 | 0.76 | 2.91E−02 | 12 | 61 | LAB830 | 0.72 | 2.01E−02 | 10 | 5 |
| LAB830 | 0.86 | 1.53E−03 | 6 | 67 | LAB830 | 0.76 | 1.14E−02 | 6 | 64 |
| LAB830 | 0.81 | 4.61E−03 | 4 | 42 | LAB831 | 0.87 | 1.21E−03 | 10 | 2 |
| LAB831 | 0.82 | 3.61E−03 | 10 | 5 | LAB831 | 0.84 | 2.36E−03 | 4 | 7 |
| LAB831 | 0.75 | 1.24E−02 | 5 | 35 | LAB832 | 0.77 | 1.42E−02 | 3 | 62 |
| LAB832 | 0.88 | 1.87E−03 | 11 | 20 | LAB832 | 0.90 | 8.37E−04 | 11 | 28 |
| LAB832 | 0.74 | 3.52E−02 | 12 | 22 | LAB832 | 0.71 | 3.08E−02 | 12 | 20 |
| LAB832 | 0.73 | 2.62E−02 | 12 | 28 | LAB832 | 0.74 | 3.47E−02 | 12 | 25 |
| LAB833 | 0.72 | 2.92E−02 | 11 | 32 | LAB833 | 0.72 | 3.03E−02 | 11 | 30 |
| LAB833 | 0.75 | 3.15E−02 | 12 | 59 | LAB833 | 0.81 | 1.48E−02 | 12 | 61 |
| LAB833 | 0.78 | 7.37E−03 | 10 | 58 | LAB834 | 0.73 | 1.57E−02 | 3 | 44 |
| LAB834 | 0.75 | 1.28E−02 | 10 | 2 | LAB834 | 0.77 | 9.91E−03 | 10 | 5 |
| LAB834 | 0.73 | 1.69E−02 | 4 | 56 | LAB834 | 0.76 | 1.05E−02 | 4 | 7 |
| LAB835 | 0.72 | 1.79E−02 | 6 | 35 | LAB835 | 0.84 | 2.24E−03 | 5 | 35 |
| LAB836 | 0.77 | 1.42E−02 | 11 | 28 | LAB836 | 0.71 | 4.70E−02 | 12 | 6 |
| LAB836 | 0.71 | 2.01E−02 | 2 | 47 | LAB836 | 0.75 | 1.27E−02 | 10 | 19 |
| LAB836 | 0.72 | 2.00E−02 | 10 | 5 | LAB836 | 0.71 | 2.23E−02 | 5 | 67 |
| LAB837 | 0.82 | 3.47E−03 | 10 | 58 | LAB839 | 0.76 | 2.94E−02 | 12 | 59 |
| LAB839 | 0.72 | 4.29E−02 | 12 | 61 | LAB839 | 0.79 | 6.69E−03 | 4 | 50 |
| LAB839 | 0.79 | 6.43E−03 | 5 | 64 | LAB842 | 0.76 | 1.01E−02 | 5 | 35 |
| LAB843 | 0.77 | 9.49E−03 | 3 | 44 | | | | | |

Table 123.
"Corr. ID"—correlation set ID according to the correlated parameters Table above.
"Exp. Set ID" = Expression set.
"R" = Pearson correlation coefficient;
"P" = p value.

II. Correlation of early vigor traits across collection of Tomato ecotypes under 300 mM NaCl, low nitrogen and normal growth conditions—Ten tomato hybrids were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to the high salinity solution (300 mM NaCl in addition to the Full Hoagland solution), low nitrogen solution (the amount of total nitrogen was reduced in a 90% from the full Hoagland solution, final amount of 0.8 mM N), or at Normal growth solution (Full Hoagland containing 8 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8.

Analyzed tomato tissues—All 10 selected Tomato varieties were sample per each treatment. Two types of tissues [leaves and roots] were sampled and RNA was extracted as described above. For convenience, each micro-array expression information tissue type has received a Set ID as summarized in Table 124 below.

TABLE 124

Tomato transcriptom expression sets

| Expression Set | Set IDs |
| --- | --- |
| Leaf - normal conditions | 1 + 10 |
| Root - normal conditions | 2 + 9 |
| Leaf - low nitrogen conditions | 3 + 8 |
| Root - low nitrogen conditions | 4 + 7 |
| Leaf - salinity conditions | 5 + 12 |
| Root - salinity conditions | 6 + 11 |

Table 124. Provided are the tomato transcriptom experimental sets.

Tomato vigor related parameters—following 5 weeks of growing, plant were harvested and analyzed for leaf number, plant height, chlorophyll levels (SPAD units), different indices of nitrogen use efficiency (NUE) and plant biomass. Next, analyzed data was saved to text files and processed using the JMP statistical analysis software (SAS institute). Data parameters collected are summarized in Table 125, herein below.

Leaf number—number of opened leaves.

RGR Leaf Num—calculated relative growth rate (RGR) of leaf number.

Shoot/Root—biomass of shoot divided by biomass of roots.

NUE total biomass—nitrogen use efficiency (NUE) calculated as total biomass divided by nitrogen concentration.

NUE root biomass—nitrogen use efficiency (NUE) of root growth calculated as root biomass divided by nitrogen concentration NUE shoot biomass—nitrogen use efficiency (NUE) of shoot growth calculated as shoot biomass divided by nitrogen concentration. Percent of reduction of root biomass compared to normal—the difference (reduction in percent) between root biomass under normal and under low nitrogen conditions.

Percent of reduction of shoot biomass compared to normal—the difference (reduction in percent) between shoot biomass under normal and under low nitrogen conditions.

Percent of reduction of total biomass compared to normal—the difference (reduction in percent) between total biomass (shoot and root) under normal and under low nitrogen conditions.

Plant height—Plants were characterized for height during growing period at 5 time points. In each measure, plants were measured for their height using a measuring tape. Height was measured from ground level to top of the longest leaf.

SPAD [SPAD unit]—Chlorophyll content was determined using a Minolta SPAD 502 chlorophyll meter and measurement was performed 64 days post sowing.

SPAD meter readings were done on young fully developed leaf. Three measurements per leaf were taken per plot.

Root Biomass [DW, gr.]/SPAD—root biomass divided by SPAD results.

Shoot Biomass [DW, gr.]/SPAD—shoot biomass divided by SPAD results.

Total Biomass (Root+Shoot) [DW, gr.]/SPAD—total biomass divided by SPAD results.

TABLE 125

Tomato correlated parameters (vectors)

| Correlated parameter with | Correlation ID |
| --- | --- |
| Leaf number Ratio Low N/Normal | 1 |
| Leaf number Ratio NaCl/Normal | 2 |
| Leaf number Ratio NaCl/Low N | 3 |
| N level/Leaf [SPAD unit/leaf] | 4 |
| NUE roots (Root Biomass [DW]/SPAD) (gr/SPAD unit) | 5 |
| NUE shoots (shoot Biomass [DW]/SPAD) (gr/SPAD unit) | 6 |
| NUE total biomass (Total Biomass [DW]/SPAD) (gr/SPAD unit) | 7 |
| Percent of reduction of root biomass compared to normal (%) | 8 |
| Percent of reduction of shoot biomass compared to normal (%) | 9 |
| Plant Height Low N/Normal | 10 |
| Plant Height Ratio NaCl/Low N | 11 |
| Plant Height Ratio NaCl/Normal | 12 |
| Plant biomass NaCl (gr) | 13 |
| Plant height Low N (cm) | 14 |
| Plant height NaCl (cm) | 15 |
| Plant height Normal (cm) | 16 |
| NUE Root Biomass [DW]/SPAD (gr/SPAD unit) | 17 |
| SPAD Ratio Low N/Normal | 18 |
| SPAD Low N (SPAD unit) | 19 |
| SPAD Normal (SPAD unit) | 20 |
| NUE Shoot Biomass [DW]/SPAD (gr/SPAD unit) | 21 |
| Shoot/Root | 22 |
| NUE Total Biomass [Root + Shoot DW]/SPAD (gr/SPAD unit) | 23 |
| Plant height Normal (cm) | 24 |
| leaf number Low N (num) | 25 |
| leaf number Normal (num) | 26 |
| leaf number NaCl (num) | 27 |

Table 125. Provided are the tomato correlated parameters. "NUE" = nitrogen use efficiency; "DW" = dry weight; "cm" = centimeter;

Experimental Results 10 different Tomato varieties were grown and characterized for parameters as described above (Table 125). The average for each of the measured parameter was calculated using the JMP software and values are summarized in Tables 126-129 below. Subsequent correlation analysis was conducted (Table 130). Follow, results were integrated to the database.

TABLE 126

Measured parameters in Tomato accessions under low nitrogen conditions

| Line | \multicolumn{11}{c}{Corr. ID} |
|---|---|---|---|---|---|---|---|---|---|---|---|
| | 1 | 4 | 5 | 6 | 7 | 8 | 9 | 10 | 14 | 17 | 18 |
| Line-1 | 0.85 | 10.854 | 6.99 | 35.35 | 58.47 | 62.592 | 75.38 | 0.81 | 36.78 | 0.0008 | 1.01 |
| Line-2 | 0.9 | 11.409 | 2.54 | 24.09 | 63.75 | 54.158 | 55.112 | 0.83 | 39.89 | 0.0003 | 0.98 |
| Line-3 | 0.98 | | | | | | | 0.84 | 34.44 | | 1.02 |
| Line-4 | 1.09 | 10.438 | 7.04 | 65.02 | 69.29 | 70.547 | 49.726 | 0.85 | 47 | 0.0008 | 1 |
| Line-5 | 0.88 | 11.169 | 5.04 | 46.71 | 71.1 | 59.685 | 63.189 | 0.83 | 46.44 | 0.0005 | 0.98 |
| Line-6 | 1.02 | 8.9286 | 8.01 | 46.67 | 60.54 | 96.129 | 82.667 | 0.93 | 45.44 | 0.0009 | 0.98 |
| Line-7 | 0.87 | 7.9264 | 15.09 | 120.07 | 73.9 | 106.5 | 66.924 | 0.85 | 47.67 | 0.0014 | 0.93 |
| Line-8 | 1.06 | 7.9932 | 9.02 | 60.09 | 68.81 | 111.9 | 107.98 | 1.05 | 39.33 | 0.001 | 1.05 |
| Line-9 | 0.91 | 10.304 | 8.78 | 66.27 | 66.74 | 81.644 | 55.401 | 0.84 | 41.78 | 0.0009 | 1.01 |
| Line-10 | 1.12 | 8.5852 | 7.25 | 56.46 | 70.82 | 32.214 | 54.433 | 0.88 | 41 | 0.0009 | 0.99 |
| Line-11 | | 11.528 | 7.73 | 38.35 | 69.7 | 143.71 | 62.155 | | | 0.0008 | |
| Line-12 | | 14.491 | 15.94 | 60.32 | 49.72 | 87.471 | 59.746 | | | 0.0015 | |

Table 126. Provided are the values of each of the parameters (as described above) measured in Tomato accessions (Line) under low nitrogen growth conditions. Growth conditions are specified in the experimental procedure section.

TABLE 127

Additional measured parameters in Tomato accessions under low nitrogen conditions

| Line | \multicolumn{6}{c}{Corr. ID} |
|---|---|---|---|---|---|---|
| | 19 | 21 | 22 | 23 | 24 | 25 |
| Line-1 | 34.57 | 0.0041 | 5.0104 | 0.005 | 45.33 | 5.56 |
| Line-2 | 24.87 | 0.003 | 11.393 | 0.0034 | 47.78 | 6.22 |
| Line-3 | 28.58 | | | | 40.78 | 7.22 |
| Line-4 | 31.58 | 0.0072 | 9.4941 | 0.008 | 55.33 | 6.78 |
| Line-5 | 29.72 | 0.0049 | 11.6 | 0.0055 | 56.22 | 5.56 |
| Line-6 | 31.83 | 0.0052 | 8.2001 | 0.006 | 48.67 | 6.56 |
| Line-7 | 30.33 | 0.0115 | 10.375 | 0.0129 | 55.78 | 5.11 |
| Line-8 | 30.29 | 0.0069 | 10.523 | 0.0079 | 37.44 | 5.89 |
| Line-9 | 31.32 | 0.0068 | 8.2421 | 0.0077 | 49.56 | 5.56 |
| Line-10 | 28.77 | 0.0067 | 7.9668 | 0.0076 | 46.33 | 6.33 |
| Line-11 | | 0.0042 | 6.4137 | 0.005 | | |
| Line-12 | | 0.0056 | 3.9092 | 0.007 | | |

Table 127. Provided are the values of each of the parameters (as described above) measured in Tomato accessions (Line) under low nitrogen growth conditions. Growth conditions are specified in the experimental procedure section.

TABLE 128

Measured parameters in Tomato accessions under normal conditions

| Line | \multicolumn{11}{c}{Corr. ID} |
|---|---|---|---|---|---|---|---|---|---|---|---|
| | 4 | 5 | 6 | 7 | 16 | 17 | 20 | 21 | 22 | 23 | 26 |
| Line-1 | 9.29 | 1.12 | 4.69 | 7.47 | 45.33 | 0.00 | 34.30 | 0.01 | 5.40 | 0.006 | 6.56 |
| Line-2 | 8.87 | 0.47 | 4.37 | 8.63 | 47.78 | 0.00 | 25.31 | 0.01 | 10.02 | 0.006 | 6.89 |
| Line-3 | | | | | 40.78 | | 28.12 | | | | 7.33 |
| Line-4 | 8.43 | 1.00 | 13.08 | 8.85 | 55.33 | 0.00 | 31.43 | 0.01 | 15.42 | 0.015 | 6.22 |
| Line-5 | 9.83 | 0.84 | 7.39 | 7.22 | 56.22 | 0.00 | 30.24 | 0.01 | 8.83 | 0.009 | 6.33 |
| Line-6 | 8.57 | 0.83 | 5.65 | 7.87 | 48.67 | 0.00 | 32.43 | 0.01 | 7.52 | 0.006 | 6.44 |
| Line-7 | 6.57 | 0.94 | 17.94 | 9.09 | 55.78 | 0.00 | 32.58 | 0.02 | 12.61 | 0.019 | 5.89 |
| Line-8 | 6.97 | 0.81 | 5.56 | 7.91 | 37.44 | 0.00 | 28.77 | 0.01 | 7.99 | 0.008 | 5.56 |
| Line-9 | 8.71 | 1.08 | 11.96 | 8.55 | 49.56 | 0.00 | 30.92 | 0.01 | 14.31 | 0.012 | 6.11 |
| Line-10 | 7.35 | 2.25 | 10.37 | 8.68 | 46.33 | 0.00 | 28.99 | 0.01 | 4.80 | 0.014 | 5.67 |
| Line-11 | 10.18 | 0.54 | 6.17 | 9.10 | | 0.00 | | 0.01 | 12.65 | 0.007 | |
| Line-12 | 9.37 | 1.82 | 10.10 | 6.24 | | 0.00 | | 0.01 | 6.29 | 0.011 | |

Table 128. Provided are the values of each of the parameters (as described above) measured in Tomato accessions (Line) under normal growth conditions. Growth conditions are specified in the experimental procedure section.

TABLE 129

Measured parameters in Tomato accessions under salinity conditions

| Line | Corr. ID | | | | | | | | | | |
|---|---|---|---|---|---|---|---|---|---|---|---|
| | 2 | 3 | 4 | 11 | 12 | 13 | 15 | 17 | 21 | 23 | 27 |
| Line-1 | 0.54 | 0.64 | 11.4 | 0.15 | 0.12 | 0.36 | 5.6 | 6E−05 | 0.0005 | 0.0007 | 3.56 |
| Line-2 | 0.57 | 0.63 | 11.639 | 0.16 | 0.14 | 0.44 | 6.46 | 0.0001 | 0.0007 | 0.0008 | 3.94 |
| Line-3 | 0.68 | 0.69 | | 0.25 | 0.21 | 0.26 | 8.47 | | | | 5 |
| Line-4 | 0.64 | 0.59 | 10.788 | 0.18 | 0.15 | 0.71 | 8.56 | 1E−04 | 0.0012 | 0.0014 | 4 |
| Line-5 | 0.56 | 0.64 | 10.776 | 0.19 | 0.16 | 0.46 | 8.87 | 7E−05 | 0.0017 | 0.0018 | 3.56 |
| Line-6 | 0.68 | 0.67 | 6.9524 | 0.17 | 0.16 | 0.54 | 7.56 | 9E−05 | 0.001 | 0.0011 | 4.39 |
| Line-7 | 0.54 | 0.62 | 9.2128 | 0.18 | 0.15 | 0.66 | 8.64 | 1E−04 | 0.0012 | 0.0013 | 3.17 |
| Line-8 | 0.67 | 0.63 | 8.5376 | 0.14 | 0.15 | 0.4 | 5.57 | 8E−05 | 0.0007 | 0.0008 | 3.72 |
| Line-9 | 0.65 | 0.72 | 10.37 | 0.14 | 0.12 | 0.52 | 5.82 | 9E−05 | 0.001 | 0.0011 | 4 |
| Line-10 | 0.75 | 0.68 | 8.8395 | 0.23 | 0.2 | 0.45 | 9.36 | | 0.001 | | 4.28 |
| Line-11 | | | 10.434 | | | | | 5E−05 | 0.0007 | 0.0006 | |
| Line-12 | | | 12.429 | | | | | 5E−05 | 0.0007 | 0.0007 | |

Table 129. Provided are the values of each of the parameters (as described above) measured in Tomato accessions (Line) under salinity growth conditions. Growth conditions are specified in the experimental procedure section.

TABLE 130

Correlation between the expression level of selected LAB genes of some embodiments of the invention in various tissues and the phenotypic performance under low nitrogen, normal or salinity stress conditions across Tomato accessions

| Gene Name | R | P value | Exp. set | Corr. Set ID | Gene Name | R | P value | Exp. set | Corr. Set ID |
|---|---|---|---|---|---|---|---|---|---|
| LAB824 | 0.72 | 2.80E−02 | 1 | 22 | LAB824 | 0.75 | 3.33E−02 | 4 | 25 |
| LAB824 | 0.81 | 1.46E−02 | 6 | 23 | LAB824 | 0.80 | 5.90E−03 | 6 | 15 |
| LAB824 | 0.76 | 1.70E−02 | 5 | 21 | LAB824 | 0.75 | 3.18E−02 | 5 | 23 |
| LAB825 | 0.79 | 1.09E−02 | 4 | 9 | LAB827 | 0.73 | 1.72E−02 | 5 | 11 |
| LAB830 | 0.82 | 7.15E−03 | 1 | 5 | LAB830 | 0.82 | 6.57E−03 | 1 | 17 |
| LAB830 | 0.91 | 2.83E−04 | 5 | 13 | LAB830 | 0.70 | 5.31E−02 | 5 | 17 |
| LAB830 | 0.70 | 2.39E−02 | 6 | 2 | LAB830 | 0.72 | 4.43E−02 | 3 | 10 |
| LAB830 | 0.78 | 1.36E−02 | 3 | 9 | LAB830 | 0.76 | 1.81E−02 | 2 | 17 |
| LAB831 | 0.78 | 1.39E−02 | 4 | 6 | LAB831 | 0.83 | 5.21E−03 | 4 | 5 |
| LAB831 | 0.78 | 1.37E−02 | 4 | 23 | LAB831 | 0.76 | 1.70E−02 | 4 | 21 |
| LAB831 | 0.81 | 8.17E−03 | 4 | 17 | LAB831 | 0.78 | 1.40E−02 | 3 | 7 |
| LAB831 | 0.75 | 1.97E−02 | 7 | 5 | LAB831 | 0.75 | 1.88E−02 | 7 | 17 |
| LAB832 | 0.87 | 4.87E−03 | 1 | 16 | LAB832 | 0.87 | 4.87E−03 | 3 | 24 |
| LAB832 | 0.89 | 2.94E−03 | 3 | 14 | LAB833 | 0.83 | 6.10E−03 | 4 | 6 |
| LAB833 | 0.82 | 7.18E−03 | 4 | 5 | LAB833 | 0.81 | 8.72E−03 | 4 | 23 |
| LAB833 | 0.80 | 9.65E−03 | 4 | 21 | LAB833 | 0.75 | 1.96E−02 | 4 | 17 |
| LAB834 | 0.74 | 2.27E−02 | 3 | 7 | LAB835 | 0.73 | 1.74E−02 | 6 | 13 |
| LAB835 | 0.78 | 1.37E−02 | 6 | 21 | LAB835 | 0.71 | 4.99E−02 | 6 | 23 |
| LAB835 | 0.70 | 2.30E−02 | 6 | 27 | LAB837 | 0.76 | 2.75E−02 | 4 | 18 |
| LAB837 | 0.73 | 4.01E−02 | 3 | 25 | LAB839 | 0.74 | 1.42E−02 | 6 | 27 |
| LAB839 | 0.79 | 1.15E−02 | 3 | 8 | LAB840 | 0.73 | 3.87E−02 | 1 | 26 |
| LAB840 | 0.70 | 2.29E−02 | 6 | 15 | LAB842 | 0.76 | 1.75E−02 | 1 | 22 |
| LAB842 | 0.78 | 1.25E−02 | 10 | 22 | LAB843 | 0.85 | 3.33E−02 | 9 | 5 |
| LAB843 | 0.81 | 8.16E−03 | 9 | 17 | LAB843 | 0.74 | 1.49E−02 | 6 | 27 |
| LAB843 | 0.75 | 1.29E−02 | 6 | 11 | LAB843 | 0.87 | 2.45E−03 | 2 | 5 |
| LAB843 | 0.81 | 7.50E−03 | 2 | 17 | | | | | |

Table 130. Correlations (R) between the genes expression levels in various tissues and the phenotypic performance. "Corr. ID"—correlation set ID according to the correlated parameters Table 125 above. "Exp. Set"—Expression set. "R" = Pearson correlation coefficient; "P" = p value.

Example 14

Production of Soybean (*Glycine max*) Transcriptom and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 12 varieties were further used for RNA expression analysis. The correlation between the RNA levels and the characterized parameters was analyzed using Pearson correlation test.

Experimental Procedures

Twenty nine Soybean varieties were grown in three repetitive plots, in field. Briefly, the growing protocol was as follows: Soybean seeds were sown in soil and grown under normal conditions until harvest.

Analyzed Soybean Tissues

In order to define correlations between the levels of RNA expression with yield components or plant architecture related parameters or vigor related parameters, 12 different Soybean varieties (out of 29 varieties) were analyzed and used for gene expression analyses as described above. Analysis was performed at two pre-determined time periods: at pod set (when the soybean pods are formed) and at harvest time (when the soybean pods are ready for harvest, with mature seeds). Each micro-array expression information tissue type has received a Set ID as summarized in Table 131 below.

TABLE 131

Soybean transcriptome expression sets

| Expression Set | Set ID |
| --- | --- |
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

Table 131. Provided are the soybean transcriptome expression sets.

RNA extraction—All 12 selected Soybean varieties were sampled. Plant tissues [leaf, root. Stem, Pod, apical meristem, Flower buds] growing under normal conditions were sampled and RNA was extracted as described above.

Soybean Yield Components and Vigor Related Parameters Assessment

The collected data parameters were as follows:

Main branch base diameter [mm] at pod set—the diameter of the base of the main branch (based diameter) average of three plants per plot.

Fresh weight [gr./plant] at pod set—total weight of the vegetative portion above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [num/plant]—counting of nodes which contain pods in lateral branches at pod set, average of three plants per plot.

Number of lateral branches at pod set [num/plant]—counting number of lateral branches at pod set, average of three plants per plot.

Total weight of lateral branches at pod set [gr./plant]—weight all lateral branches at pod set, average of three plants per plot.

Total weight of pods on main stem at pod set [gr./plant]—weight all pods on main stem at pod set, average of three plants per plot.

Total number of nodes on main stem [num/plant]—count of number of nodes on main stem starting from first node above ground, average of three plants per plot.

Total number of pods with 1 seed on lateral branches at pod set [num/plant]—count the number of pods containing 1 seed in all lateral branches at pod set, average of three plants per plot.

Total number of pods with 2 seeds on lateral branches at pod set [num/plant]—count the number of pods containing 2 seeds in all lateral branches at pod set, average of three plants per plot.

Total number of pods with 3 seeds on lateral branches at pod set [num/plant]—count the number of pods containing 3 seeds in all lateral branches at pod set, average of three plants per plot.

Total number of pods with 4 seeds on lateral branches at pod set [num/plant]—count the number of pods containing 4 seeds in all lateral branches at pod set, average of three plants per plot.

Total number of pods with 1 seed on main stem at pod set [num/plant]—count the number of pods containing 1 seed in main stem at pod set, average of three plants per plot.

Total number of pods with 2 seeds on main stem at pod set [num/plant]—count the number of pods containing 2 seeds in main stem at pod set, average of three plants per plot.

Total number of pods with 3 seeds on main stem at pod set [num/plant]—count the number of pods containing 3 seeds in main stem at pod set, average of three plants per plot.

Total number of pods with 4 seeds on main stem at pod set [num/plant]—count the number of pods containing 4 seeds in main stem at pod set, average of three plants per plot.

Total number of seeds per plant at pod set [num/plant]—count number of seeds in lateral branches and main stem at pod set, average of three plants per plot.

Total number of seeds on lateral branches at pod set [num/plant]—count total number of seeds on lateral branches at pod set, average of three plants per plot.

Total number of seeds on main stem at pod set [num/plant]—count total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—calculated in formula XV, average of three plants per plot.

Total number of pods on main stem/Total number of nodes on main stem, average of three plants per plot. Formula XV:

Ratio of total number of seeds in main stem to number of seeds on lateral branches—calculated in formula XVI, average of three plants per plot.

Total number of seeds on main stem at pod set/Total number of seeds on lateral branches at pod set. Formula XVI:

Total weight of pods per plant at pod set [gr./plant]—weight all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, Hypertext Transfer Protocol://World Wide Web (dot) ars-grin (dot) gov/cgi-bin/npgs/html/desclist (dot) pl?51].

Seed quality [ranked 1-5]—measure at harvest, a visual estimate based on several hundred seeds. Parameter is rated according to the following scores considering the amount and degree of wrinkling, defective coat (cracks), greenishness, and moldy or other pigment. Rating is 1-very good, 2-good, 3-fair, 4-poor, 5-very poor.

Lodging [ranked 1-5]—is rated at maturity per plot according to the following scores: 1-most plants in a plot are erected, 2-All plants leaning slightly or a few plants down, 3-all plants leaning moderately, or 25%-50% down, 4-all plants leaning considerably, or 50%-80% down, 5-most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate Num of Seeds on lateral branches-at pod set and divide by the Number of Total number of pods with seeds on lateral branches-at pod set.

Average main stem seeds per pod [number]—Calculate Total Number of Seeds on main stem at pod set and divide by the Number of Total number of pods with seeds on main stem at pod setting.

Main stem average internode length [cm]—Calculate Plant height at pod set and divide by the Total number of nodes on main stem at pod setting.

Total num of pods with seeds on main stem [number]—count all pods containing seeds on the main stem at pod setting.

Total num of pods with seeds on lateral branches [number]—count all pods containing seeds on the lateral branches at pod setting.

Total number of pods per plant at pod set [number]—count pods on main stem and lateral branches at pod setting.

Data parameters collected are summarized in Table 132, herein below

TABLE 132

| Soybean correlated parameters (vectors) | |
|---|---|
| Correlated parameter with | Correlation ID |
| 100 percent flowering (days) | 1 |
| 50 percent flowering (days) | 2 |
| Base diameter at pod set (mm) | 3 |
| DW at pod set (gr/plant) | 4 |
| Lodging (ranked 1-5) | 5 |
| Maturity (days) | 6 |
| Num of lateral branches (num) | 7 |
| Num of pods with 1 seed on main stem at pod set (num) | 8 |
| Num of pods with 2 seed on main stem (num) | 9 |

TABLE 132-continued

| Soybean correlated parameters (vectors) | |
|---|---|
| Correlated parameter with | Correlation ID |
| Num of pods with 3 seed on main stem (num) | 10 |
| Num of pods with 4 seed on main stem (num) | 11 |
| Plant height at harvest (cm) | 12 |
| Plant height at pod set (cm) | 13 |
| Ratio number of pods per node on main stem | 14 |
| Ratio number of seeds per main stem to seeds per 1 | 15 |
| Seed quality (ranked 1-5) | 16 |
| Seed size (gr) | 17 |
| Total Number of Seeds on lateral branches (num) | 18 |
| Total Number of Seeds on main stem at pod set (num) | 19 |
| Total no of pods with 1 seed on lateral branch (num) | 20 |
| Total no of pods with 2 seed on lateral branch (num) | 21 |
| Total no of pods with 3 seed on lateral branch (num) | 22 |
| Total no of pods with 4 seed on lateral branch (num) | 23 |
| Total number of nodes on main stem (num) | 24 |
| Total number of nodes with pods on lateral branch (num) | 25 |
| Total number of seeds per plant (num) | 26 |
| Total weight of lateral branches at pod set (gr/plant) | 27 |
| Total weight of pods on lateral branches (gr/plant) | 28 |
| Total weight of pods on main stem at pod set (gr/plant) | 29 |
| Total weight of pods per plant (gr/plant) | 30 |
| Total weight of seeds per plant (gr/plant) | 31 |
| fresh weight at pod set (gr/plant) | 32 |
| yield at harvest (bushels/hectare) | 33 |
| Average lateral branch seeds per pod (num) | 34 |
| Average main stem seeds per pod (num) | 35 |
| Main stem average internode length (cm) | 36 |
| Num pods with seeds on lateral branches-at pod set (num) | 37 |
| Total number of pods per plant at pod set (num) | 38 |
| Total number of pods with seeds on main stem at pod set (num) | 39 |
| Seed size (gr) | 40 |

Table 132. Provided are the soybean correlated parameters. "DW" = dry weight;

Experimental Results

The different soybean accessions were grown and characterized for different parameters as described above. Table 132 describes the soybean correlated parameters. The average for each of the measured parameter was calculated using the JMP software and values are summarized in Tables 133-134 below. Subsequent correlation analysis between the various transcriptom sets and the average parameters (Table 135) was conducted. Follow, results were integrated to the database.

TABLE 133

Measured parameters in Soybean varieties (lines 1-6)

| Corr. ID | Line-1 | Line-2 | Line-3 | Line-4 | Line-5 | Line-6 |
|---|---|---|---|---|---|---|
| 1 | 67.33 | 71.67 | 67.67 | 67.33 | 60 | 74 |
| 2 | 61 | 65.33 | 60.67 | 61 | 54.67 | 68.33 |
| 3 | 8.333 | 9.544 | 9.678 | 8.111 | 8.822 | 10.12 |
| 4 | 53.67 | 50.33 | 38 | 46.17 | 60.83 | 55.67 |
| 5 | 1.667 | 1.833 | 1.167 | 1.667 | 2.667 | 2.833 |
| 6 | 24 | 43.67 | 30.33 | 30.33 | 38.33 | 40 |
| 7 | 9 | 8.667 | 9.111 | 9.889 | 7.667 | 17.56 |
| 8 | 1.111 | 4.375 | 1.444 | 1.444 | 4.556 | 1.667 |
| 9 | 16.89 | 16.25 | 13.22 | 16.89 | 27 | 8.111 |
| 10 | 29.56 | 1.75 | 19.78 | 22.33 | 11.67 | 22.78 |
| 11 | 0 | 0 | 0.111 | 0.111 | 0 | 0.444 |
| 12 | 96.67 | 76.67 | 67.5 | 75.83 | 74.17 | 76.67 |
| 13 | 86.78 | 69.56 | 62.44 | 70.89 | 69.44 | 63.89 |
| 14 | 2.874 | 1.377 | 2.132 | 2.256 | 2.6 | 1.87 |
| 15 | 0.893 | 0.896 | 0.869 | 0.891 | 2.316 | 0.365 |
| 16 | 2.333 | 3.5 | 3 | 2.167 | 2.833 | 2 |
| 17 | 89 | 219.3 | 93 | 86 | 191.3 | 71.33 |
| 18 | 150.9 | 55.89 | 134 | 160.4 | 75.44 | 324.6 |

TABLE 133-continued

Measured parameters in Soybean varieties (lines 1-6)

| Corr. ID | Line-1 | Line-2 | Line-3 | Line-4 | Line-5 | Line-6 |
|---|---|---|---|---|---|---|
| 19 | 123.6 | 43.89 | 87.67 | 102.7 | 93.56 | 88 |
| 20 | 1.556 | 3 | 1.778 | 1.778 | 5.667 | 5.625 |
| 21 | 17 | 18.75 | 26.44 | 32.33 | 21.56 | 33.5 |
| 22 | 38.44 | 2 | 26.44 | 31.33 | 8.889 | 82 |
| 23 | 0 | 0 | 0 | 0 | 0 | 1.5 |
| 24 | 16.56 | 16.78 | 16.11 | 18.11 | 16.78 | 17.11 |
| 25 | 23 | 16 | 23.11 | 33 | 15.22 | 45.25 |
| 26 | 274.4 | 99.78 | 221.7 | 263.1 | 169 | 412.5 |
| 27 | 67.78 | 63.78 | 64.89 | 74.89 | 54 | 167.2 |
| 28 | 26 | 14.89 | 20.11 | 20.11 | 21.11 | 30.25 |
| 29 | 22.11 | 14.33 | 16 | 15 | 33.78 | 9 |
| 30 | 48.11 | 29.22 | 36.11 | 35.11 | 54.89 | 38.88 |
| 31 | 15.09 | 10.5 | 17.23 | 16.51 | 12.06 | 10.25 |
| 32 | 170.9 | 198.2 | 152.6 | 163.9 | 224.7 | 265 |
| 33 | 47.57 | 43.77 | 50.37 | 56.3 | 44 | 40.33 |
| 34 | 2.67 | 1.95 | 2.431 | 2.529 | 2.127 | 2.677 |
| 35 | 2.599 | 1.895 | 2.523 | 2.525 | 2.167 | 2.591 |
| 36 | 5.243 | 4.152 | 3.914 | 3.921 | 4.154 | 3.742 |
| 37 | 57 | 28.56 | 54.67 | 65.44 | 36.11 | 122.6 |
| 38 | 104.6 | 51.67 | 89.22 | 106.2 | 79.33 | 155.6 |
| 39 | 47.56 | 23.11 | 34.56 | 40.78 | 43.22 | 33 |
| 40 | 89 |  | 93 | 86 |  | 71.33 |

Table 133. Provided are the values of each of the parameters (as described above) measured in soybean accessions (line) under normal growth conditions. Growth conditions are specified in the experimental procedure section.

TABLE 134

Measured parameters in Soybean varieties (lines 7-12)

| Corr ID | Line-7 | Line-8 | Line-9 | Line-10 | Line-11 | Line-12 |
|---|---|---|---|---|---|---|
| 1 | 73 | 72.33 | 68.67 | 73.67 | 68 | 70.67 |
| 2 | 66.5 | 65.67 | 62.33 | 67.67 | 61.67 | 64.33 |
| 3 | 8.456 | 8.089 | 8.256 | 7.733 | 8.156 | 7.889 |
| 4 | 48 | 52 | 44.17 | 52.67 | 56 | 47.5 |
| 5 | 2.667 | 2.5 | 1.833 | 3.5 | 3.333 | 1.5 |
| 6 | 41 | 38.33 | 31 | 39 | 27.33 | 32.67 |
| 7 | 11.67 | 12.11 | 8 | 9.111 | 6.778 | 10 |
| 8 | 4 | 4.333 | 2.111 | 1.889 | 3.444 | 1.222 |
| 9 | 21.33 | 17.67 | 20.33 | 16.11 | 28.11 | 16.56 |
| 10 | 11.11 | 28.22 | 24.11 | 36.44 | 39.67 | 32.33 |
| 11 | 0 | 0.556 | 0 | 3.889 | 0 | 0 |
| 12 | 101.7 | 98.33 | 75.83 | 116.7 | 76.67 | 71.67 |
| 13 | 89.78 | 82.11 | 70.56 | 101.7 | 79.56 | 67.22 |
| 14 | 1.98 | 2.712 | 2.777 | 2.754 | 3.7 | 2.836 |
| 15 | 3.9 | 0.783 | 1.183 | 1.984 | 1.033 | 0.832 |
| 16 | 3.5 | 2.5 | 2.167 | 2.333 | 2.167 | 2.167 |
| 17 | 88 | 75 | 80.67 | 75.67 | 76.33 | 77.33 |
| 18 | 46.88 | 176.2 | 143 | 105.4 | 184.3 | 187.3 |
| 19 | 80 | 126.6 | 115.1 | 159 | 178.7 | 131.3 |
| 20 | 2.875 | 3 | 1.25 | 2.667 | 1.778 | 3 |
| 21 | 8.5 | 22.78 | 21.75 | 10.67 | 23.78 | 25.67 |
| 22 | 9 | 42.11 | 32.75 | 25.67 | 45 | 44.33 |
| 23 | 0 | 0.333 | 0 | 1.111 | 0 | 0 |
| 24 | 18.78 | 18.89 | 16.78 | 21.11 | 19.33 | 20.78 |
| 25 | 8.25 | 25.44 | 21.88 | 16.33 | 22.56 | 24.22 |
| 26 | 136 | 302.8 | 260.5 | 264.4 | 363 | 318.7 |
| 27 | 45.44 | 83.22 | 64.33 | 52 | 76.89 | 67 |
| 28 | 4.125 | 20.11 | 17 | 9.222 | 28.11 | 22.56 |
| 29 | 9.033 | 16 | 15.89 | 14.56 | 30.44 | 18 |
| 30 | 14.25 | 36.11 | 32.75 | 23.78 | 58.56 | 40.56 |
| 31 | 7.297 | 11.38 | 15.68 | 10.83 | 12.98 | 15.16 |
| 32 | 160.7 | 196.3 | 155.3 | 178.1 | 204.4 | 164.2 |
| 33 | 34.23 | 44.27 | 53.67 | 42.47 | 43.6 | 52.2 |
| 34 | 2.12 | 2.581 | 2.583 | 2.668 | 2.62 | 2.578 |
| 35 | 2.218 | 2.487 | 2.474 | 2.713 | 2.512 | 2.609 |
| 36 | 4.803 | 4.357 | 4.203 | 4.825 | 4.116 | 3.827 |
| 37 | 20.38 | 68.22 | 55.75 | 40.11 | 70.56 | 73 |
| 38 | 61 | 119 | 103.3 | 98.44 | 141.8 | 123.1 |
| 39 | 36.44 | 50.78 | 43.63 | 58.33 | 71.22 | 50.11 |
| 40 | 88 | 75 | 80.67 | 75.67 | 76.33 | 77.33 |

Table 134. Provided are the values of each of the parameters (as described above) measured in soybean accessions (line) under normal growth conditions. Growth conditions are specified in the experimental procedure section.

TABLE 135

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LAB800 | 0.74 | 1.34E−02 | 8 | 13 | LAB800 | 0.72 | 1.88E−02 | 8 | 12 |
| LAB800 | 0.82 | 1.37E−02 | 9 | 31 | LAB800 | 0.78 | 2.59E−03 | 10 | 11 |
| LAB801 | 0.78 | 7.42E−03 | 7 | 13 | LAB801 | 0.80 | 5.32E−03 | 7 | 12 |
| LAB801 | 0.77 | 8.64E−03 | 5 | 10 | LAB801 | 0.72 | 1.79E−02 | 5 | 19 |
| LAB801 | 0.82 | 1.23E−02 | 9 | 12 | LAB801 | 0.75 | 4.70E−03 | 4 | 10 |
| LAB804 | 0.84 | 8.63E−03 | 9 | 15 | LAB804 | 0.79 | 2.40E−03 | 10 | 9 |
| LAB807 | 0.72 | 1.82E−02 | 7 | 31 | LAB807 | 0.72 | 1.83E−02 | 7 | 33 |
| LAB807 | 0.82 | 3.44E−03 | 5 | 17 | LAB807 | 0.84 | 8.99E−03 | 9 | 15 |
| LAB807 | 0.76 | 2.94E−03 | 9 | 9 | LAB809 | 0.83 | 8.97E−04 | 4 | 22 |
| LAB809 | 0.83 | 7.81E−04 | 4 | 18 | LAB809 | 0.83 | 8.05E−04 | 4 | 23 |
| LAB809 | 0.89 | 9.50E−05 | 4 | 27 | LAB809 | 0.84 | 6.37E−04 | 4 | 7 |
| LAB809 | 0.85 | 5.19E−04 | 4 | 25 | LAB810 | 0.71 | 2.02E−02 | 8 | 10 |
| LAB810 | 0.75 | 3.18E−02 | 9 | 9 | LAB810 | 0.73 | 4.10E−02 | 9 | 30 |
| LAB810 | 0.76 | 2.94E−02 | 9 | 14 | LAB810 | 0.91 | 1.95E−03 | 9 | 29 |
| LAB810 | 0.73 | 7.61E−03 | 10 | 4 | LAB810 | 0.78 | 2.87E−03 | 10 | 5 |
| LAB811 | 0.78 | 7.90E−03 | 7 | 32 | LAB811 | 0.73 | 1.64E−02 | 8 | 22 |
| LAB811 | 0.72 | 1.84E−02 | 8 | 18 | LAB811 | 0.76 | 1.06E−02 | 8 | 26 |
| LAB801 | 0.73 | 7.28E−03 | 4 | 34 | LAB802 | 0.74 | 3.75E−02 | 9 | 36 |
| LAB804 | 0.74 | 1.44E−02 | 8 | 36 | LAB807 | 0.77 | 3.21E−03 | 10 | 36 |
| LAB809 | 0.83 | 9.26E−04 | 4 | 37 | LAB810 | 0.71 | 4.86E−02 | 9 | 39 |
| LAB810 | 0.71 | 9.69E−03 | 10 | 39 | LAB811 | 0.71 | 2.17E−02 | 8 | 37 |
| LAB811 | 0.79 | 6.78E−03 | 8 | 2 | LAB811 | 0.79 | 6.66E−03 | 8 | 34 |
| LAB811 | 0.72 | 1.77E−02 | 8 | 38 | LAB802 | 0.83 | 1.08E−02 | 5 | 40 |

TABLE 135-continued

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LAB800 | 0.82 | 1.25E−02 | 5 | 40 | LAB803 | 0.88 | 3.86E−03 | 5 | 40 |
| LAB801 | 0.90 | 2.27E−03 | 8 | 40 | LAB805 | 0.81 | 1.38E−02 | 5 | 40 |
| LAB802 | 0.74 | 5.68E−02 | 9 | 40 | LAB809 | 0.77 | 2.44E−02 | 5 | 40 |
| LAB804 | 0.93 | 7.37E−04 | 8 | 40 | LAB800 | 0.71 | 2.07E−02 | 1 | 40 |
| LAB807 | 0.76 | 2.70E−02 | 8 | 40 | | | | | |

Table 135. Correlations (R) between the genes expression levels in various tissues and the phenotypic performance. "Corr. ID"—correlation set ID according to the correlated parameters Table above. "Exp. Set"—Expression set. "R" = Pearson correlation coefficient; "P" = p value.

Example 15

Plant Fiber Development in Cotton Production of Cotton Transcriptom and High Throughput Correlation Analysis Using Cotton Oligonucleotide Microarray In order to conduct high throughput gene expression correlation analysis, the present inventors used cotton oligonucleotide microarray, designed and produced by "Comparative Evolutionary Genomics of Cotton" [Hypertext Transfer Protocol cottonevolution (dot) info/). This Cotton Oligonucleotide Microarray is composed of 12,006 Integrated DNA Technologies (IDT) oligonucleotides derived from an assembly of more than 180,000 Gossypium ESTs sequenced from 30 cDNA libraries. For additional details see PCT/IL2005/000627 and PCT/IL2007/001590 which are fully incorporated herein by reference.

TABLE 136

Cotton transcriptom experimental sets

| Expression Set | Set ID |
|---|---|
| cotton fiber 5 d | 1 |
| cotton fiber 10 d | 2 |
| cotton fiber 15 d | 3 |

Table 136. Provided are the cotton transcriptom expression sets. "5 d" = 5 days post anthesis; "10 d" = 10 days post anthesis; "15 d" = 15 days post anthesis. "DPA" = days-past-anthesis.

In order to define correlations between the levels of RNA expression and fiber length, fibers from 8 different cotton lines were analyzed. These fibers were selected showing very good fiber quality and high lint index (Pima types, originating from other cotton species, namely G. barbadense), different levels of quality and lint indexes from various G. hirsutum lines: good quality and high lint index (Acala type), and poor quality and short lint index (Tamcot type, and old varieties). A summary of the fiber length of the different lines is provided in Table 137.

Experimental Procedures

RNA extraction—Fiber development stages, representing different fiber characteristics, at 5, 10 and 15 DPA were sampled and RNA was extracted as described above.

Fiber length assessment—Fiber length of the selected cotton lines was measured using fibrograph. The fibrograph system was used to compute length in terms of "Upper Half Mean" length. The upper half mean (UHM) is the average length of longer half of the fiber distribution. The fibrograph measures length in span lengths at a given percentage point World Wide Web (dot) cottoninc (dot) com/Classification-ofCotton/?Pg=4#Length].

Experimental Results

Eight different cotton lines were grown, and their fiber length was measured. The fibers UHM values are summarized in Table 137 herein below. The R square was calculated (Table 138).

TABLE 137

Summary of the fiber length of the 8 different cotton lines

| Line/Correlation ID | Fiber Length (UHM) |
|---|---|
| Line-1 | 1.21 |
| Line-2 | 1.1 |
| Line-3 | 1.36 |
| Line-4 | 1.26 |
| Line-5 | 0.89 |
| Line-6 | 1.01 |
| Line-7 | 1.06 |
| Line-8 | 1.15 |

Table 137: Presented are the fiber length means of 8 different cotton lines.

TABLE 138

Correlation between the expression level of selected genes of some embodiments of the invention in various tissues and the phenotypic performance under normal conditions in cotton

| Gene Name | R | P value | Exp. set |
|---|---|---|---|
| LAB672 | 0.84 | 8.50E−03 | 1 |

Table 138. Correlations (R) between the genes expression levels in various tissues and the phenotypic performance. "Corr. ID"—correlation set ID according to the correlated parameters Table above. "Exp. Set"—Expression set. "R" = Pearson correlation coefficient; "P" = p value Example 16

Production of Arabidopsis Transcriptom and High Throughput Correlation Analysis of Yield, Biomass and/or Vigor Related Parameters Using 44K Arabidopsis Full Genome Oligonucleotide Micro-Array To produce a high throughput correlation analysis comparing between plant phenotype and gene expression level, the present inventors utilized an Arabidopsis thaliana oligonucleotide micro-array, produced by Agilent Technologies [Hypertext Transfer Protocol://World Wide Web (dot) chem. (dot) agilent (dot) com/Scripts/PDS (dot) asp?1Page=50879]. The array oligonucleotide represents about 40,000 A. thaliana genes and transcripts designed based on data from the TIGR ATH1 v.5 database and Arabidopsis MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described above. Each microarray expression information tissue type has received a Set ID as summarized in Table 139 below.

TABLE 139

Tissues used for *Arabidopsis* transcriptom expression sets

| Expression Set | Set ID |
|---|---|
| Leaf | 1 |
| Root | 2 |
| Seed 5 DAF | 3 |
| Flower | 4 |
| Seed 12 DAF | 5 |

Table 139: Provided are the identification (ID) numbers of each of the *Arabidopsis* expression sets (1-5). DAF = days after flowering.

Yield components and vigor related parameters assessment—Nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in vertical grown transparent agar plates (seedling analysis). Most of chosen parameters were analyzed by digital imaging.

Digital imaging for seedling analysis—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P43.0 GHz processor) and a public domain program—ImageJ 1.37, Java based image processing program, which was developed at the U.S. National Institutes of Health and is freely available on the internet at Hypertext Transfer Protocol://rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Figure 3A:
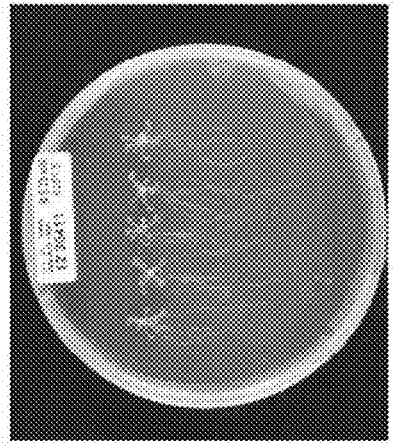
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
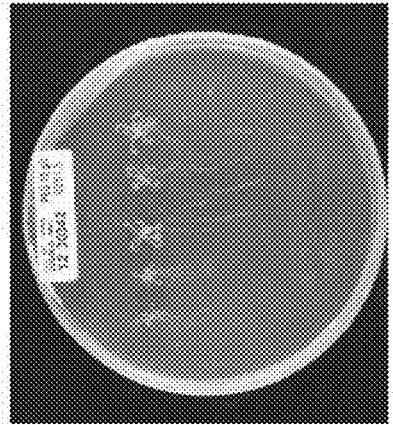
Figure 3E:
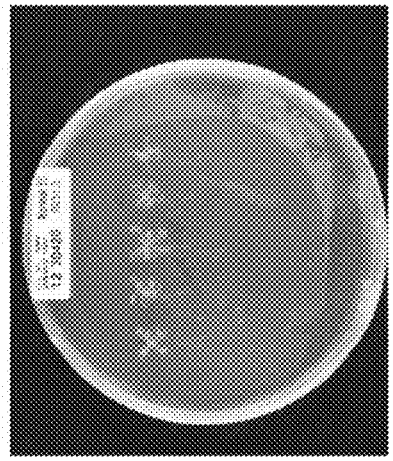
Figure 3B:
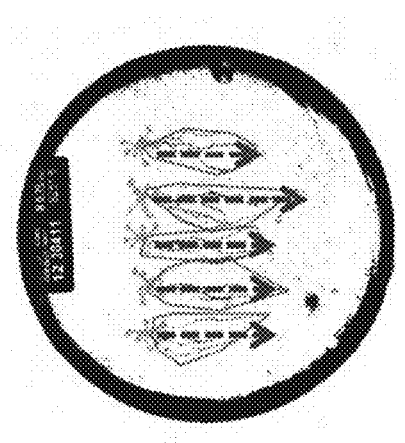
Figure 3D:
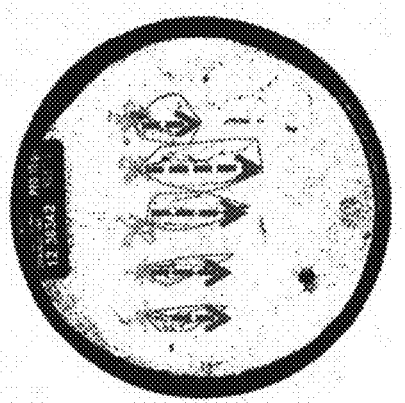
Figure 3F:
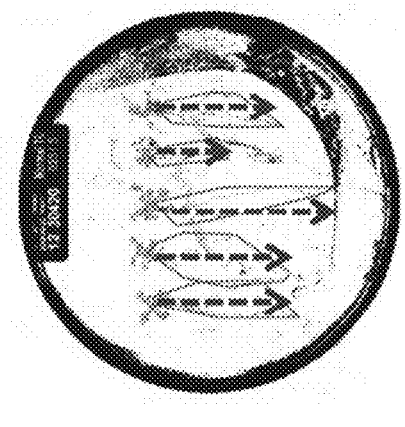
Figure 4:
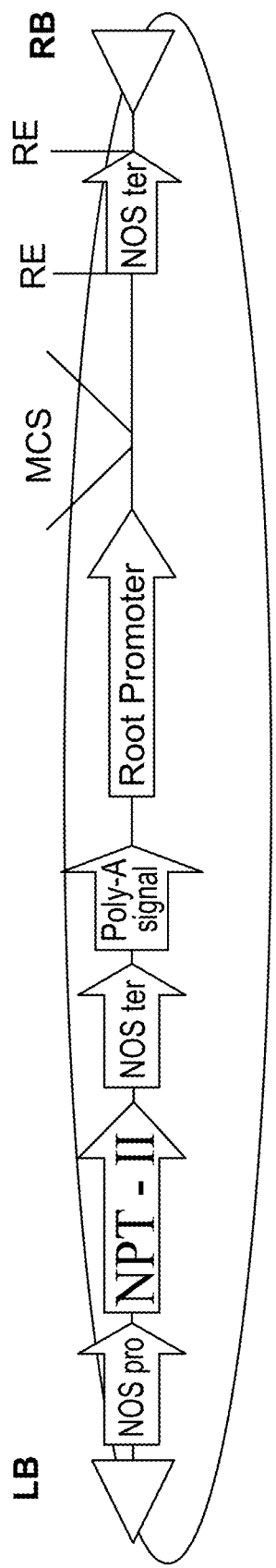
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS (Multiple cloning site) of the vector.
Figure 5:
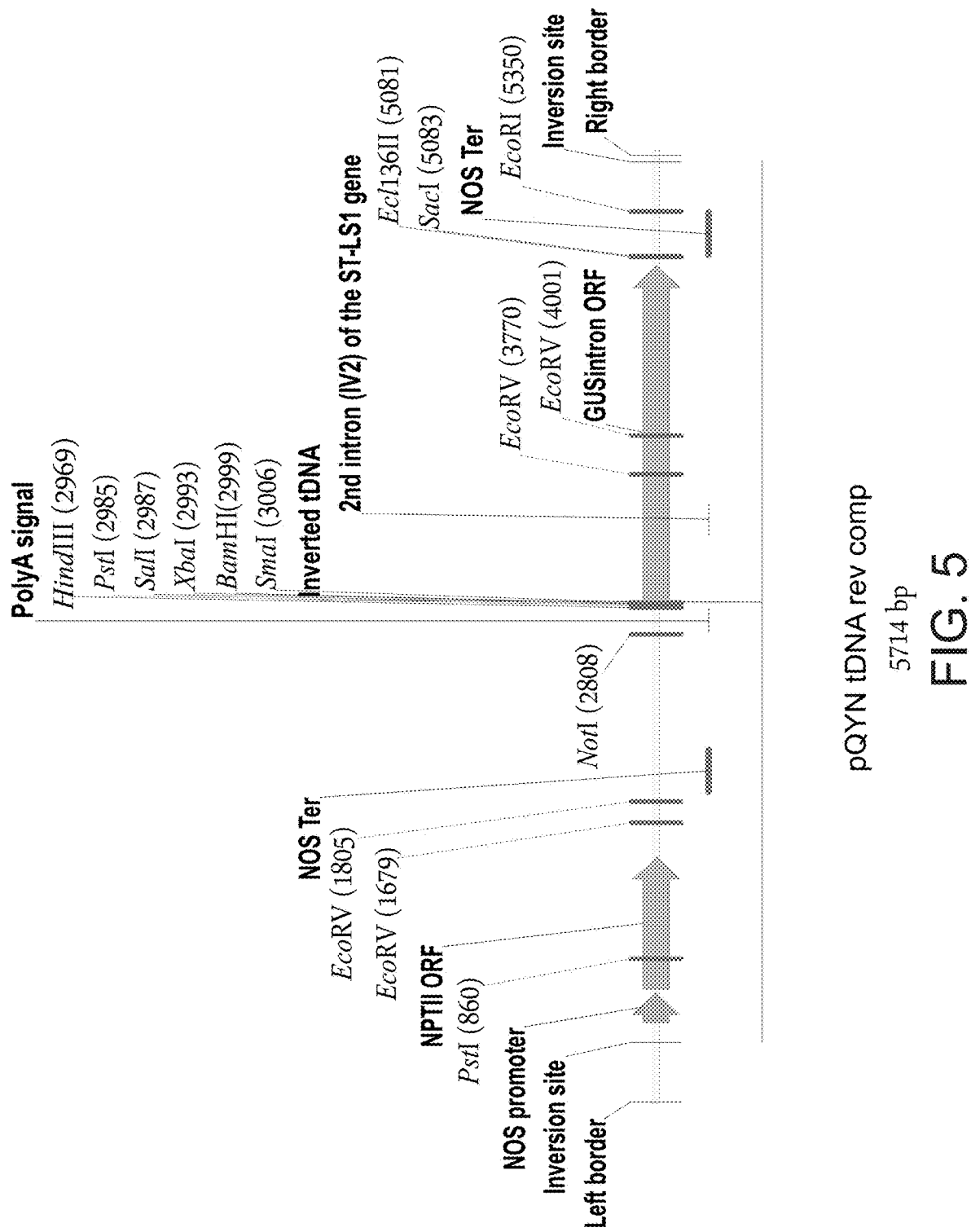
FIG. 5 is a schematic illustration of the pQYN plasmid.
Figure 6:
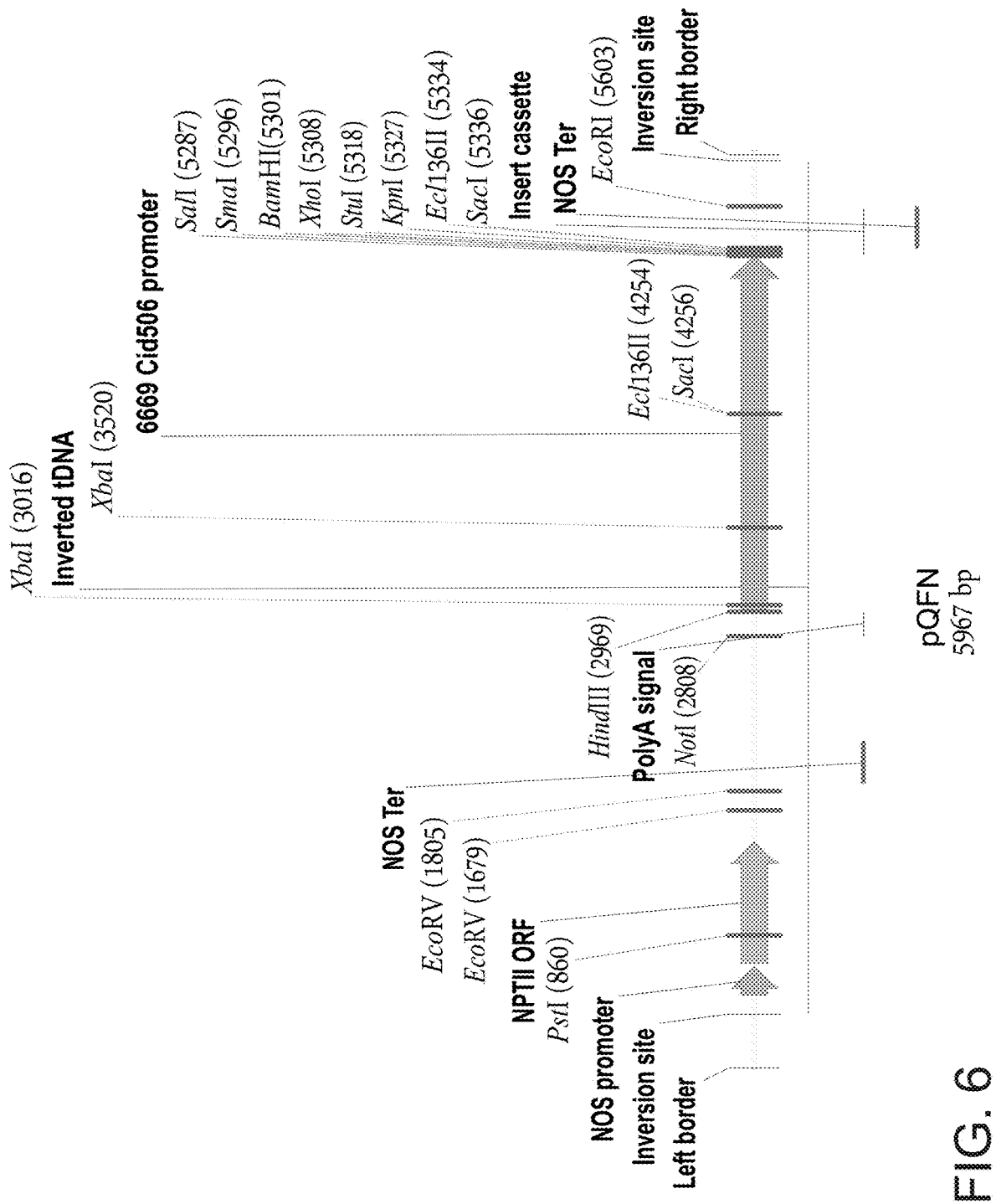
FIG. 6 is a schematic illustration of the pQFN plasmid.
Figure 7:
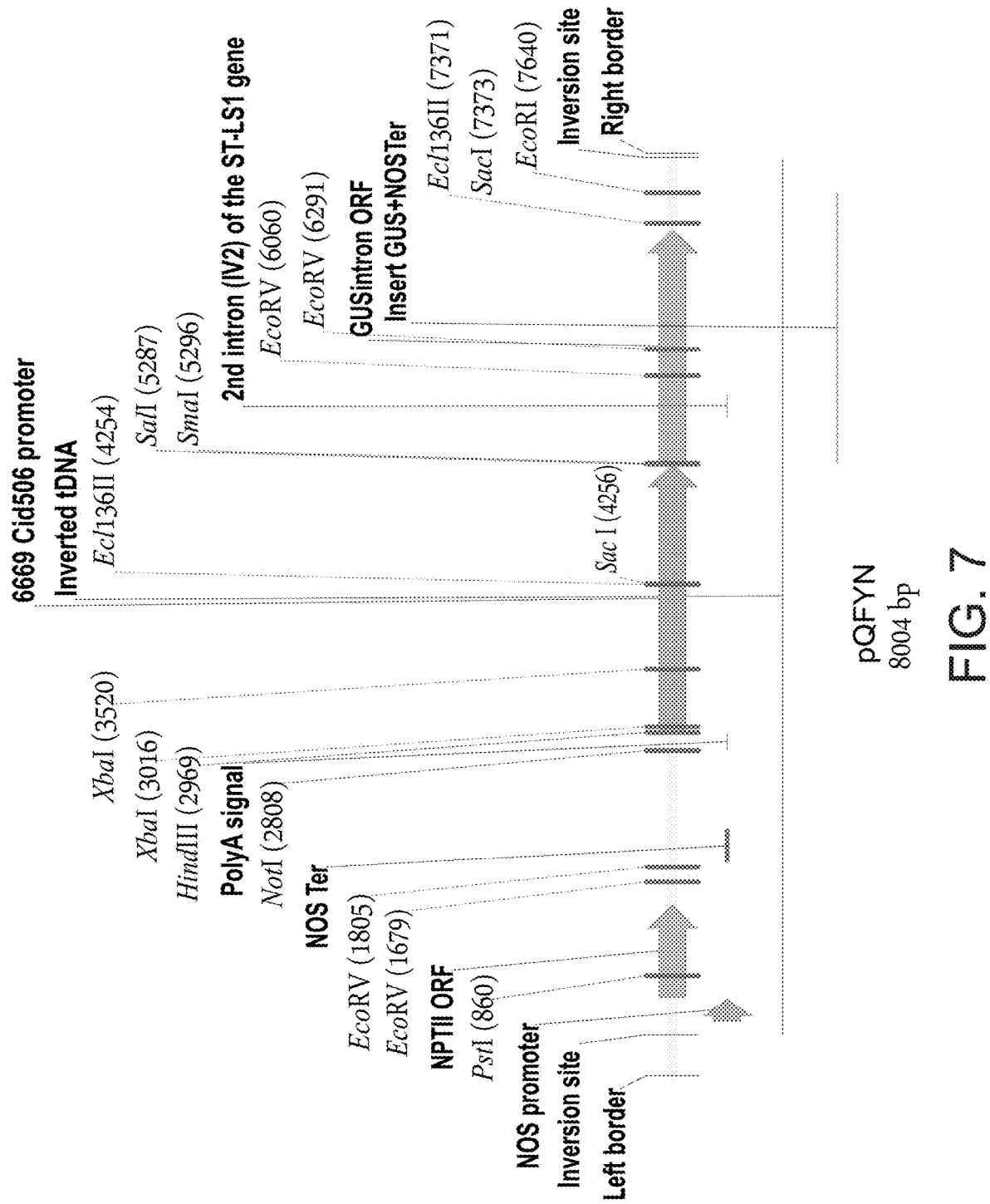
FIG. 7 is a schematic illustration of the pQFYN plasmid.
Figure 8:
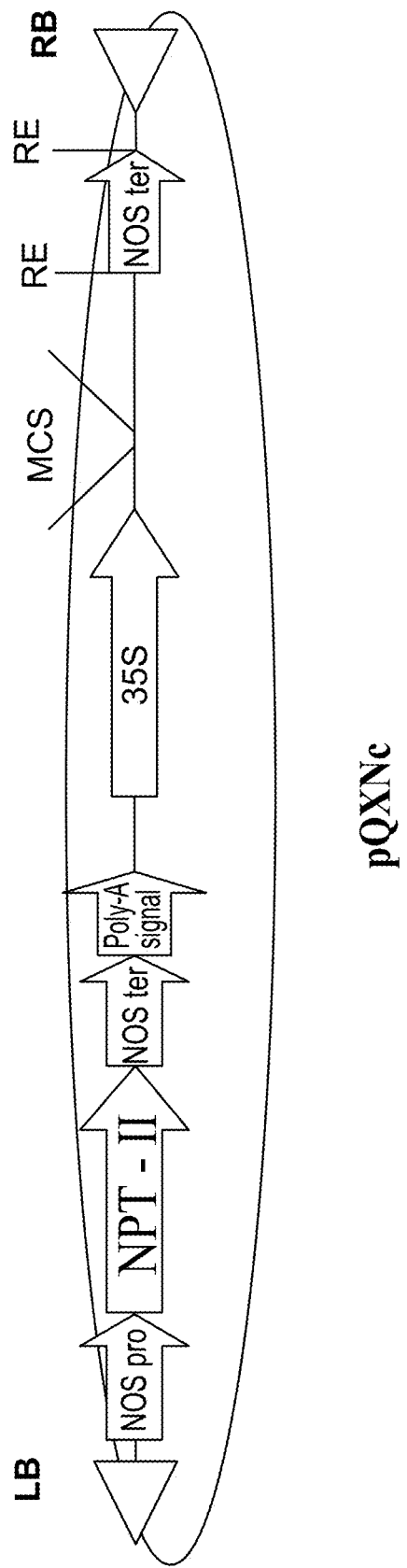
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pQFNC; SEQ ID NO: 10442). The isolated polynucleotide sequences of some embodiments of the invention were cloned into the MCS (Multiple cloning site) of the vector.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula XVII.

Relative growth rate of root length=Regression coefficient of root length along time course (measured in cm per day).     Formula XVII Vegetative growth rate analysis—was calculated according to Formula XVII below.

Relative growth rate of vegetative growth=Regression coefficient of leaf area along time course (measured in $cm^2$ per day).     Formula XVII:

The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr.).

Oil yield—The oil yield was calculated using Formula XIX.

Seed Oil yield=Seed yield per plant (gr.)*Oil % in seed.     Formula XIX

Harvest Index (seed)—The harvest index was calculated using Formula IV (described above).

Experimental Results

Nine different *Arabidopsis* ecotypes were grown and characterized for 18 parameters (named as vectors). Table 140 describes the *Arabidopsis* correlated parameters. The average for each of the measured parameter was calculated using the JMP software (Tables 141-142) and a subsequent correlation analysis was performed (Table 143). Results were then integrated to the database.

TABLE 140

*Arabidopsis* correlated parameters (vectors)

| Correlated parameter with | Correlation ID |
|---|---|
| Blade circularity | 1 |
| Dry matter per plant (gr.) | 2 |
| Harvest Index | 3 |
| Lamina length (cm) | 4 |
| Lamina width (cm) | 5 |
| Leaf width/length | 6 |
| Oil % per seed (%) | 7 |
| Oil yield per plant (mg) | 8 |
| Seeds per Pod (num) | 9 |
| Silique length (cm) | 10 |
| Total leaf area per plant (cm2) | 11 |
| Vegetative growth rate ($cm^2$/day) till 8 true leaves | 12 |
| Fresh weight per plant (gr.) at bolting stage | 13 |
| Relative root length growth (cm/day) day 13 | 14 |
| Root length day 13 (cm) | 15 |
| Root length day 7 (cm) | 16 |
| 1000 Seed weight (gr.) | 17 |
| Seed yield per plant (gr.) | 18 |

Table 140. Provided are the *Arabidopsis* correlated parameters (correlation ID Nos. 1-18). Abbreviations: Cm = centimeter(s); gr. = gram(s); mg = milligram(s).

The characterized values are summarized in Tables 141 and 142 below.

TABLE 141

Measured parameters in *Arabidopsis* ecotypes

| Line | Corr. ID | | | | | | | | |
|---|---|---|---|---|---|---|---|---|---|
|  | 1 | 2 | 3 | 4 | 5 | 6 | 7 | 8 | 9 |
| Line-1 | 0.51 | 0.64 | 0.53 | 2.77 | 1.38 | 0.35 | 34.42 | 118.63 | 45.44 |
| Line-2 | 0.48 | 1.27 | 0.35 | 3.54 | 1.70 | 0.29 | 31.19 | 138.73 | 53.47 |
| Line-3 | 0.45 | 1.05 | 0.56 | 3.27 | 1.46 | 0.32 | 38.05 | 224.06 | 58.47 |
| Line-4 | 0.37 | 1.28 | 0.33 | 3.78 | 1.37 | 0.26 | 27.76 | 116.26 | 35.27 |
| Line-5 | 0.50 | 1.69 | 0.37 | 3.69 | 1.83 | 0.36 | 35.49 | 218.27 | 48.56 |
| Line-6 | 0.38 | 1.34 | 0.32 | 4.60 | 1.65 | 0.27 | 32.91 | 142.11 | 37.00 |
| Line-7 | 0.39 | 0.81 | 0.45 | 3.88 | 1.51 | 0.30 | 31.56 | 114.15 | 39.38 |
| Line-8 | 0.49 | 1.21 | 0.51 | 3.72 | 1.82 | 0.34 | 30.79 | 190.06 | 40.53 |
| Line-9 | 0.41 | 1.35 | 0.41 | 4.15 | 1.67 | 0.31 | 34.02 | 187.62 | 25.53 |

Table 141: Provided are the values of each of the parameters (as described above) measured in *arabidopsis* accessions (line). Growth conditions are specified in the experimental procedure section.

TABLE 142

Additional measured parameters in *Arabidopsis* ecotypes

| Line | Corr. ID | | | | | | | | |
|---|---|---|---|---|---|---|---|---|---|
|  | 10 | 11 | 12 | 13 | 14 | 15 | 16 | 17 | 18 |
| Line-1 | 1.06 | 46.86 | 0.31 | 1.51 | 0.63 | 4.42 | 0.94 | 0.0203 | 0.34 |
| Line-2 | 1.26 | 109.89 | 0.38 | 3.61 | 0.66 | 8.53 | 1.76 | 0.0230 | 0.44 |
| Line-3 | 1.31 | 58.36 | 0.48 | 1.94 | 1.18 | 5.62 | 0.70 | 0.0252 | 0.59 |
| Line-4 | 1.47 | 56.80 | 0.47 | 2.08 | 1.09 | 4.83 | 0.73 | 0.0344 | 0.42 |
| Line-5 | 1.24 | 114.66 | 0.43 | 3.56 | 0.91 | 5.96 | 0.99 | 0.0202 | 0.61 |
| Line-6 | 1.09 | 110.82 | 0.64 | 4.34 | 0.77 | 6.37 | 1.16 | 0.0263 | 0.43 |
| Line-7 | 1.18 | 88.49 | 0.43 | 3.47 | 0.61 | 5.65 | 1.28 | 0.0205 | 0.36 |
| Line-8 | 1.18 | 121.79 | 0.38 | 3.48 | 0.70 | 7.06 | 1.41 | 0.0226 | 0.62 |
| Line-9 | 1.00 | 93.04 | 0.47 | 3.71 | 0.78 | 7.04 | 1.25 | 0.0235 | 0.55 |

Table 142: Provided are the values of each of the parameters (as described above) measured in *arabidopsis* accessions (line). Growth conditions are specified in the experimental procedure section.

TABLE 143

Correlation between the expression level of selected LAB genes of some embodiments of the invention in various tissues and the phenotypic performance under normal conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LAB618 | 0.81 | 1.51E−02 | 2 | 2 | LAB618 | 0.75 | 3.37E−02 | 2 | 12 |
| LAB618 | 0.80 | 3.24E−02 | 3 | 3 | LAB618 | 0.73 | 4.11E−02 | 4 | 4 |
| LAB618 | 0.83 | 1.16E−02 | 4 | 12 | LAB618 | 0.79 | 1.98E−02 | 1 | 18 |
| LAB618 | 0.79 | 1.94E−02 | 1 | 8 | LAB619 | 0.71 | 7.36E−02 | 3 | 12 |
| LAB619 | 0.85 | 7.36E−03 | 1 | 3 | LAB619 | 0.87 | 5.40E−03 | 1 | 7 |

Table 143. Correlations (R) between the genes expression levels in various tissues and the phenotypic performance. "Corr. ID"—correlation set ID according to the correlated parameters Table above. "Exp. Set"—Expression set. "R" = Pearson correlation coefficient; "P" = p value

Example 17

Production of *Arabidopsis* Transcriptom and High Throughput Correlation Analysis Using 44K *Arabidopsis* Oligonucleotide Micro-Array In order to produce a high throughput correlation analysis comparing between plant phenotype and gene expression level, the present inventors utilized a *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Two tissues of plants [leaves and stems] growing at two different nitrogen fertilization levels (1.5 mM Nitrogen or 6 mM Nitrogen) were sampled and RNA was extracted as described above. Each micro-array expression information tissue type has received a Set ID as summarized Table 135 below.

TABLE 144

*Arabidopsis* transcriptom experimental sets

| Expression Set | Set ID |
|---|---|
| Leaves at 6 mM Nitrogen fertilization | 1 |
| Leaves at 1.5 mM Nitrogen fertilization | 2 |
| Stems at 1.5 mM Nitrogen fertilization | 3 |
| Stem at 6 mM Nitrogen fertilization | 4 |

Table 144. Provided are the *arabidopsis* transcriptome expression sets.

*Arabidopsis* yield components and vigor related parameters under different nitrogen fertilization levels assessment—10 *Arabidopsis* accessions in 2 repetitive plots each containing 8 plants per plot were grown at greenhouse. The growing protocol used was as follows: surface sterilized seeds were sown in Eppendorf tubes containing 0.5×Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO3$ and microelements, while normal irrigation conditions was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]). Next, analyzed data was saved to text files and processed using the JMP statistical analysis software (SAS institute).

Data parameters collected are summarized in Table 145, hereinbelow.

TABLE 145

*Arabidopsis* correlated parameters (vectors)

| Correlated parameter with | Correlation ID |
|---|---|
| N 1.5 mM 1000 Seeds weight (gr) | 1 |
| N 1.5 mM Biomass reduction compared to 6 mM | 2 |
| N 1.5 mM DW/SPAD (gr/SPAD unit) | 3 |
| N 1.5 mM Dry Weight (gr) | 4 |
| N 1.5 mM Harvest Index | 5 |
| N 1.5 mM Leaf Blade Area 10 day ($cm^2$) | 6 |
| N 1.5 mM Leaf Number 10 day (num) | 7 |
| N 1.5 mM RGR of Rosette Area 3 day ($cm^2$/day) | 8 |
| N 1.5 mM Rosette Area 10 day ($cm^2$) | 9 |
| N 1.5 mM Rosette Area 8 day ($cm^2$) | 10 |
| N 1.5 mM SPAD/DW (SPAD unit/gr. Plant) | 11 |
| N 1.5 mM Seed Yield (gr/plant) | 12 |
| N 1.5 mM Seed yield reduction compared to 6 mM | 13 |
| N 1.5 mM Spad/FW (SPAD unit/gr) | 14 |
| N 1.5 mM seed yield/spad (gr/SPAD unit) | 15 |
| N 1.5 mM seed yield per leaf blade (gr/$cm^2$) | 16 |

TABLE 145-continued

Arabidopsis correlated parameters (vectors)

| Correlated parameter with | Correlation ID |
|---|---|
| N 1.5 mM seed yield per rosette area day 10 (gr/cm$^2$) | 17 |
| N 1.5 mM t50 Flowering (days) | 18 |
| N 6 mM DW/SPAD (gr/SPAD unit) | 19 |
| N 6 mM Spad/FW (SPAD unit/gr) | 20 |
| N 6 mM 1000 Seeds weight (gr) | 21 |
| N 6 mM Dry Weight (gr) | 22 |
| N 6 mM Harvest Index | 23 |
| N 6 mM Leaf Blade Area 10 day (cm$^2$) | 24 |
| N 6 mM Leaf Number 10 day (num) | 25 |
| N 6 mM RGR of Rosette Area 3 day (cm$^2$/day) | 26 |
| N 6 mM Rosette Area 10 day (cm$^2$) | 27 |
| N 6 mM Rosette Area 8 day (cm$^2$) | 28 |
| N 6 mM Seed Yield (gr/plant) | 29 |
| N 6 mM Seed yield/N unit (gr./SPAD unit) | 30 |
| N 6 mM seed yield/rosette area day 10 day (gr/cm$^2$) | 31 |
| N 6 mM seed yield/leaf blade (gr/cm$^2$) | 32 |
| N 6 mM spad/DW (gN/g plant) (SPAD unit/gr) | 33 |
| N 6 mM t50 Flowering (days) | 34 |

Table 145. "N" = Nitrogen at the noted concentrations; "gr." = grams; "SPAD" = chlorophyll levels; "t50" = time where 50% of plants flowered; "gr./SPAD unit" = plant biomass expressed in grams per unit of nitrogen in plant measured by SPAD. "DW" = plant dry weight; "N level/DW" = plant Nitrogen level measured in SPAD unit per plant biomass [gr.]; "DW/N level" = plant biomass per plant [gr.]/SPAD unit;

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, Rosette diameter and area.

Vegetative growth rate: the relative growth rate (RGR) of leaf blade area (Formula XX), leaf number (Formula XXI), rosette area (Formula XXII), rosette diameter (Formula XXIII), plot coverage (Formula XXIV) and Petiole Relative Area (XXV) are calculated as follows:

Relative growth rate of leaf blade area=Regression coefficient of leaf area along time course (measured in cm$^2$ per day).  Formula XX Relative growth rate of leaf number=Regression coefficient of leaf number along time course (measured in number per day).  Formula XXI Relative growth rate of rosette area=Regression coefficient of rosette area along time course (measured in cm$^2$ per day).  Formula XXII Relative growth rate of rosette diameter=Regression coefficient of rosette diameter along time course (measured in cm per day).  Formula XXIII Relative growth rate of plot coverage=Regression coefficient of plot (measured in cm$^2$ per day).  Formula XXIV Petiole Relative Area=(Petiol area)/Rosette area (measured in %).  Formula XXV:

Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index—The harvest index was calculated using Formula IV as described above.

T$_{50}$ days to flowering—Each of the repeats was monitored for flowering date.

Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in %.

Experimental Results 10 different *Arabidopsis* accessions (ecotypes) were grown and characterized for 37 parameters as described above (Table 145). The average for each of the measured parameters was calculated using the JMP software and values are summarized in Table 146-149 below. Subsequent correlation analysis between the various transcriptom sets (Table 144) and the measured parameters was conducted. Following are the results integrated to the database.

TABLE 146

Measured parameters in *Arabidopsis* accessions

| Line | Corr. ID | | | | | | | |
|---|---|---|---|---|---|---|---|---|
| | 1 | 2 | 3 | 4 | 5 | 6 | 7 | 8 |
| Line-1 | 0.016 | 60.75 | 0.0060 | 0.16 | 0.19 | 0.33 | 6.88 | 0.63 |
| Line-2 | 0.016 | 76.71 | | 0.12 | 0.20 | 0.27 | 7.31 | 0.79 |
| Line-3 | 0.018 | 78.56 | | 0.08 | 0.29 | 0.37 | 7.31 | 0.50 |
| Line-4 | 0.014 | 78.14 | 0.0041 | 0.11 | 0.08 | 0.39 | 7.88 | 0.49 |
| Line-5 | 0.022 | 78.64 | | 0.12 | 0.07 | 0.37 | 7.75 | 0.72 |
| Line-6 | 0.015 | 73.19 | 0.0051 | 0.13 | 0.24 | 0.39 | 7.63 | 0.83 |
| Line-7 | 0.014 | 83.07 | | 0.11 | 0.18 | 0.35 | 7.19 | 0.65 |
| Line-8 | 0.022 | 77.19 | | 0.15 | 0.08 | 0.38 | 8.63 | 0.67 |
| Line-9 | 0.019 | 70.12 | 0.0059 | 0.17 | 0.08 | 0.31 | 5.93 | 0.64 |
| Line-10 | 0.018 | 62.97 | 0.0063 | 0.18 | 0.03 | 0.37 | 7.94 | 0.61 |

Table 146. Provided are the measured parameters under various treatments in various ecotypes (*Arabidopsis* accessions). Growth conditions are specified in the experimental procedure section.

TABLE 147

Additional Measured parameters in *Arabidopsis* accessions

| Line | Corr. ID | | | | | | | |
|---|---|---|---|---|---|---|---|---|
| | 9 | 10 | 11 | 12 | 13 | 14 | 15 | 16 |
| Line-1 | 1.43 | 0.76 | 167.30 | 0.03 | 72.56 | 45.59 | 0.0012 | 0.09 |
| Line-2 | 1.33 | 0.71 | | 0.03 | 84.70 | | | 0.09 |
| Line-3 | 1.77 | 1.06 | | 0.02 | 78.78 | | | 0.06 |
| Line-4 | 1.97 | 1.16 | 241.06 | 0.01 | 88.00 | 42.11 | 0.0004 | 0.03 |
| Line-5 | 1.83 | 1.00 | | 0.01 | 92.62 | | | 0.02 |
| Line-6 | 1.82 | 0.91 | 194.98 | 0.03 | 76.71 | 53.11 | 0.0012 | 0.08 |
| Line-7 | 1.64 | 0.94 | | 0.02 | 81.94 | | | 0.06 |
| Line-8 | 2.00 | 1.12 | | 0.01 | 91.30 | | | 0.03 |
| Line-9 | 1.15 | 0.64 | 169.34 | 0.01 | 85.76 | 67.00 | 0.0005 | 0.04 |
| Line-10 | 1.75 | 1.00 | 157.82 | 0.01 | 91.82 | 28.15 | 0.0002 | 0.01 |

Table 147. Provided are the measured parameters under various treatments in various ecotypes (*Arabidopsis* accessions). Growth conditions are specified in the experimental procedure section.

TABLE 148

Additional Measured parameters in *Arabidopsis* accessions

| Line | Corr. ID | | | | | | | | |
|---|---|---|---|---|---|---|---|---|---|
| | 17 | 18 | 19 | 20 | 21 | 22 | 23 | 24 | 25 |
| Line-1 | 0.0221 | 15.97 | 0.02 | 22.49 | 0.0147 | 0.42 | 0.28 | 0.34 | 6.25 |
| Line-2 | 0.0190 | 20.97 | | | 0.0169 | 0.53 | 0.31 | 0.31 | 7.31 |
| Line-3 | 0.0136 | 14.84 | | | 0.0178 | 0.38 | 0.28 | 0.52 | 8.06 |
| Line-4 | 0.0052 | 24.71 | 0.02 | 28.27 | 0.0121 | 0.52 | 0.16 | 0.45 | 8.75 |
| Line-5 | 0.0050 | 23.70 | | | 0.0155 | 0.58 | 0.21 | 0.43 | 8.75 |
| Line-6 | 0.0178 | 18.06 | 0.02 | 33.32 | 0.0154 | 0.50 | 0.28 | 0.50 | 8.38 |
| Line-7 | 0.0127 | 19.49 | | | 0.0140 | 0.63 | 0.17 | 0.43 | 7.13 |
| Line-8 | 0.0068 | 23.57 | | | 0.0166 | 0.65 | 0.21 | 0.51 | 9.44 |
| Line-9 | 0.0118 | 21.89 | 0.01 | 39.00 | 0.0161 | 0.57 | 0.17 | 0.41 | 6.31 |
| Line-10 | 0.0032 | 23.57 | 0.03 | 17.64 | 0.0160 | 0.50 | 0.14 | 0.43 | 8.06 |

Table 148. Provided are the measured parameters under various treatments in various ecotypes (*Arabidopsis* accessions). Growth conditions are specified in the experimental procedure section.

TABLE 149

Additional Measured parameters in *Arabidopsis* accessions

| Line | Corr. ID | | | | | | | | |
|---|---|---|---|---|---|---|---|---|---|
| | 26 | 27 | 28 | 29 | 30 | 31 | 32 | 33 | 34 |
| Line-1 | 0.69 | 1.41 | 0.76 | 0.12 | 0.0042 | 0.0824 | 0.34 | 53.71 | 16.37 |
| Line-2 | 1.02 | 1.57 | 0.86 | 0.17 | | 0.1058 | 0.53 | | 20.50 |
| Line-3 | 0.61 | 2.67 | 1.48 | 0.11 | | 0.0405 | 0.21 | | 14.63 |
| Line-4 | 0.60 | 2.42 | 1.28 | 0.08 | 0.0030 | 0.0339 | 0.18 | 54.62 | 24.00 |
| Line-5 | 0.65 | 2.14 | 1.10 | 0.12 | | 0.0556 | 0.28 | | 23.60 |
| Line-6 | 0.68 | 2.47 | 1.24 | 0.14 | 0.0053 | 0.0570 | 0.28 | 66.48 | 15.03 |
| Line-7 | 0.58 | 1.97 | 1.09 | 0.11 | | 0.0554 | 0.25 | | 19.75 |
| Line-8 | 0.61 | 2.72 | 1.41 | 0.14 | | 0.0507 | 0.27 | | 22.89 |
| Line-9 | 0.52 | 1.64 | 0.89 | 0.09 | 0.0033 | 0.0582 | 0.24 | 68.05 | 18.80 |
| Line-10 | 0.48 | 2.21 | 1.22 | 0.07 | 0.0023 | 0.0307 | 0.16 | 35.55 | 23.38 |

Table 149. Provided are the measured parameters under various treatments in various ecotypes (*Arabidopsis* accessions). Growth conditions are specified in the experimental procedure section.

TABLE 150

Correlation between the expression level of selected LAB genes of some embodiments of the invention in various tissues and the phenotypic performance under low nitrogen and normal conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LAB617 | 0.72 | 1.78E−02 | 2 | 1 | LAB617 | 0.71 | 2.06E−02 | 1 | 4 |
| LAB617 | 0.73 | 1.76E−02 | 1 | 34 | LAB617 | 0.83 | 3.17E−03 | 3 | 1 |

Table 150. Correlations (R) between the genes expression levels in various tissues and the phenotypic performance. "Corr. ID"—correlation set ID according to the correlated parameters Table above. "Exp. Set"—Expression set. "R" = Pearson correlation coefficient; "P" = p value Example 18

Identification of Genes which Increase ABST, Growth Rate, Vigor, Yield, Biomass, Oil Content, WUE, NUE and/or FUE in Plants Based on the above described bioinformatics and experimental tools, the present inventors have identified 218 genes which exhibit a major impact on abiotic stress tolerance, plant yield, oil content, growth rate, vigor, biomass, fiber yield and quality, photosynthetic capacity, growth rate, nitrogen use efficiency, water use efficiency and fertilizer use efficiency when expression thereof is increased in plants. The identified genes, their curated polynucleotide and polypeptide sequences, as well as their updated sequences according to GenBank database are summarized in Table 151, hereinbelow.

TABLE 151

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
|---|---|---|---|
| LAB616 | arabidopsis\|10v1\|AT1G78230 | 1 | 475 |
| LAB617 | arabidopsis\|10v1\|AT3G62580 | 2 | 476 |
| LAB618 | arabidopsis\|10v1\|AT4G21190 | 3 | 477 |
| LAB619 | arabidopsis\|10v1\|AT4G39970 | 4 | 478 |
| LAB620 | barley\|10v2\|AV835060 | 5 | 479 |
| LAB621 | barley\|10v2\|BE060696 | 6 | 480 |
| LAB622 | barley\|10v2\|BE194055 | 7 | 481 |
| LAB623 | barley\|10v2\|BE194908 | 8 | 482 |
| LAB624 | barley\|10v2\|BE413570 | 9 | 483 |
| LAB625 | barley\|10v2\|BE454533 | 10 | 484 |
| LAB626 | barley\|10v2\|BE455595 | 11 | 485 |
| LAB627 | barley\|10v2\|BF254362 | 12 | 486 |
| LAB628 | barley\|10v2\|BF262375 | 13 | 487 |
| LAB629 | barley\|10v2\|BF619383 | 14 | 488 |
| LAB630 | barley\|10v2\|BF621759 | 15 | 489 |
| LAB631 | barley\|10v2\|BF622249 | 16 | 490 |
| LAB632 | barley\|10v2\|BF622714 | 17 | 491 |
| LAB633 | barley\|10v2\|BF624407 | 18 | 492 |
| LAB634 | barley\|10v2\|BF625108 | 19 | 493 |
| LAB635 | barley\|10v2\|BF625296 | 20 | 494 |
| LAB636 | barley\|10v2\|BF626425 | 21 | 495 |
| LAB637 | barley\|10v2\|BG299942 | 22 | 496 |
| LAB638 | barley\|10v2\|BI952365 | 23 | 497 |
| LAB639 | barley\|10v2\|BI955769 | 24 | 498 |
| LAB640 | barley\|10v2\|BI960586 | 25 | 499 |
| LAB641 | barley\|10v2\|BJ463886 | 26 | 500 |
| LAB642 | barley\|10v2\|BM370254 | 27 | 501 |
| LAB644 | barley\|10v2\|BQ663993 | 28 | 502 |
| LAB645 | barley\|10v2\|BU990670 | 29 | 503 |
| LAB647 | barley\|10v2\|GH213121 | 30 | 504 |
| LAB649 | canola\|11v1\|EE410383 | 31 | 505 |
| LAB650 | cotton\|11v1\|BE053207 | 32 | 506 |
| LAB651 | foxtail_millet\|11v3\|EC612491 | 33 | 507 |
| LAB652 | foxtail_millet\|11v3\|EC613059 | 34 | 508 |
| LAB653 | foxtail_millet\|11v3\|EC613770 | 35 | 509 |
| LAB654 | foxtail_millet\|11v3\|PHY7SI009391M | 36 | 510 |
| LAB655 | foxtail_millet\|11v3\|PHY7SI009629M | 37 | 511 |
| LAB656 | foxtail_millet\|11v3\|PHY7SI009779M | 38 | 512 |
| LAB657 | foxtail_millet\|11v3\|PHY7SI011238M | 39 | 513 |
| LAB659 | foxtail_millet\|11v3\|PHY7SI014411M | 40 | 514 |
| LAB660 | foxtail_millet\|11v3\|PHY7SI017763M | 41 | 515 |
| LAB661 | foxtail_millet\|11v3\|PHY7SI021724M | 42 | 516 |

TABLE 151-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
|---|---|---|---|
| LAB662 | foxtail_millet\|11v3\|PHY7SI022125M | 43 | 517 |
| LAB663 | foxtail_millet\|11v3\|PHY7SI022834M | 44 | 518 |
| LAB664 | foxtail_millet\|11v3\|PHY7SI022902M | 45 | 519 |
| LAB665 | foxtail_millet\|11v3\|PHY7SI023281M | 46 | 520 |
| LAB666 | foxtail_millet\|11v3\|PHY7SI023422M | 47 | 521 |
| LAB667 | foxtail_millet\|11v3\|PHY7SI029211M | 48 | 522 |
| LAB668 | foxtail_millet\|11v3\|PHY7SI030817M | 49 | 523 |
| LAB669 | foxtail_millet\|11v3\|PHY7SI034438M | 50 | 524 |
| LAB670 | foxtail_millet\|11v3\|PHY7SI038207M | 51 | 525 |
| LAB671 | foxtail_millet\|11v3\|PHY7SI040241M | 52 | 526 |
| LAB672 | gossypium_raimondii\|12v1\|DR458820 | 53 | 527 |
| LAB673 | maize\|10v1\|AA979901 | 54 | 528 |
| LAB675 | maize\|10v1\|AF143681 | 55 | 529 |
| LAB676 | maize\|10v1\|AI372115 | 56 | 530 |
| LAB677 | maize\|10v1\|AI372353 | 57 | 531 |
| LAB678 | maize\|10v1\|AI619182 | 58 | 532 |
| LAB679 | maize\|10v1\|AI622384 | 59 | 533 |
| LAB680 | maize\|10v1\|AI622752 | 60 | 534 |
| LAB681 | maize\|10v1\|AI637066 | 61 | 535 |
| LAB682 | maize\|10v1\|AI677194 | 62 | 536 |
| LAB683 | maize\|10v1\|AI691657 | 63 | 537 |
| LAB684 | maize\|10v1\|AI734652 | 64 | 538 |
| LAB685 | maize\|10v1\|AI737066 | 65 | 539 |
| LAB686 | maize\|10v1\|AI737444 | 66 | 540 |
| LAB687 | maize\|10v1\|AI740094 | 67 | 541 |
| LAB688 | maize\|10v1\|AI795604 | 68 | 542 |
| LAB689 | maize\|10v1\|AI795742 | 69 | 543 |
| LAB690 | maize\|10v1\|AI795751 | 70 | 544 |
| LAB691 | maize\|10v1\|AI857184 | 71 | 545 |
| LAB692 | maize\|10v1\|AI861347 | 72 | 546 |
| LAB693 | maize\|10v1\|AI901930 | 73 | 547 |
| LAB694 | maize\|10v1\|AI902032 | 74 | 548 |
| LAB695 | maize\|10v1\|AI932122 | 75 | 549 |
| LAB696 | maize\|10v1\|AI947867 | 76 | 550 |
| LAB697 | maize\|10v1\|AI947885 | 77 | 551 |
| LAB698 | maize\|10v1\|AJ006547 | 78 | 552 |
| LAB700 | maize\|10v1\|AW066791 | 79 | 553 |
| LAB701 | maize\|10v1\|AW231459 | 80 | 554 |
| LAB702 | maize\|10v1\|AW330591 | 81 | 555 |
| LAB703 | maize\|10v1\|AW355959 | 82 | 556 |
| LAB704 | maize\|10v1\|AW461004 | 83 | 557 |
| LAB705 | maize\|10v1\|AW498362 | 84 | 558 |
| LAB706 | maize\|10v1\|AW499427 | 85 | 559 |
| LAB707 | maize\|10v1\|AW787305 | 86 | 560 |
| LAB708 | maize\|10v1\|AW787498 | 87 | 561 |
| LAB709 | maize\|10v1\|BE454007 | 88 | 562 |
| LAB710 | maize\|10v1\|BM378479 | 89 | 563 |
| LAB711 | maize\|10v1\|CD988313 | 90 | 564 |
| LAB712 | maize\|10v1\|CV985191 | 91 | 565 |
| LAB713 | maize\|10v1\|DN223227 | 92 | 566 |
| LAB714 | maize\|10v1\|T18853 | 93 | 567 |
| LAB716 | poplar\|10v1\|BU817192 | 94 | 568 |
| LAB717 | poplar\|10v1\|BU869216 | 95 | 569 |
| LAB718 | poplar\|10v1\|CA822891 | 96 | 570 |
| LAB719 | rice\|11v1\|AU062544 | 97 | 571 |
| LAB720 | rice\|11v1\|AU162158 | 98 | 572 |
| LAB721 | rice\|11v1\|BE228839 | 99 | 573 |
| LAB722 | rice\|11v1\|BI305463 | 100 | 574 |
| LAB723 | rice\|11v1\|BI306005 | 101 | 575 |
| LAB724 | rice\|11v1\|BI796493 | 102 | 576 |
| LAB725 | rice\|11v1\|BI805675 | 103 | 577 |
| LAB726 | rice\|11v1\|BI805831 | 104 | 578 |
| LAB727 | rice\|11v1\|BI806975 | 105 | 579 |
| LAB728 | rice\|11v1\|BI807671 | 106 | 580 |
| LAB729 | rice\|11v1\|BM420747 | 107 | 581 |
| LAB730 | rice\|11v1\|C72652 | 108 | 582 |
| LAB731 | rice\|11v1\|CA766103 | 109 | 583 |
| LAB732 | rice\|11v1\|CB210565 | 110 | 584 |
| LAB733 | rice\|11v1\|CB210910 | 111 | 585 |
| LAB734 | rice\|11v1\|CI305545 | 112 | 586 |
| LAB735 | rice\|11v1\|CK040817 | 113 | 587 |
| LAB736 | rice\|gb170\|OS01G70010 | 114 | 588 |

TABLE 151-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
| --- | --- | --- | --- |
| LAB738 | rice\|gb170\|OS05G30750 | 115 | 589 |
| LAB739 | rice\|gb170\|OS05G46500 | 116 | 590 |
| LAB740 | sorghum\|11v1\|SB03G000850 | 117 | 591 |
| LAB741 | sorghum\|11v1\|SB03G007380 | 118 | 592 |
| LAB742 | sorghum\|11v1\|SB09G004130 | 119 | 593 |
| LAB744 | sorghum\|12v1\|AW286835 | 120 | 594 |
| LAB746 | sorghum\|12v1\|CF759842 | 121 | 595 |
| LAB748 | sorghum\|12v1\|SB01G002840 | 122 | 596 |
| LAB749 | sorghum\|12v1\|SB01G008190 | 123 | 597 |
| LAB750 | sorghum\|12v1\|SB01G025570 | 124 | 598 |
| LAB751 | sorghum\|12v1\|SB01G031145 | 125 | 599 |
| LAB752 | sorghum\|12v1\|SB01G035760 | 126 | 600 |
| LAB753 | sorghum\|12v1\|SB01G040510 | 127 | 601 |
| LAB754 | sorghum\|12v1\|SB01G049100 | 128 | 602 |
| LAB755 | sorghum\|12v1\|SB02G003700 | 129 | 603 |
| LAB756 | sorghum\|12v1\|SB02G006790 | 130 | 604 |
| LAB757 | sorghum\|12v1\|SB02G028150 | 131 | 605 |
| LAB758 | sorghum\|12v1\|SB02G034770 | 132 | 606 |
| LAB759 | sorghum\|12v1\|SB02G039700 | 133 | 607 |
| LAB760 | sorghum\|12v1\|SB02G040060 | 134 | 608 |
| LAB761 | sorghum\|12v1\|SB03G005990 | 135 | 609 |
| LAB762 | sorghum\|12v1\|SB03G027180 | 136 | 610 |
| LAB763 | sorghum\|12v1\|SB03G030230 | 137 | 611 |
| LAB764 | sorghum\|12v1\|SB03G034230 | 138 | 612 |
| LAB765 | sorghum\|12v1\|SB03G034960 | 139 | 613 |
| LAB767 | sorghum\|12v1\|SB03G035060 | 140 | 614 |
| LAB768 | sorghum\|12v1\|SB03G038630 | 141 | 615 |
| LAB769 | sorghum\|12v1\|SB03G043250 | 142 | 616 |
| LAB770 | sorghum\|12v1\|SB04G004050 | 143 | 617 |
| LAB771 | sorghum\|12v1\|SB04G025650 | 144 | 618 |
| LAB772 | sorghum\|12v1\|SB04G027690 | 145 | 619 |
| LAB773 | sorghum\|12v1\|SB04G028210 | 146 | 620 |
| LAB774 | sorghum\|12v1\|SB05G005150 | 147 | 621 |
| LAB775 | sorghum\|12v1\|SB06G002090 | 148 | 622 |
| LAB776 | sorghum\|12v1\|SB06G017150 | 149 | 623 |
| LAB777 | sorghum\|12v1\|SB06G018340 | 150 | 624 |
| LAB778 | sorghum\|12v1\|SB06G018520 | 151 | 625 |
| LAB779 | sorghum\|12v1\|SB06G018670 | 152 | 626 |
| LAB780 | sorghum\|12v1\|SB06G019310 | 153 | 627 |
| LAB781 | sorghum\|12v1\|SB06G019625 | 154 | 628 |
| LAB782 | sorghum\|12v1\|SB06G021340 | 155 | 629 |
| LAB783 | sorghum\|12v1\|SB06G022690 | 156 | 630 |
| LAB784 | sorghum\|12v1\|SB06G026000 | 157 | 631 |
| LAB785 | sorghum\|12v1\|SB06G026210 | 158 | 632 |
| LAB786 | sorghum\|12v1\|SB06G029200 | 159 | 633 |
| LAB787 | sorghum\|12v1\|SB06G032650 | 160 | 634 |
| LAB788 | sorghum\|12v1\|SB07G024190 | 161 | 635 |
| LAB789 | sorghum\|12v1\|SB08G004890 | 162 | 636 |
| LAB790 | sorghum\|12v1\|SB08G006240 | 163 | 637 |
| LAB791 | sorghum\|12v1\|SB08G016450 | 164 | 638 |
| LAB792 | sorghum\|12v1\|SB09G002040 | 165 | 639 |
| LAB793 | sorghum\|12v1\|SB09G002180 | 166 | 640 |
| LAB794 | sorghum\|12v1\|SB09G004650 | 167 | 641 |
| LAB795 | sorghum\|12v1\|SB09G022090 | 168 | 642 |
| LAB796 | sorghum\|12v1\|SB09G022210 | 169 | 643 |
| LAB797 | sorghum\|12v1\|SB10G000500 | 170 | 644 |
| LAB798 | sorghum\|12v1\|SB10G029140 | 171 | 645 |
| LAB799 | sorghum\|12v1\|SB10G029750 | 172 | 646 |
| LAB800 | soybean\|11v1\|GLYMA04G05720 | 173 | 647 |
| LAB801 | soybean\|11v1\|GLYMA04G12170 | 174 | 648 |
| LAB802 | soybean\|11v1\|GLYMA07G00450 | 175 | 649 |
| LAB803 | soybean\|11v1\|GLYMA08G19920 | 176 | 650 |
| LAB804 | soybean\|11v1\|GLYMA10G01750 | 177 | 651 |
| LAB805 | soybean\|11v1\|GLYMA10G06620 | 178 | 652 |
| LAB807 | soybean\|11v1\|GLYMA10G38880 | 179 | 653 |
| LAB809 | soybean\|11v1\|GLYMA20G26610 | 180 | 654 |
| LAB810 | soybean\|11v1\|GLYMA20G34960 | 181 | 655 |
| LAB811 | soybean\|11v1\|GLYMA20G36400 | 182 | 656 |
| LAB813 | sunflower\|10v1\|CD852214 | 183 | 657 |
| LAB814 | sunflower\|10v1\|DY905846 | 184 | 658 |
| LAB815 | sunflower\|10v1\|DY920340 | 185 | 659 |
| LAB816 | sunflower\|10v1\|DY933583 | 186 | 660 |

TABLE 151-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
|---|---|---|---|
| LAB817 | sunflower\|12v1\|CD849392 | 187 | 661 |
| LAB820 | sunflower\|12v1\|DY913292 | 188 | 662 |
| LAB821 | sunflower\|12v1\|DY915017 | 189 | 663 |
| LAB823 | sunflower\|12v1\|DY937266 | 190 | 664 |
| LAB824 | tomato\|11v1\|AI773686 | 191 | 665 |
| LAB825 | tomato\|11v1\|AI778113 | 192 | 666 |
| LAB827 | tomato\|11v1\|AW035009 | 193 | 667 |
| LAB829 | tomato\|11v1\|AW217661 | 194 | 668 |
| LAB830 | tomato\|11v1\|AW615872 | 195 | 669 |
| LAB831 | tomato\|11v1\|BG125080 | 196 | 670 |
| LAB832 | tomato\|11v1\|BG125441 | 197 | 671 |
| LAB833 | tomato\|11v1\|BG126165 | 198 | 672 |
| LAB834 | tomato\|11v1\|BG128255 | 199 | 673 |
| LAB835 | tomato\|11v1\|BG128279 | 200 | 674 |
| LAB836 | tomato\|11v1\|BG132326 | 201 | 675 |
| LAB837 | tomato\|11v1\|BG626094 | 202 | 676 |
| LAB839 | tomato\|11v1\|BG629779 | 203 | 677 |
| LAB840 | tomato\|11v1\|BG629817 | 204 | 678 |
| LAB841 | tomato\|11v1\|BG734916 | 205 | 679 |
| LAB842 | tomato\|11v1\|BQ512667 | 206 | 680 |
| LAB843 | tomato\|11v1\|CO751611 | 207 | 681 |
| LAB844 | wheat\|10v2\|AF079526 | 208 | 682 |
| LAB845 | wheat\|10v2\|BE405715 | 209 | 683 |
| LAB847 | wheat\|10v2\|BE637663 | 210 | 684 |
| LAB848 | wheat\|10v2\|BI479093 | 211 | 685 |
| LAB849 | wheat\|10v2\|BQ166387 | 212 | 686 |
| LAB850 | wheat\|10v2\|CK211432 | 213 | 687 |
| LAB669__H7 | rice\|11v1\|BE229317 | 214 | 688 |
| LAB744__H1 | maize\|10v1\|AI665228 | 215 | 689 |
| LAB756__H3 | rice\|11v1\|BU572354 | 216 | 690 |
| LAB745 | sorghum\|12v1\|CD462918 | 217 | — |
| LAB747 | sorghum\|12v1\|EVOER1621 | 218 | — |
| LAB616 | arabidopsis\|10v1\|AT1G78230 | 219 | 475 |
| LAB621 | barley\|10v2\|BE060696 | 220 | 691 |
| LAB624 | barley\|10v2\|BE413570 | 221 | 692 |
| LAB627 | barley\|10v2\|BF254362 | 222 | 693 |
| LAB640 | barley\|10v2\|BI960586 | 223 | 499 |
| LAB641 | barley\|10v2\|BJ463886 | 224 | 694 |
| LAB644 | barley\|10v2\|BQ663993 | 225 | 695 |
| LAB645 | barley\|10v2\|BU990670 | 226 | 696 |
| LAB647 | barley\|10v2\|GH213121 | 227 | 697 |
| LAB654 | foxtail__millet\|11v3\|PHY7SI009391M | 228 | 510 |
| LAB656 | foxtail__millet\|11v3\|PHY7SI009779M | 229 | 698 |
| LAB664 | foxtail__millet\|11v3\|PHY7SI022902M | 230 | 519 |
| LAB673 | maize\|10v1\|AA979901 | 231 | 528 |
| LAB676 | maize\|10v1\|AI372115 | 232 | 699 |
| LAB682 | maize\|10v1\|AI677194 | 233 | 536 |
| LAB710 | maize\|10v1\|BM378479 | 234 | 563 |
| LAB711 | maize\|10v1\|CD988313 | 235 | 700 |
| LAB726 | rice\|11v1\|BI805831 | 236 | 578 |
| LAB727 | rice\|11v1\|BI806975 | 237 | 579 |
| LAB731 | rice\|11v1\|CA766103 | 238 | 583 |
| LAB736 | rice\|gb170\|OS01G70010 | 239 | 701 |
| LAB749 | sorghum\|12v1\|SB01G008190 | 240 | 597 |
| LAB754 | sorghum\|12v1\|SB01G049100 | 241 | 702 |
| LAB756 | sorghum\|12v1\|SB02G006790 | 242 | 604 |
| LAB757 | sorghum\|12v1\|SB02G028150 | 243 | 605 |
| LAB763 | sorghum\|12v1\|SB03G030230 | 244 | 611 |
| LAB767 | sorghum\|12v1\|SB03G035060 | 245 | 614 |
| LAB770 | sorghum\|12v1\|SB04G004050 | 246 | 703 |
| LAB773 | sorghum\|12v1\|SB04G028210 | 247 | 704 |
| LAB774 | sorghum\|12v1\|SB05G005150 | 248 | 621 |
| LAB775 | sorghum\|12v1\|SB06G002090 | 249 | 622 |
| LAB777 | sorghum\|12v1\|SB06G018340 | 250 | 624 |
| LAB784 | sorghum\|12v1\|SB06G026000 | 251 | 631 |
| LAB787 | sorghum\|12v1\|SB06G032650 | 252 | 705 |
| LAB789 | sorghum\|12v1\|SB08G004890 | 253 | 636 |
| LAB797 | sorghum\|12v1\|SB10G000500 | 254 | 706 |
| LAB821 | sunflower\|12v1\|DY915017 | 255 | 707 |
| LAB832 | tomato\|11v1\|BG125441 | 256 | 708 |
| LAB843 | tomato\|11v1\|CO751611 | 257 | 709 |
| LAB844 | wheat\|10v2\|AF079526 | 258 | 682 |

TABLE 151-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
|---|---|---|---|
| LAB848 | wheat\|10v2\|BI479093 | 259 | 710 |
| LAB850 | wheat\|10v2\|CK211432 | 260 | 711 |
| LAB745 | sorghum\|12v1\|CD462918 | 261 | — |
| LAB747 | sorghum\|12v1\|EVOER1621 | 262 | — |
| LAB616 | arabidopsis\|10v1\|AT1G78230 | 263 | 475 |
| LAB617 | arabidopsis\|10v1\|AT3G62580 | 264 | 476 |
| LAB618 | arabidopsis\|10v1\|AT4G21190 | 265 | 477 |
| LAB619 | arabidopsis\|10v1\|AT4G39970 | 266 | 712 |
| LAB620 | barley\|10v2\|AV835060 | 267 | 479 |
| LAB622 | barley\|10v2\|BE194055 | 268 | 713 |
| LAB623 | barley\|10v2\|BE194908 | 269 | 482 |
| LAB624 | barley\|10v2\|BE413570 | 270 | 483 |
| LAB625 | barley\|10v2\|BE454533 | 271 | 484 |
| LAB626 | barley\|10v2\|BE455595 | 272 | 485 |
| LAB627 | barley\|10v2\|BF254362 | 273 | 714 |
| LAB628 | barley\|10v2\|BF262375 | 274 | 487 |
| LAB629 | barley\|10v2\|BF619383 | 275 | 488 |
| LAB630 | barley\|10v2\|BF621759 | 276 | 489 |
| LAB631 | barley\|10v2\|BF622249 | 277 | 490 |
| LAB632 | barley\|10v2\|BF622714 | 278 | 491 |
| LAB633 | barley\|10v2\|BF624407 | 279 | 492 |
| LAB634 | barley\|10v2\|BF625108 | 280 | 493 |
| LAB635 | barley\|10v2\|BF625296 | 281 | 715 |
| LAB636 | barley\|10v2\|BF626425 | 282 | 495 |
| LAB637 | barley\|10v2\|BG299942 | 283 | 496 |
| LAB638 | barley\|10v2\|BI952365 | 284 | 497 |
| LAB639 | barley\|10v2\|BI955769 | 285 | 716 |
| LAB640 | barley\|10v2\|BI960586 | 286 | 499 |
| LAB641 | barley\|10v2\|BJ463886 | 287 | 500 |
| LAB642 | barley\|10v2\|BM370254 | 288 | 717 |
| LAB645 | barley\|10v2\|BU990670 | 289 | 718 |
| LAB647 | barley\|10v2\|GH213121 | 290 | 504 |
| LAB649 | canola\|11v1\|EE410383 | 291 | 505 |
| LAB650 | cotton\|11v1\|BE053207 | 292 | 719 |
| LAB651 | foxtail_millet\|11v3\|EC612491 | 293 | 720 |
| LAB652 | foxtail_millet\|11v3\|EC613059 | 294 | 508 |
| LAB653 | foxtail_millet\|11v3\|EC613770 | 295 | 509 |
| LAB654 | foxtail_millet\|11v3\|PHY7SI009391M | 296 | 510 |
| LAB655 | foxtail_millet\|11v3\|PHY7SI009629M | 297 | 511 |
| LAB656 | foxtail_millet\|11v3\|PHY7SI009779M | 298 | 721 |
| LAB657 | foxtail_millet\|11v3\|PHY7SI011238M | 299 | 513 |
| LAB659 | foxtail_millet\|11v3\|PHY7SI014411M | 300 | 514 |
| LAB660 | foxtail_millet\|11v3\|PHY7SI017763M | 301 | 515 |
| LAB661 | foxtail_millet\|11v3\|PHY7SI021724M | 302 | 516 |
| LAB662 | foxtail_millet\|11v3\|PHY7SI022125M | 303 | 517 |
| LAB663 | foxtail_millet\|11v3\|PHY7SI022834M | 304 | 518 |
| LAB664 | foxtail_millet\|11v3\|PHY7SI022902M | 305 | 519 |
| LAB665 | foxtail_millet\|11v3\|PHY7SI023281M | 306 | 520 |
| LAB666 | foxtail_millet\|11v3\|PHY7SI023422M | 307 | 521 |
| LAB667 | foxtail_millet\|11v3\|PHY7SI029211M | 308 | 522 |
| LAB668 | foxtail_millet\|11v3\|PHY7SI030817M | 309 | 523 |
| LAB670 | foxtail_millet\|11v3\|PHY7SI038207M | 310 | 525 |
| LAB671 | foxtail_millet\|11v3\|PHY7SI040241M | 311 | 526 |
| LAB672 | gossypium_raimondii\|12v1\|DR458820 | 312 | 722 |
| LAB673 | maize\|10v1\|AA979901 | 313 | 723 |
| LAB675 | maize\|10v1\|AF143681 | 314 | 529 |
| LAB676 | maize\|10v1\|AI372115 | 315 | 530 |
| LAB677 | maize\|10v1\|AI372353 | 316 | 724 |
| LAB678 | maize\|10v1\|AI619182 | 317 | 532 |
| LAB679 | maize\|10v1\|AI622384 | 318 | 533 |
| LAB680 | maize\|10v1\|AI622752 | 319 | 725 |
| LAB681 | maize\|10v1\|AI637066 | 320 | 726 |
| LAB682 | maize\|10v1\|AI677194 | 321 | 727 |
| LAB683 | maize\|10v1\|AI691657 | 322 | 537 |
| LAB684 | maize\|10v1\|AI734652 | 323 | 538 |
| LAB685 | maize\|10v1\|AI737066 | 324 | 539 |
| LAB686 | maize\|10v1\|AI737444 | 325 | 728 |
| LAB687 | maize\|10v1\|AI740094 | 326 | 541 |
| LAB688 | maize\|10v1\|AI795604 | 327 | 729 |
| LAB689 | maize\|10v1\|AI795742 | 328 | 543 |
| LAB690 | maize\|10v1\|AI795751 | 329 | 544 |
| LAB691 | maize\|10v1\|AI857184 | 330 | 730 |

TABLE 151-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
|---|---|---|---|
| LAB692 | maize\|10v1\|AI861347 | 331 | 546 |
| LAB693 | maize\|10v1\|AI901930 | 332 | 547 |
| LAB694 | maize\|10v1\|AI902032 | 333 | 548 |
| LAB695 | maize\|10v1\|AI932122 | 334 | 549 |
| LAB696 | maize\|10v1\|AI947867 | 335 | 550 |
| LAB697 | maize\|10v1\|AI947885 | 336 | 551 |
| LAB698 | maize\|10v1\|AJ006547 | 337 | 731 |
| LAB700 | maize\|10v1\|AW066791 | 338 | 732 |
| LAB701 | maize\|10v1\|AW231459 | 339 | 554 |
| LAB702 | maize\|10v1\|AW330591 | 340 | 555 |
| LAB703 | maize\|10v1\|AW355959 | 341 | 733 |
| LAB704 | maize\|10v1\|AW461004 | 342 | 557 |
| LAB705 | maize\|10v1\|AW498362 | 343 | 734 |
| LAB706 | maize\|10v1\|AW499427 | 344 | 559 |
| LAB707 | maize\|10v1\|AW787305 | 345 | 735 |
| LAB708 | maize\|10v1\|AW787498 | 346 | 561 |
| LAB709 | maize\|10v1\|BE454007 | 347 | 562 |
| LAB710 | maize\|10v1\|BM378479 | 348 | 736 |
| LAB711 | maize\|10v1\|CD988313 | 349 | 564 |
| LAB712 | maize\|10v1\|CV985191 | 350 | 565 |
| LAB713 | maize\|10v1\|DN223227 | 351 | 737 |
| LAB714 | maize\|10v1\|T18853 | 352 | 567 |
| LAB716 | poplar\|10v1\|BU817192 | 353 | 568 |
| LAB717 | poplar\|10v1\|BU869216 | 354 | 569 |
| LAB718 | poplar\|10v1\|CA822891 | 355 | 570 |
| LAB719 | rice\|11v1\|AU062544 | 356 | 571 |
| LAB721 | rice\|11v1\|BE228839 | 357 | 738 |
| LAB722 | rice\|11v1\|BI305463 | 358 | 739 |
| LAB723 | rice\|11v1\|BI306005 | 359 | 575 |
| LAB724 | rice\|11v1\|BI796493 | 360 | 576 |
| LAB725 | rice\|11v1\|BI805675 | 361 | 740 |
| LAB726 | rice\|11v1\|BI805831 | 362 | 578 |
| LAB727 | rice\|11v1\|BI806975 | 363 | 741 |
| LAB728 | rice\|11v1\|BI807671 | 364 | 580 |
| LAB729 | rice\|11v1\|BM420747 | 365 | 742 |
| LAB730 | rice\|11v1\|C72652 | 366 | 582 |
| LAB731 | rice\|11v1\|CA766103 | 367 | 583 |
| LAB732 | rice\|11v1\|CB210565 | 368 | 584 |
| LAB733 | rice\|11v1\|CB210910 | 369 | 585 |
| LAB734 | rice\|11v1\|CI305545 | 370 | 586 |
| LAB735 | rice\|11v1\|CK040817 | 371 | 587 |
| LAB736 | rice\|gb170\|OS01G70010 | 372 | 743 |
| LAB738 | rice\|gb170\|OS05G30750 | 373 | 589 |
| LAB739 | rice\|gb170\|OS05G46500 | 374 | 590 |
| LAB740 | sorghum\|11v1\|SB03G000850 | 375 | 591 |
| LAB741 | sorghum\|11v1\|SB03G007380 | 376 | 592 |
| LAB742 | sorghum\|11v1\|SB09G004130 | 377 | 744 |
| LAB746 | sorghum\|12v1\|CF759842 | 378 | 595 |
| LAB748 | sorghum\|12v1\|SB01G002840 | 379 | 596 |
| LAB749 | sorghum\|12v1\|SB01G008190 | 380 | 745 |
| LAB750 | sorghum\|12v1\|SB01G025570 | 381 | 746 |
| LAB751 | sorghum\|12v1\|SB01G031145 | 382 | 747 |
| LAB752 | sorghum\|12v1\|SB01G035760 | 383 | 600 |
| LAB753 | sorghum\|12v1\|SB01G040510 | 384 | 748 |
| LAB754 | sorghum\|12v1\|SB01G049100 | 385 | 749 |
| LAB755 | sorghum\|12v1\|SB02G003700 | 386 | 603 |
| LAB757 | sorghum\|12v1\|SB02G028150 | 387 | 750 |
| LAB758 | sorghum\|12v1\|SB02G034770 | 388 | 606 |
| LAB759 | sorghum\|12v1\|SB02G039700 | 389 | 607 |
| LAB760 | sorghum\|12v1\|SB02G040060 | 390 | 608 |
| LAB761 | sorghum\|12v1\|SB03G005990 | 391 | 609 |
| LAB762 | sorghum\|12v1\|SB03G027180 | 392 | 610 |
| LAB763 | sorghum\|12v1\|SB03G030230 | 393 | 611 |
| LAB764 | sorghum\|12v1\|SB03G034230 | 394 | 751 |
| LAB765 | sorghum\|12v1\|SB03G034960 | 395 | 613 |
| LAB767 | sorghum\|12v1\|SB03G035060 | 396 | 614 |
| LAB768 | sorghum\|12v1\|SB03G038630 | 397 | 615 |
| LAB769 | sorghum\|12v1\|SB03G043250 | 398 | 616 |
| LAB770 | sorghum\|12v1\|SB04G004050 | 399 | 617 |
| LAB771 | sorghum\|12v1\|SB04G025650 | 400 | 618 |
| LAB772 | sorghum\|12v1\|SB04G027690 | 401 | 619 |
| LAB773 | sorghum\|12v1\|SB04G028210 | 402 | 620 |

TABLE 151-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
|---|---|---|---|
| LAB774 | sorghum\|12v1\|SB05G005150 | 403 | 621 |
| LAB775 | sorghum\|12v1\|SB06G002090 | 404 | 622 |
| LAB776 | sorghum\|12v1\|SB06G017150 | 405 | 623 |
| LAB777 | sorghum\|12v1\|SB06G018340 | 406 | 624 |
| LAB778 | sorghum\|12v1\|SB06G018520 | 407 | 625 |
| LAB779 | sorghum\|12v1\|SB06G018670 | 408 | 626 |
| LAB780 | sorghum\|12v1\|SB06G019310 | 409 | 627 |
| LAB781 | sorghum\|12v1\|SB06G019625 | 410 | 628 |
| LAB782 | sorghum\|12v1\|SB06G021340 | 411 | 629 |
| LAB783 | sorghum\|12v1\|SB06G022690 | 412 | 630 |
| LAB784 | sorghum\|12v1\|SB06G026000 | 413 | 631 |
| LAB785 | sorghum\|12v1\|SB06G026210 | 414 | 632 |
| LAB786 | sorghum\|12v1\|SB06G029200 | 415 | 633 |
| LAB787 | sorghum\|12v1\|SB06G032650 | 416 | 634 |
| LAB788 | sorghum\|12v1\|SB07G024190 | 417 | 635 |
| LAB789 | sorghum\|12v1\|SB08G004890 | 418 | 752 |
| LAB790 | sorghum\|12v1\|SB08G006240 | 419 | 753 |
| LAB791 | sorghum\|12v1\|SB08G016450 | 420 | 638 |
| LAB792 | sorghum\|12v1\|SB09G002040 | 421 | 639 |
| LAB793 | sorghum\|12v1\|SB09G002180 | 422 | 640 |
| LAB794 | sorghum\|12v1\|SB09G004650 | 423 | 641 |
| LAB795 | sorghum\|12v1\|SB09G022090 | 424 | 642 |
| LAB796 | sorghum\|12v1\|SB09G022210 | 425 | 643 |
| LAB797 | sorghum\|12v1\|SB10G000500 | 426 | 644 |
| LAB798 | sorghum\|12v1\|SB10G029140 | 427 | 645 |
| LAB799 | sorghum\|12v1\|SB10G029750 | 428 | 646 |
| LAB800 | soybean\|11v1\|GLYMA04G05720 | 429 | 647 |
| LAB801 | soybean\|11v1\|GLYMA04G12170 | 430 | 648 |
| LAB802 | soybean\|11v1\|GLYMA07G00450 | 431 | 649 |
| LAB803 | soybean\|11v1\|GLYMA08G19920 | 432 | 650 |
| LAB804 | soybean\|11v1\|GLYMA10G01750 | 433 | 651 |
| LAB805 | soybean\|11v1\|GLYMA10G06620 | 434 | 652 |
| LAB807 | soybean\|11v1\|GLYMA10G38880 | 435 | 653 |
| LAB809 | soybean\|11v1\|GLYMA20G26610 | 436 | 754 |
| LAB810 | soybean\|11v1\|GLYMA20G34960 | 437 | 655 |
| LAB811 | soybean\|11v1\|GLYMA20G36400 | 438 | 656 |
| LAB813 | sunflower\|10v1\|CD852214 | 439 | 755 |
| LAB814 | sunflower\|10v1\|DY905846 | 440 | 756 |
| LAB815 | sunflower\|10v1\|DY920340 | 441 | 659 |
| LAB816 | sunflower\|10v1\|DY933583 | 442 | 757 |
| LAB817 | sunflower\|12v1\|CD849392 | 443 | 661 |
| LAB820 | sunflower\|12v1\|DY913292 | 444 | 758 |
| LAB821 | sunflower\|12v1\|DY915017 | 445 | 759 |
| LAB823 | sunflower\|12v1\|DY937266 | 446 | 760 |
| LAB824 | tomato\|11v1\|AI773686 | 447 | 665 |
| LAB825 | tomato\|11v1\|AI778113 | 448 | 761 |
| LAB827 | tomato\|11v1\|AW035009 | 449 | 667 |
| LAB829 | tomato\|11v1\|AW217661 | 450 | 668 |
| LAB830 | tomato\|11v1\|AW615872 | 451 | 669 |
| LAB831 | tomato\|11v1\|BG125080 | 452 | 670 |
| LAB832 | tomato\|11v1\|BG125441 | 453 | 762 |
| LAB833 | tomato\|11v1\|BG126165 | 454 | 672 |
| LAB834 | tomato\|11v1\|BG128255 | 455 | 673 |
| LAB835 | tomato\|11v1\|BG128279 | 456 | 674 |
| LAB836 | tomato\|11v1\|BG132326 | 457 | 675 |
| LAB837 | tomato\|11v1\|BG626094 | 458 | 763 |
| LAB839 | tomato\|11v1\|BG629779 | 459 | 677 |
| LAB840 | tomato\|11v1\|BG629817 | 460 | 678 |
| LAB841 | tomato\|11v1\|BG734916 | 461 | 764 |
| LAB842 | tomato\|11v1\|BQ512667 | 462 | 680 |
| LAB843 | tomato\|11v1\|CO751611 | 463 | 681 |
| LAB844 | wheat\|10v2\|AF079526 | 464 | 765 |
| LAB845 | wheat\|10v2\|BE405715 | 465 | 766 |
| LAB847 | wheat\|10v2\|BE637663 | 466 | 767 |
| LAB848 | wheat\|10v2\|BI479093 | 467 | 768 |
| LAB849 | wheat\|10v2\|BQ166387 | 468 | 769 |
| LAB850 | wheat\|10v2\|CK211432 | 469 | 770 |
| LAB669_H7 | rice\|11v1\|BE229317 | 470 | 688 |
| LAB744_H1 | maize\|10v1\|AI665228 | 471 | 689 |
| LAB756_H3 | rice\|11v1\|BU572354 | 472 | 690 |

TABLE 151-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Cluster tag | Polyn. SEQ ID NO: | Polyp. SEQ ID NO: |
|---|---|---|---|
| LAB745 | sorghum\|12v1\|CD462918 | 473 | — |
| LAB747 | sorghum\|12v1\|EVOER1621 | 474 | — |

Table 151. Provided are the identified genes which expression thereof in plants increases abiotic stress tolerance, water use efficiency, yield, growth rate, vigor, biomass, fiber yield, fiber quality, growth rate, oil content, nitrogen use efficiency and fertilizer use efficiency of a plant. "Polyn."—polynucleotide; "Polyp."—polypeptide.

Example 19

Identification of Homologues which Affect Abst, WUE, Yield, Growth Rate, Vigor, Biomass, Oil Content, NUE and/or FUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

Identification of putative orthologs of the genes identified in Table 151 above can be performed using various tools such as the BLAST® (/Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile with up regulation at a specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing to construct a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

Methods for searching and identifying homologues of yield and improved agronomic traits such as ABS tolerance and FUE related polypeptides or polynucleotides are well within the realm of the skilled artisan. The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST® programs. There are five implementations of BLAST®, three designed for nucleotide sequence queries (BLASTN®, BLASTX®, and TBLASTX®) and two designed for protein sequence queries (BLASTP® and TBLASTN®) (Coulson, Trends in Biotechnology: 76-80, 1994; Birren et al., Genome Analysis, I: 543, 1997). Such methods involve alignment and comparison of sequences. The BLAST® algorithm calculates percent sequence identity and performs a statistical analysis of the similarity between the two sequences. The software for performing BLAST® analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology is preferably carried out on a full-length sequence, but may also be based on a comparison of certain regions such as conserved domains. The identification of such domains would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/ prodomqry (dot) html), PIR (Hypertext Transfer Protocol:// pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 151 (Example 18 above) were identified from the databases using BLAST® software with the BLASTP® and TBLASTN® algorithms as filters for the first stage, and the needle (EMBOSS package) or Frame+ algorithm alignment for the second stage. Local identity (BLAST® alignments) was defined with a very permissive cutoff—60% Identity on a span of 60% of the sequences lengths because it use as only a filter for the global alignment stage. The default filtering of the BLAST® package was not utilized (by setting the parameter "-F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the BLASTP® filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the TBLASTN® filter):
GenCore 6.0 OneModel application utilizing the Frame+ algorithm with the following parameters: model=frame+_p2n.model mode=qglobal—q=protein. sequence—db=nucleotide.sequence. The rest of the parameters are unchanged from the default options described hereinabove.

The query polypeptide sequences were SEQ ID NOs: 475-770 [which are encoded by the polynucleotides SEQ ID NOs:1-474 shown in Table 151) above] and the identified orthologous and homologous sequences having at least 80% global sequence identity are provided in Table 152, below. These homologous genes are expected to increase plant ABST, yield, seed yield, oil yield, oil content, growth rate, fiber yield, fiber quality, fiber length, photosynthetic capacity, biomass, vigor, WUE and/or NUE of a plant.

TABLE 152

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB616_H1 | arabidopsis_lyrata\|09v1\|JGIAL008105_T1 | 771 | 6179 | 475 | 88.45 | glotblastn |
| LAB617_H1 | arabidopsis_lyrata\|09v1\|JGIAL019605_P1 | 772 | 6180 | 476 | 93.4 | globlastp |
| LAB617_H2 | b_rapa\|11v1\|CD816899_P1 | 773 | 6181 | 476 | 91.5 | globlastp |
| LAB617_H3 | canola\|11v1\|CB331895_P1 | 774 | 6181 | 476 | 91.5 | globlastp |
| LAB617_H4 | canola\|11v1\|SRR001111.13540_P1 | 775 | 6181 | 476 | 91.5 | globlastp |
| LAB804_H1 | thellungiella_parvulum\|11v1\|BY803956 | 776 | 6182 | 476 | 91.5 | globlastp |
| LAB804_H1 | thellungiella_parvulum\|11v1\|BY803956 | 776 | 6182 | 651 | 80.3 | globlastp |
| LAB617_H6 | b_juncea\|10v2\|E6ANDIZ01A5S0C | 777 | 6183 | 476 | 91.1 | globlastp |
| LAB617_H7 | canola\|11v1\|CN828959_P1 | 778 | 6184 | 476 | 91.1 | globlastp |
| LAB617_H8 | thellungiella_halophilum\|11v1\|BY803956 | 779 | 6185 | 476 | 91.1 | globlastp |
| LAB617_H14 | b_juncea\|12v1\|E6ANDIZ01AURJS_P1 | 780 | 6186 | 476 | 90.6 | globlastp |
| LAB617_H9 | b_oleracea\|gb161\|EH422504_P1 | 781 | 6187 | 476 | 90.6 | globlastp |
| LAB617_H15 | b_juncea\|12v1\|E6ANDIZ01BWTOD_P1 | 782 | 6188 | 476 | 90.1 | globlastp |
| LAB617_H10 | radish\|gb164\|EV527182 | 783 | 6189 | 476 | 90.1 | globlastp |
| LAB617_H11 | radish\|gb164\|EV567824 | 784 | 6190 | 476 | 90.1 | globlastp |
| LAB617_H12 | radish\|gb164\|FD538955 | 785 | 6191 | 476 | 89.2 | glotblastn |
| LAB617_H13 | radish\|gb164\|EV537654 | 786 | 6192 | 476 | 88.3 | globlastp |
| LAB804_H2 | clementine\|11v1\|CF417156_P1 | 787 | 6193 | 476 | 83.6 | globlastp |
| LAB804_H2 | clementine\|11v1\|CF417156_P1 | 787 | 6193 | 651 | 85.9 | globlastp |
| LAB804_H3 | orange\|11v1\|CF417156_P1 | 788 | 6193 | 476 | 83.6 | globlastp |
| LAB804_H3 | orange\|11v1\|CF417156_P1 | 788 | 6193 | 651 | 85.9 | globlastp |
| LAB804_H4 | cleome_spinosa\|10v1\|GR932468_P1 | 789 | 6194 | 476 | 83.3 | globlastp |
| LAB804_H4 | cleome_spinosa\|10v1\|GR932468_P1 | 789 | 6194 | 651 | 80.9 | globlastp |
| LAB804_H5 | cleome_spinosa\|10v1\|SRR015531S0006992_P1 | 790 | 6195 | 476 | 83.1 | globlastp |
| LAB804_H5 | cleome_spinosa\|10v1\|SRR015531S0006992_P1 | 790 | 6195 | 651 | 80.8 | globlastp |
| LAB804_H6 | cacao\|10v1\|CF973443_P1 | 791 | 6196 | 476 | 82.2 | globlastp |
| LAB804_H6 | cacao\|10v1\|CF973443_P1 | 791 | 6196 | 651 | 81.7 | globlastp |
| LAB804_H7 | peanut\|10v1\|EG029690_P1 | 792 | 6197 | 476 | 81.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB804_H7 | peanut\|10v1\|EG029690_P1 | 792 | 6197 | 651 | 89.2 | globlastp |
| LAB804_H8 | euonymus\|11v1\|SRR070038X120018_P1 | 793 | 6198 | 476 | 81.7 | globlastp |
| LAB804_H8 | euonymus\|11v1\|SRR070038X120018_P1 | 793 | 6198 | 651 | 85.4 | globlastp |
| LAB804_H9 | tripterygium\|11v1\|SRR098677X109347 | 794 | 6199 | 476 | 81.7 | globlastp |
| LAB804_H9 | tripterygium\|11v1\|SRR098677X109347 | 794 | 6199 | 651 | 85 | globlastp |
| LAB804_H10 | pteridium\|11v1\|SRR043594X142729 | 795 | 6200 | 476 | 81.69 | glotblastn |
| LAB804_H10 | pteridium\|11v1\|SRR043594X142729 | 795 | 6200 | 651 | 81.22 | glotblastn |
| LAB804_H11 | oak\|10v1\|CU656480_P1 | 796 | 6201 | 476 | 81.3 | globlastp |
| LAB804_H11 | oak\|10v1\|CU656480_P1 | 796 | 6201 | 651 | 85 | globlastp |
| LAB804_H12 | cotton\|11v1\|AW186702_P1 | 797 | 6202 | 476 | 81.2 | globlastp |
| LAB804_H12 | cotton\|11v1\|AW186702_P1 | 797 | 6202 | 651 | 81.7 | globlastp |
| LAB804_H13 | gossypium_raimondii\|12v1\|AW186702_P1 | 798 | 6202 | 476 | 81.2 | globlastp |
| LAB804_H13 | gossypium_raimondii\|12v1\|AW186702_P1 | 798 | 6202 | 651 | 81.7 | globlastp |
| LAB804_H14 | tripterygium\|11v1\|SRR098677X104467XX2 | 799 | 6203 | 476 | 81.2 | globlastp |
| LAB804_H14 | tripterygium\|11v1\|SRR098677X104467XX2 | 799 | 6203 | 651 | 85 | globlastp |
| LAB804_H15 | cirsium\|11v1\|SRR346952.105939_P1 | 800 | 6204 | 476 | 80.8 | globlastp |
| LAB804_H15 | cirsium\|11v1\|SRR346952.105939_P1 | 800 | 6204 | 651 | 88 | globlastp |
| LAB804_H16 | cynara\|gb167\|GE592518_P1 | 801 | 6205 | 476 | 80.8 | globlastp |
| LAB804_H16 | cynara\|gb167\|GE592518_P1 | 801 | 6205 | 651 | 87.5 | globlastp |
| LAB804_H17 | eucalyptus\|11v2\|CU395771_P1 | 802 | 6206 | 476 | 80.8 | globlastp |
| LAB804_H17 | eucalyptus\|11v2\|CU395771_P1 | 802 | 6206 | 651 | 85.9 | globlastp |
| LAB804_H18 | grape\|11v1\|GSVIVT01028100001_P1 | 803 | 6207 | 476 | 80.8 | globlastp |
| LAB804_H18 | grape\|11v1\|GSVIVT01028100001_P1 | 803 | 6207 | 651 | 85.4 | globlastp |
| LAB804_H19 | humulus\|11v1\|ES654374_P1 | 804 | 6208 | 476 | 80.8 | globlastp |
| LAB804_H19 | humulus\|11v1\|ES654374_P1 | 804 | 6208 | 651 | 89.2 | globlastp |
| LAB804_H20 | platanus\|11v1\|SRR096786X109993_P1 | 805 | 6209 | 476 | 80.8 | globlastp |
| LAB804_H20 | platanus\|11v1\|SRR096786X109993_P1 | 805 | 6209 | 651 | 83.1 | globlastp |
| LAB804_H21 | cannabis\|12v1\|EW700651_P1 | 806 | 6210 | 476 | 80.3 | globlastp |
| LAB804_H21 | cannabis\|12v1\|EW700651_P1 | 806 | 6210 | 651 | 88.3 | globlastp |
| LAB804_H22 | hornbeam\|12v1\|SRR364455.112836_P1 | 807 | 6211 | 476 | 80.3 | globlastp |
| LAB804_H22 | hornbeam\|12v1\|SRR364455.112836_P1 | 807 | 6211 | 651 | 85.9 | globlastp |
| LAB804_H23 | papaya\|gb165\|CO373908_P1 | 808 | 6212 | 476 | 80.3 | globlastp |
| LAB804_H23 | papaya\|gb165\|CO373908_P1 | 808 | 6212 | 651 | 82.6 | globlastp |
| LAB804_H24 | pigeonpea\|11v1\|GR472234_P1 | 809 | 6213 | 476 | 80.3 | globlastp |
| LAB804_H24 | pigeonpea\|11v1\|GR472234_P1 | 809 | 6213 | 651 | 96.2 | globlastp |
| LAB804_H25 | safflower\|gb162\|EL373692 | 810 | 6214 | 476 | 80.3 | globlastp |
| LAB804_H25 | safflower\|gb162\|EL373692 | 810 | 6214 | 651 | 86.1 | globlastp |
| LAB618_H1 | canola\|11v1\|EE411660_T1 | 811 | 6215 | 477 | 87.54 | glotblastn |
| LAB618_H2 | radish\|gb164\|EX757800 | 812 | 6216 | 477 | 87.3 | globlastp |
| LAB618_H3 | thellungiella_halophilum\|11v1\|EHJGI11016416 | 813 | 6217 | 477 | 86.8 | globlastp |
| LAB618_H4 | thellungiella_parvulum\|11v1\|EPCRP030814 | 814 | 6218 | 477 | 86.4 | globlastp |
| LAB618_H5 | b_rapa\|11v1\|DY027925_P1 | 815 | 6219 | 477 | 86.3 | globlastp |
| LAB618_H6 | arabidopsis_lyrata\|09v1\|JGIAL026042_P1 | 816 | 6220 | 477 | 85.3 | globlastp |
| LAB618_H7 | canola\|11v1\|EE513334_P1 | 817 | 6221 | 477 | 82.8 | globlastp |
| LAB618_H8 | b_juncea\|12v1\|E6ANDIZ01EPONR_T1 | 818 | 6222 | 477 | 81.96 | glotblastn |
| LAB619_H4 | b_juncea\|10v2\|E6ANDIZ01AOTZC | 819 | 6223 | 478 | 86.1 | globlastp |
| LAB619_H5 | radish\|gb164\|EX746885 | 820 | 6224 | 478 | 86.1 | globlastp |
| LAB619_H9 | b_juncea\|12v1\|E6ANDIZ01AOTZC_P1 | 821 | 6225 | 478 | 85.4 | globlastp |
| LAB619_H6 | canola\|11v1\|ES977584_P1 | 822 | 6226 | 478 | 85.4 | globlastp |
| LAB619_H7 | b_oleracea\|gb161\|EH429338_T1 | 823 | 6227 | 478 | 85.13 | glotblastn |
| LAB619_H8 | b_rapa\|11v1\|DY013352_P1 | 824 | 6228 | 478 | 85.1 | globlastp |
| LAB620_H2 | wheat\|12v3\|BE445227_P1 | 825 | 6229 | 479 | 96 | globlastp |
| LAB620_H1 | rye\|12v1\|DRR001012.468942 | 826 | 6230 | 479 | 95.8 | globlastp |
| LAB620_H2 | wheat\|10v2\|BE426572 | 827 | 6231 | 479 | 95.5 | globlastp |
| LAB620_H11 | wheat\|12v3\|BE426572_P1 | 828 | 6232 | 479 | 95.5 | globlastp |
| LAB620_H3 | rye\|12v1\|DRR001012.133035 | 829 | 6233 | 479 | 95.01 | glotblastn |
| LAB620_H4 | rye\|12v1\|DRR001013.17335 | 830 | 6234 | 479 | 91.4 | globlastp |
| LAB620_H5 | rye\|12v1\|DRR001012.103279 | 831 | 6235 | 479 | 90.6 | globlastp |
| LAB620_H6 | rye\|12v1\|DRR001012.137158 | 832 | 6236 | 479 | 89.2 | globlastp |
| LAB620_H7 | oat\|11v1\|GO596517_P1 | 833 | 6237 | 479 | 89.1 | globlastp |
| LAB620_H8 | rye\|12v1\|BE637364 | 834 | 6238 | 479 | 88.7 | globlastp |
| LAB620_H9 | brachypodium\|12v1\|BRADI5G25610_P1 | 835 | 6239 | 479 | 88 | globlastp |
| LAB620_H10 | leymus\|gb166\|EG376080_P1 | 836 | 6240 | 479 | 87.4 | globlastp |
| LAB620_H11 | wheat\|10v2\|BE442673 | 837 | 6241 | 479 | 86.2 | globlastp |
| LAB620_H12 | rice\|11v1\|BE228459 | 838 | 6242 | 479 | 84.2 | globlastp |
| LAB620_H13 | rice\|11v1\|CF568779 | 839 | 6243 | 479 | 84.1 | globlastp |
| LAB620_H14 | switchgrass\|gb167\|FE614464 | 840 | 6244 | 479 | 82 | globlastp |
| LAB620_H15 | foxtail_millet\|11v3\|PHY7SI022133M_P1 | 841 | 6245 | 479 | 81.9 | globlastp |
| LAB620_H14 | switchgrass\|12v1\|FE614464_P1 | 842 | 6246 | 479 | 81.8 | globlastp |
| LAB620_H16 | sorghum\|12v1\|SB06G032270 | 843 | 6247 | 479 | 81.2 | globlastp |
| LAB620_H17 | maize\|10v1\|AW165436_P1 | 844 | 6248 | 479 | 80.7 | globlastp |
| LAB621_H1 | wheat\|10v2\|BE638019 | 845 | 6249 | 480 | 96.9 | globlastp |
| LAB621_H1 | wheat\|12v3\|CV771505_P1 | 846 | 6250 | 480 | 96.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB621 | barley\|12v1\|BG299493_P1 | 847 | 6251 | 480 | 88.4 | globlastp |
| LAB621_H4 | brachypodium\|12v1\|BRADI1G51940T2_P1 | 848 | 6252 | 480 | 82.6 | globlastp |
| LAB621_H2 | rye\|12v1\|DRR001012.247676 | 849 | 6253 | 480 | 82.5 | globlastp |
| LAB622_H8 | rice\|11v1\|C97877 | 850 | 6254 | 481 | 84.7 | globlastp |
| LAB622_H10 | foxtail_millet\|11v3\|PHY7SI010927M_P1 | 851 | 6255 | 481 | 81.5 | globlastp |
| LAB623_H1 | rye\|12v1\|DRR001012.122581 | 852 | 6256 | 482 | 94.6 | globlastp |
| LAB623_H2 | rice\|11v1\|AU056684 | 853 | 6257 | 482 | 85.3 | globlastp |
| LAB623_H8 | barley\|12v1\|BG416095_P1 | 854 | 6258 | 482 | 84.6 | globlastp |
| LAB623_H3 | foxtail_millet\|11v3\|PHY7SI029505M_P1 | 855 | 6259 | 482 | 84.6 | globlastp |
| LAB623_H9 | switchgrass\|12v1\|FL691409_P1 | 856 | 6260 | 482 | 84.2 | globlastp |
| LAB623_H4 | sorghum\|12v1\|SB02G025760 | 857 | 6261 | 482 | 82.7 | globlastp |
| LAB623_H5 | sugarcane\|10v1\|CA075318 | 858 | 6262 | 482 | 82.3 | globlastp |
| LAB623_H10 | wheat\|12v3\|BE419298_P1 | 859 | 6263 | 482 | 81.4 | globlastp |
| LAB623_H6 | maize\|10v1\|AI586808_P1 | 860 | 6264 | 482 | 81.4 | globlastp |
| LAB623_H7 | maize\|10v1\|AI622596_P1 | 861 | 6265 | 482 | 80.8 | globlastp |
| LAB624_H4 | wheat\|12v3\|BE500006_P1 | 862 | 6266 | 483 | 96.9 | globlastp |
| LAB624_H5 | wheat\|12v3\|SRR073321X152149D1_P1 | 863 | 6267 | 483 | 96.9 | globlastp |
| LAB624_H3 | brachypodium\|12v1\|BRADI4G16810_P1 | 864 | 6268 | 483 | 86.4 | globlastp |
| LAB624_H6 | rice\|11v1\|CI224808_P1 | 865 | 6269 | 483 | 82.4 | globlastp |
| LAB624_H7 | sorghum\|12v1\|SB05G020900_P1 | 866 | 6270 | 483 | 82 | globlastp |
| LAB624_H8 | foxtail_millet\|11v3\|PHY7SI026426M_P1 | 867 | 6271 | 483 | 81.8 | globlastp |
| LAB625_H1 | leymus\|gb166\|EG391780_P1 | 868 | 6272 | 484 | 99.1 | globlastp |
| LAB625_H2 | rye\|12v1\|DRR001012.127623 | 869 | 6273 | 484 | 99.1 | globlastp |
| LAB625_H3 | wheat\|10v2\|BQ788819 | 870 | 6274 | 484 | 98.8 | globlastp |
| LAB625_H3 | wheat\|12v3\|BQ789482_P1 | 871 | 6274 | 484 | 98.8 | globlastp |
| LAB625_H4 | brachypodium\|12v1\|BRADI1G15940_P1 | 872 | 6275 | 484 | 94.8 | globlastp |
| LAB625_H5 | switchgrass\|gb167\|FE636459 | 873 | 6276 | 484 | 92.8 | globlastp |
| LAB625_H5 | switchgrass\|12v1\|FE636459_P1 | 874 | 6277 | 484 | 92.5 | globlastp |
| LAB625_H6 | maize\|10v1\|AI491622_P1 | 875 | 6278 | 484 | 92.2 | globlastp |
| LAB625_H7 | rice\|11v1\|BE040825 | 876 | 6279 | 484 | 92.2 | globlastp |
| LAB625_H8 | sorghum\|12v1\|SB10G002920 | 877 | 6280 | 484 | 92.2 | globlastp |
| LAB625_H9 | cenchrus\|gb166\|EB661083_P1 | 878 | 6281 | 484 | 91.6 | globlastp |
| LAB625_H10 | sugarcane\|10v1\|CA089197 | 879 | 6282 | 484 | 90.8 | globlastp |
| LAB625_H11 | millet\|10v1\|EVO454PM055199_P1 | 880 | 6283 | 484 | 90.5 | globlastp |
| LAB625_H12 | foxtail_millet\|11v3\|PHY7SI036501M_T1 | 881 | 6284 | 484 | 90.17 | globtblastn |
| LAB625_H13 | phalaenopsis\|11v1\|SRR125771.101382_P1 | 882 | 6285 | 484 | 84.4 | globlastp |
| LAB625_H77 | prunus_mume\|13v1\|DW344662_P1 | 883 | 6286 | 484 | 83.5 | globlastp |
| LAB625_H14 | aristolochia\|10v1\|FD760040_P1 | 884 | 6287 | 484 | 83.5 | globlastp |
| LAB625_H15 | papaya\|gb165\|EX238938_P1 | 885 | 6288 | 484 | 83.5 | globlastp |
| LAB625_H16 | prunus\|10v1\|CN494803 | 886 | 6286 | 484 | 83.5 | globlastp |
| LAB625_H78 | sesame\|12v1\|BU670022_P1 | 887 | 6289 | 484 | 82.9 | globlastp |
| LAB625_H17 | apple\|11v1\|CN494803_P1 | 888 | 6290 | 484 | 82.9 | globlastp |
| LAB625_H18 | cassava\|09v1\|DV451804_P1 | 889 | 6291 | 484 | 82.9 | globlastp |
| LAB625_H19 | clementine\|11v1\|CV715595_P1 | 890 | 6292 | 484 | 82.9 | globlastp |
| LAB625_H20 | eucalyptus\|11v2\|SRR001658X5147_T1 | 891 | 6293 | 484 | 82.9 | globtblastn |
| LAB625_H21 | oil_palm\|11v1\|SRR190698.272408_P1 | 892 | 6294 | 484 | 82.9 | globlastp |
| LAB625_H22 | orange\|11v1\|CV715595_P1 | 893 | 6292 | 484 | 82.9 | globlastp |
| LAB625_H23 | castorbean\|12v1\|EG672819_P1 | 894 | 6295 | 484 | 82.4 | globlastp |
| LAB625_H24 | radish\|gb164\|EV525521 | 895 | 6296 | 484 | 82.4 | globlastp |
| LAB625_H25 | amsonia\|11v1\|SRR098688X126499_P1 | 896 | 6297 | 484 | 82.1 | globlastp |
| LAB625_H26 | cotton\|11v1\|DT553596_P1 | 897 | 6298 | 484 | 82.1 | globlastp |
| LAB625_H27 | watermelon\|11v1\|DV633645 | 898 | 6299 | 484 | 82.1 | globlastp |
| LAB625_H28 | maritime_pine\|10v1\|BX254212_P1 | 899 | 6300 | 484 | 82 | globlastp |
| LAB625_H29 | peanut\|10v1\|EE124863_P1 | 900 | 6301 | 484 | 82 | globlastp |
| LAB625_H30 | pine\|10v2\|AA739796_P1 | 901 | 6300 | 484 | 82 | globlastp |
| LAB625_H31 | spruce\|11v1\|ES252241 | 902 | 6302 | 484 | 82 | globlastp |
| LAB625_H32 | triphysaria\|10v1\|EY172940 | 903 | 6303 | 484 | 82 | globlastp |
| LAB625_H79 | aquilegia\|10v2\|DT733421_P1 | 904 | 6304 | 484 | 81.8 | globlastp |
| LAB625_H33 | aquilegia\|10v1\|DT733421 | 905 | 6304 | 484 | 81.8 | globlastp |
| LAB625_H34 | nicotiana_benthamiana\|12v1\|CN742800_P1 | 906 | 6305 | 484 | 81.8 | globlastp |
| LAB625_H34 | nicotiana_benthamiana\|gb162\|CN742800 | 907 | 6306 | 484 | 81.8 | globlastp |
| LAB625_H35 | poppy\|11v1\|SRR030259.122551_P1 | 908 | 6307 | 484 | 81.8 | globlastp |
| LAB625_H36 | phyla\|11v2\|SRR099035X163195_T1 | 909 | 6308 | 484 | 81.74 | globtblastn |
| LAB625_H37 | tabernaemontana\|11v1\|SRR098689X125206 | 910 | 6309 | 484 | 81.7 | globlastp |
| LAB625_H80 | banana\|12v1\|FF558823_P1 | 911 | 6310 | 484 | 81.5 | globlastp |
| LAB625_H38 | b_rapa\|11v1\|CN732059_P1 | 912 | 6311 | 484 | 81.5 | globlastp |
| LAB625_H39 | chestnut\|gb170\|SRR006295S0019697_P1 | 913 | 6312 | 484 | 81.5 | globlastp |
| LAB625_H40 | oak\|10v1\|FP042989_P1 | 914 | 6312 | 484 | 81.5 | globlastp |
| LAB625_H41 | tomato\|11v1\|BG132037 | 915 | 6313 | 484 | 81.5 | globlastp |
| LAB625_H42 | beech\|11v1\|FR617570_T1 | 916 | 6314 | 484 | 81.45 | globtblastn |
| LAB625_H43 | sarracenia\|11v1\|SRR192669.158321 | 917 | 6315 | 484 | 81.45 | globtblastn |
| LAB625_H81 | bean\|12v2\|CA896913_P1 | 918 | 6316 | 484 | 81.3 | globlastp |
| LAB625_H82 | lettuce\|12v1\|DW111551_P1 | 919 | 6317 | 484 | 81.3 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
| --- | --- | --- | --- | --- | --- | --- |
| LAB625_H44 | bean\|12v1\|CA896913 | 920 | 6316 | 484 | 81.3 | globlastp |
| LAB625_H45 | cowpea\|12v1\|FF401664_P1 | 921 | 6318 | 484 | 81.3 | globlastp |
| LAB625_H45 | cowpea\|gb166\|FF401664 | 922 | 6318 | 484 | 81.3 | globlastp |
| LAB625_H46 | lettuce\|10v1\|DW111551 | 923 | 6317 | 484 | 81.3 | globlastp |
| LAB625_H83 | poplar\|13v1\|CK112093_P1 | 924 | 6319 | 484 | 81.2 | globlastp |
| LAB625_H47 | monkeyflower\|10v1\|GR021299 | 925 | 6320 | 484 | 81.2 | globlastp |
| LAB625_H47 | monkeyflower\|12v1\|SRR037227.100352_P1 | 926 | 6320 | 484 | 81.2 | globlastp |
| LAB625_H48 | poplar\|10v1\|CK112093 | 927 | 6319 | 484 | 81.2 | globlastp |
| LAB625_H49 | poplar\|10v1\|XM002313872 | 928 | 6321 | 484 | 81.2 | globlastp |
| LAB625_H49 | poplar\|13v1\|XM_002313872_P1 | 929 | 6321 | 484 | 81.2 | globlastp |
| LAB625_H50 | potato\|10v1\|BG591935_P1 | 930 | 6322 | 484 | 81.2 | globlastp |
| LAB625_H51 | solanum_phureja\|09v1\|SPHBG132037 | 931 | 6322 | 484 | 81.2 | globlastp |
| LAB625_H52 | strawberry\|11v1\|EX670890 | 932 | 6323 | 484 | 81.2 | globlastp |
| LAB625_H84 | blueberry\|12v1\|SRR353282X62159D1_T1 | 933 | 6324 | 484 | 81.16 | glotblastn |
| LAB625_H53 | beet\|12v1\|BI543970_P1 | 934 | 6325 | 484 | 81.1 | globlastp |
| LAB625_H54 | soybean\|11v1\|GLYMA10G40440 | 935 | 6326 | 484 | 81 | globlastp |
| LAB625_H54 | soybean\|12v1\|GLYMA10G40440_P1 | 936 | 6326 | 484 | 81 | globlastp |
| LAB625_H55 | cowpea\|12v1\|FC461332_P1 | 937 | 6327 | 484 | 80.9 | globlastp |
| LAB625_H55 | cowpea\|gb166\|FC461332 | 938 | 6327 | 484 | 80.9 | globlastp |
| LAB625_H56 | medicago\|12v1\|AW980662_P1 | 939 | 6328 | 484 | 80.9 | globlastp |
| LAB625_H57 | thellungiella_parvulum\|11v1\|EPCRP010044 | 940 | 6329 | 484 | 80.9 | globlastp |
| LAB625_H58 | euonymus\|11v1\|SRR070038X15434_T1 | 941 | 6330 | 484 | 80.87 | glotblastn |
| LAB625_H59 | thellungiella_halophilum\|11v1\|EHJGI11005074 | 942 | 6331 | 484 | 80.87 | glotblastn |
| LAB625_H60 | thellungiella_parvulum\|11v1\|EPCRP005066 | 943 | 6332 | 484 | 80.87 | glotblastn |
| LAB625_H61 | cotton\|11v1\|DT548734_P1 | 944 | 6333 | 484 | 80.6 | globlastp |
| LAB625_H62 | cycas\|gb166\|EX922356_P1 | 945 | 6334 | 484 | 80.6 | globlastp |
| LAB625_H63 | pigeonpea\|11v1\|SRR054580X423669_P1 | 946 | 6335 | 484 | 80.6 | globlastp |
| LAB625_H64 | soybean\|11v1\|GLYMA20G26890 | 947 | 6336 | 484 | 80.35 | glotblastn |
| LAB625_H64 | soybean\|12v1\|GLYMA20G26890_T1 | 948 | 6336 | 484 | 80.35 | glotblastn |
| LAB625_H65 | catharanthus\|11v1\|SRR098691X103228_P1 | 949 | 6337 | 484 | 80.3 | globlastp |
| LAB625_H66 | flax\|11v1\|JG122552_P1 | 950 | 6338 | 484 | 80.3 | globlastp |
| LAB625_H67 | gossypium_raimondii\|12v1\|DT548734_P1 | 951 | 6339 | 484 | 80.3 | globlastp |
| LAB625_H68 | ipomoea_nil\|10v1\|BJ562192_P1 | 952 | 6340 | 484 | 80.3 | globlastp |
| LAB625_H69 | antirrhinum\|gb166\|AJ793853_T1 | 953 | 6341 | 484 | 80.29 | glotblastn |
| LAB625_H70 | cirsium\|11v1\|SRR346952.106990_T1 | 954 | 6342 | 484 | 80.29 | glotblastn |
| LAB625_H71 | cirsium\|11v1\|SRR346952.833569_T1 | 955 | 6343 | 484 | 80.29 | glotblastn |
| LAB625_H72 | silene\|11v1\|SRR096785X102281 | 956 | 6344 | 484 | 80.29 | glotblastn |
| LAB625_H73 | grape\|11v1\|GSVIVT01037848001_P1 | 957 | 6345 | 484 | 80.2 | globlastp |
| LAB625_H74 | chickpea\|11v1\|SRR133517.123706 | 958 | 6346 | 484 | 80.1 | globlastp |
| LAB625_H74 | chickpea\|13v2\|SRR133517.123706_P1 | 959 | 6346 | 484 | 80.1 | globlastp |
| LAB625_H75 | arabidopsis_lyrata\|09v1\|JGIAL010505_T1 | 960 | 6347 | 484 | 80 | glotblastn |
| LAB625_H76 | lotus\|09v1\|AW719379_T1 | 961 | 6348 | 484 | 80 | glotblastn |
| LAB626_H1 | pseudoroegneria\|gb167\|FF349328 | 962 | 6349 | 485 | 98.7 | globlastp |
| LAB626_H2 | rye\|12v1\|BE495583 | 963 | 6350 | 485 | 98.3 | globlastp |
| LAB626_H3 | wheat\|10v2\|BE419997 | 964 | 6351 | 485 | 98 | globlastp |
| LAB626_H3 | wheat\|12v3\|BE419997_P1 | 965 | 6351 | 485 | 98 | globlastp |
| LAB626_H4 | leymus\|gb166\|EG374735_P1 | 966 | 6352 | 485 | 97.7 | globlastp |
| LAB626_H5 | brachypodium\|12v1\|BRADI5G12080_P1 | 967 | 6353 | 485 | 92.1 | globlastp |
| LAB626_H6 | rice\|11v1\|AU029951 | 968 | 6354 | 485 | 86.6 | globlastp |
| LAB626_H7 | maize\|10v1\|CB281936_P1 | 969 | 6355 | 485 | 83.8 | globlastp |
| LAB626_H8 | sorghum\|12v1\|SB06G018640 | 970 | 6356 | 485 | 83.8 | globlastp |
| LAB626_H9 | sugarcane\|10v1\|CA074242 | 971 | 6357 | 485 | 83.8 | globlastp |
| LAB626_H10 | maize\|10v1\|AI891360_P1 | 972 | 6358 | 485 | 83.5 | globlastp |
| LAB626_H14 | switchgrass\|12v1\|FL742760_P1 | 973 | 6359 | 485 | 83.2 | globlastp |
| LAB626_H11 | fescue\|gb161\|DT675496_P1 | 974 | 6360 | 485 | 83.2 | globlastp |
| LAB626_H12 | foxtail_millet\|11v3\|PHY7SI010696M_P1 | 975 | 6361 | 485 | 83.2 | globlastp |
| LAB626_H13 | millet\|10v1\|EVO454PM002955_P1 | 976 | 6362 | 485 | 82.6 | globlastp |
| LAB626_H15 | switchgrass\|12v1\|FL756782_P1 | 977 | 6363 | 485 | 82.5 | globlastp |
| LAB628_H1 | wheat\|10v2\|BE590956 | 978 | 6364 | 487 | 93.2 | globlastp |
| LAB628_H1 | wheat\|12v3\|BE590956_P1 | 979 | 6364 | 487 | 93.2 | globlastp |
| LAB628_H2 | pseudoroegneria\|gb167\|FF362016 | 980 | 6365 | 487 | 91.1 | globlastp |
| LAB628_H3 | fescue\|gb161\|DT685079_P1 | 981 | 6366 | 487 | 84.8 | globlastp |
| LAB628_H4 | brachypodium\|12v1\|BRADI2G43040_P1 | 982 | 6367 | 487 | 82.7 | globlastp |
| LAB629_H1 | wheat\|12v3\|BG274995_P1 | 983 | 6368 | 488 | 94.6 | globlastp |
| LAB629_H1 | rye\|12v1\|DRR001012.227452 | 984 | 6369 | 488 | 94.23 | glotblastn |
| LAB630_H16 | wheat\|12v3\|BE497431_P1 | 985 | 6370 | 489 | 96.8 | globlastp |
| LAB630_H1 | pseudoroegneria\|gb167\|FF364958 | 986 | 6371 | 489 | 96.8 | globlastp |
| LAB630_H2 | wheat\|10v2\|BE497431XX2 | 987 | 6372 | 489 | 96.8 | globlastp |
| LAB630_H2 | wheat\|12v3\|BE517187_P1 | 988 | 6373 | 489 | 96.5 | globlastp |
| LAB630_H3 | rye\|12v1\|DRR001012.11011 | 989 | 6374 | 489 | 95.9 | globlastp |
| LAB630_H4 | rye\|12v1\|DRR001012.115392 | 990 | 6375 | 489 | 95.3 | globlastp |
| LAB630_H5 | rye\|12v1\|DRR001012.497471 | 991 | 6376 | 489 | 94.75 | glotblastn |
| LAB630_H6 | brachypodium\|12v1\|BRADI4G02350_P1 | 992 | 6377 | 489 | 91.6 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB630_H7 | foxtail_millet|11v3|GT091056_P1 | 993 | 6378 | 489 | 84.5 | globlastp |
| LAB630_H8 | rice|11v1|AA751964 | 994 | 6379 | 489 | 83.7 | globlastp |
| LAB630_H9 | maize|10v1|AI395949_P1 | 995 | 6380 | 489 | 83.4 | globlastp |
| LAB630_H10 | maize|10v1|AI396380_P1 | 996 | 6381 | 489 | 83.4 | globlastp |
| LAB630_H11 | millet|10v1|EVO454PM013672_P1 | 997 | 6382 | 489 | 83.3 | globlastp |
| LAB630_H12 | sorghum|12v1|SB08G020830 | 998 | 6383 | 489 | 83.1 | globlastp |
| LAB630_H13 | switchgrass|gb167|FE625960 | 999 | 6384 | 489 | 83.1 | globlastp |
| LAB630_H14 | oat|11v1|CN818230_P1 | 1000 | 6385 | 489 | 82.8 | globlastp |
| LAB630_H17 | switchgrass|12v1|FE608986_P1 | 1001 | 6386 | 489 | 82.2 | globlastp |
| LAB630_H15 | sugarcane|10v1|BQ537487 | 1002 | 6387 | 489 | 81.7 | globlastp |
| LAB631_H1 | rye|12v1|DRR001012.353645 | 1003 | 6388 | 490 | 93 | globlastp |
| LAB631_H2 | rye|12v1|DRR001012.773201 | 1004 | 6388 | 490 | 93 | globlastp |
| LAB631_H3 | wheat|10v2|BE425328 | 1005 | 6389 | 490 | 93 | globlastp |
| LAB631_H3 | wheat|12v3|BE425328_P1 | 1006 | 6389 | 490 | 93 | globlastp |
| LAB631_H4 | rye|12v1|DRR001012.14856 | 1007 | 6390 | 490 | 92.6 | globlastp |
| LAB631_H5 | rye|12v1|DRR001012.272200 | 1008 | 6391 | 490 | 90.7 | globlastp |
| LAB632_H9 | wheat|12v3|BM135360_P1 | 1009 | 6392 | 491 | 95.1 | globlastp |
| LAB632_H1 | wheat|10v2|BE591422 | 1010 | 6393 | 491 | 95.1 | globlastp |
| LAB632_H1 | wheat|12v3|BE591422_P1 | 1011 | 6393 | 491 | 95.1 | globlastp |
| LAB632_H2 | rye|12v1|DRR001012.102621 | 1012 | 6394 | 491 | 94.4 | globlastp |
| LAB632_H3 | oat|11v1|CN817514_P1 | 1013 | 6395 | 491 | 88.5 | globlastp |
| LAB632_H4 | fescue|gb161|CK803085_P1 | 1014 | 6396 | 491 | 87 | globlastp |
| LAB632_H5 | brachypodium|12v1|BRADI1G15400_P1 | 1015 | 6397 | 491 | 86.6 | globlastp |
| LAB632_H6 | fescue|gb161|CK802979_P1 | 1016 | 6398 | 491 | 86.6 | globlastp |
| LAB632_H7 | rye|12v1|DRR001012.138316 | 1017 | 6399 | 491 | 85.5 | globlastp |
| LAB632_H8 | lolium|10v1|AU250959_T1 | 1018 | 6400 | 491 | 82.84 | glotblastn |
| LAB633_H846 | wheat|12v3|BE415525_P1 | 1019 | 492 | 492 | 100 | globlastp |
| LAB633_H847 | wheat|12v3|BE497510_P1 | 1020 | 492 | 492 | 100 | globlastp |
| LAB633_H1 | fescue|gb161|DT688127_P1 | 1021 | 492 | 492 | 100 | globlastp |
| LAB633_H2 | leymus|gb166|CD808938_P1 | 1022 | 492 | 492 | 100 | globlastp |
| LAB633_H3 | lolium|10v1|AU247803_P1 | 1023 | 492 | 492 | 100 | globlastp |
| LAB633_H4 | lolium|10v1|AU250131_P1 | 1024 | 492 | 492 | 100 | globlastp |
| LAB633_H5 | lolium|10v1|DT670744_P1 | 1025 | 492 | 492 | 100 | globlastp |
| LAB633_H6 | oat|11v1|ASTATPASEH_P1 | 1026 | 492 | 492 | 100 | globlastp |
| LAB633_H7 | oat|11v1|CN816203_P1 | 1027 | 492 | 492 | 100 | globlastp |
| LAB633_H8 | oat|11v1|CN818473_P1 | 1028 | 492 | 492 | 100 | globlastp |
| LAB633_H9 | oat|11v1|GR326071_P1 | 1029 | 492 | 492 | 100 | globlastp |
| LAB633_H10 | pseudoroegneria|gb167|FF342202 | 1030 | 492 | 492 | 100 | globlastp |
| LAB633_H11 | pseudoroegneria|gb167|FF354282 | 1031 | 492 | 492 | 100 | globlastp |
| LAB633_H12 | rye|12v1|BE495058 | 1032 | 492 | 492 | 100 | globlastp |
| LAB633_H13 | rye|12v1|BF145486 | 1033 | 492 | 492 | 100 | globlastp |
| LAB633_H14 | rye|12v1|DRR001012.178730 | 1034 | 492 | 492 | 100 | globlastp |
| LAB633_H15 | rye|12v1|DRR001013.134595 | 1035 | 492 | 492 | 100 | globlastp |
| LAB633_H16 | wheat|10v2|BE415525 | 1036 | 492 | 492 | 100 | globlastp |
| LAB633_H16 | wheat|12v3|BE405530_P1 | 1037 | 492 | 492 | 100 | globlastp |
| LAB633_H848 | wheat|12v3|BE400824_P1 | 1038 | 6401 | 492 | 99.4 | globlastp |
| LAB633_H849 | wheat|12v3|BE413605_P1 | 1039 | 6401 | 492 | 99.4 | globlastp |
| LAB633_H850 | wheat|12v3|CA637124_P1 | 1040 | 6401 | 492 | 99.4 | globlastp |
| LAB633_H17 | barley|10v2|BE413158 | 1041 | 6401 | 492 | 99.4 | globlastp |
| LAB633_H17 | barley|12v1|BE413158_P1 | 1042 | 6401 | 492 | 99.4 | globlastp |
| LAB633_H18 | brachypodium|12v1|BRADI2G39690_P1 | 1043 | 6402 | 492 | 99.4 | globlastp |
| LAB633_H19 | brachypodium|12v1|BRADI4G24287_P1 | 1044 | 6401 | 492 | 99.4 | globlastp |
| LAB633_H20 | brachypodium|12v1|BRADI4G41560_P1 | 1045 | 6401 | 492 | 99.4 | globlastp |
| LAB633_H21 | cynodon|10v1|ES299096_P1 | 1046 | 6403 | 492 | 99.4 | globlastp |
| LAB633_H22 | cynodon|10v1|ES300110_P1 | 1047 | 6401 | 492 | 99.4 | globlastp |
| LAB633_H23 | maize|10v1|AI586913_P1 | 1048 | 6401 | 492 | 99.4 | globlastp |
| LAB633_H24 | maize|10v1|X92374_P1 | 1049 | 6401 | 492 | 99.4 | globlastp |
| LAB633_H25 | maize|10v1|X92375_P1 | 1050 | 6401 | 492 | 99.4 | globlastp |
| LAB633_H26 | millet|10v1|AF416606_P1 | 1051 | 6401 | 492 | 99.4 | globlastp |
| LAB633_H27 | millet|10v1|GFXAY620961X1_P1 | 1052 | 6401 | 492 | 99.4 | globlastp |
| LAB633_H28 | pseudoroegneria|gb167|FF347054 | 1053 | 6401 | 492 | 99.4 | globlastp |
| LAB633_H29 | rye|12v1|BF145534 | 1054 | 6401 | 492 | 99.4 | globlastp |
| LAB633_H30 | sorghum|12v1|SB05G004510 | 1055 | 6401 | 492 | 99.4 | globlastp |
| LAB633_H31 | sugarcane|10v1|BQ533789 | 1056 | 6401 | 492 | 99.4 | globlastp |
| LAB633_H32 | sugarcane|10v1|CA068850 | 1057 | 6401 | 492 | 99.4 | globlastp |
| LAB633_H33 | wheat|10v2|BE429139 | 1058 | 6401 | 492 | 99.4 | globlastp |
| LAB633_H33 | wheat|12v3|BE425161_P1 | 1059 | 6401 | 492 | 99.4 | globlastp |
| LAB633_H34 | wheat|10v2|CA484273 | 1060 | 6401 | 492 | 99.4 | globlastp |
| LAB633_H34 | wheat|12v3|CA484273_P1 | 1061 | 6401 | 492 | 99.4 | globlastp |
| LAB633_H851 | wheat|12v3|BE401163_P1 | 1062 | 6404 | 492 | 98.8 | globlastp |
| LAB633_H35 | foxtail_millet|11v3|EC613811_P1 | 1063 | 6405 | 492 | 98.8 | globlastp |
| LAB633_H36 | lovegrass|gb167|DN481317_P1 | 1064 | 6406 | 492 | 98.8 | globlastp |
| LAB633_H37 | rice|11v1|AA754273 | 1065 | 6407 | 492 | 98.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H38 | sorghum\|12v1\|SB08G004380 | 1066 | 6408 | 492 | 98.8 | globlastp |
| LAB633_H39 | sorghum\|12v1\|SB08G004390 | 1067 | 6408 | 492 | 98.8 | globlastp |
| LAB633_H40 | sugarcane\|10v1\|BQ533950 | 1068 | 6409 | 492 | 98.8 | globlastp |
| LAB633_H41 | wheat\|10v2\|AL819713 | 1069 | 6404 | 492 | 98.8 | globlastp |
| LAB633_H41 | wheat\|12v3\|BQ608651_P1 | 1070 | 6404 | 492 | 98.8 | globlastp |
| LAB633_H42 | wheat\|10v2\|BG313106 | 1071 | 6404 | 492 | 98.8 | globlastp |
| LAB633_H42 | wheat\|12v3\|BE426215_P1 | 1072 | 6404 | 492 | 98.8 | globlastp |
| LAB633_H43 | wheat\|10v2\|CA603994XX1 | 1073 | 6404 | 492 | 98.8 | globlastp |
| LAB633_H43 | wheat\|12v3\|BE404839_P1 | 1074 | 6404 | 492 | 98.8 | globlastp |
| LAB633_H852 | wheat\|12v3\|CA604013_T1 | 1075 | 6410 | 492 | 98.79 | glotblastn |
| LAB633_H853 | sesame\|12v1\|BU667591_P1 | 1076 | 6411 | 492 | 98.2 | globlastp |
| LAB633_H44 | basilicum\|10v1\|DY322167_P1 | 1077 | 6411 | 492 | 98.2 | globlastp |
| LAB633_H45 | beech\|11v1\|SRR006293.1203_P1 | 1078 | 6412 | 492 | 98.2 | globlastp |
| LAB633_H46 | beech\|11v1\|SRR006293.17149_P1 | 1079 | 6412 | 492 | 98.2 | globlastp |
| LAB633_H47 | beech\|11v1\|SRR006293.991_P1 | 1080 | 6412 | 492 | 98.2 | globlastp |
| LAB633_H48 | brachypodium\|12v1\|BRADI3G45420_P1 | 1081 | 6413 | 492 | 98.2 | globlastp |
| LAB633_H49 | cenchrus\|gb166\|EB654899_P1 | 1082 | 6414 | 492 | 98.2 | globlastp |
| LAB633_H50 | hornbeam\|12v1\|SRR364455.103826_P1 | 1083 | 6412 | 492 | 98.2 | globlastp |
| LAB633_H51 | maize\|10v1\|MZEORFD_P1 | 1084 | 6415 | 492 | 98.2 | globlastp |
| LAB633_H52 | oil_palm\|11v1\|EY409192_P1 | 1085 | 6416 | 492 | 98.2 | globlastp |
| LAB633_H53 | orobanche\|10v1\|SRR023189S0007505_P1 | 1086 | 6411 | 492 | 98.2 | globlastp |
| LAB633_H54 | orobanche\|10v1\|SRR023189S0008087_P1 | 1087 | 6411 | 492 | 98.2 | globlastp |
| LAB633_H55 | phyla\|11v2\|SRR099035X103952_P1 | 1088 | 6411 | 492 | 98.2 | globlastp |
| LAB633_H56 | phyla\|11v2\|SRR099035X11119_P1 | 1089 | 6411 | 492 | 98.2 | globlastp |
| LAB633_H57 | phyla\|11v2\|SRR099037X106816_P1 | 1090 | 6411 | 492 | 98.2 | globlastp |
| LAB633_H58 | plantago\|11v2\|AM111326_P1 | 1091 | 6411 | 492 | 98.2 | globlastp |
| LAB633_H59 | plantago\|11v2\|SRR066373X10076_P1 | 1092 | 6411 | 492 | 98.2 | globlastp |
| LAB633_H60 | plantago\|11v2\|SRR066373X101900_P1 | 1093 | 6411 | 492 | 98.2 | globlastp |
| LAB633_H61 | plantago\|11v2\|SRR066373X107481XX1_P1 | 1094 | 6411 | 492 | 98.2 | globlastp |
| LAB633_H62 | plantago\|11v2\|SRR066373X112910_P1 | 1095 | 6411 | 492 | 98.2 | globlastp |
| LAB633_H63 | rice\|11v1\|OSU27098 | 1096 | 6417 | 492 | 98.2 | globlastp |
| LAB633_H64 | salvia\|10v1\|CV162426 | 1097 | 6411 | 492 | 98.2 | globlastp |
| LAB633_H65 | salvia\|10v1\|CV163575 | 1098 | 6411 | 492 | 98.2 | globlastp |
| LAB633_H66 | salvia\|10v1\|CV165970 | 1099 | 6411 | 492 | 98.2 | globlastp |
| LAB633_H67 | sesame\|10v1\|BU668441 | 1100 | 6411 | 492 | 98.2 | globlastp |
| LAB633_H68 | switchgrass\|gb167\|DN140816 | 1101 | 6418 | 492 | 98.2 | globlastp |
| LAB633_H69 | switchgrass\|gb167\|DN147486 | 1102 | 6418 | 492 | 98.2 | globlastp |
| LAB633_H70 | switchgrass\|gb167\|FL726205 | 1103 | 6418 | 492 | 98.2 | globlastp |
| LAB633_H71 | utricularia\|11v1\|SRR094438.101758 | 1104 | 6411 | 492 | 98.2 | globlastp |
| LAB633_H72 | utricularia\|11v1\|SRR094438.10823 | 1105 | 6411 | 492 | 98.2 | globlastp |
| LAB633_H854 | aquilegia\|10v2\|JGIAC003445_P1 | 1106 | 6419 | 492 | 97.6 | globlastp |
| LAB633_H855 | aquilegia\|10v2\|JGIAC016860_P1 | 1107 | 6419 | 492 | 97.6 | globlastp |
| LAB633_H856 | aquilegia\|10v2\|JGIAC016861_P1 | 1108 | 6419 | 492 | 97.6 | globlastp |
| LAB633_H857 | blueberry\|12v1\|SRR353282X19997D1_P1 | 1109 | 6420 | 492 | 97.6 | globlastp |
| LAB633_H858 | blueberry\|12v1\|SRR353282X48934D1_P1 | 1110 | 6421 | 492 | 97.6 | globlastp |
| LAB633_H859 | blueberry\|12v1\|SRR353283X59210D1_P1 | 1111 | 6420 | 492 | 97.6 | globlastp |
| LAB633_H860 | lettuce\|12v1\|DW047671_P1 | 1112 | 6419 | 492 | 97.6 | globlastp |
| LAB633_H861 | lettuce\|12v1\|DW049950_P1 | 1113 | 6419 | 492 | 97.6 | globlastp |
| LAB633_H862 | lettuce\|12v1\|DW052416_P1 | 1114 | 6419 | 492 | 97.6 | globlastp |
| LAB633_H863 | olea\|13v1\|SRR014463X12263D1_P1 | 1115 | 6422 | 492 | 97.6 | globlastp |
| LAB633_H864 | olea\|13v1\|SRR014463X37052D1_P1 | 1116 | 6422 | 492 | 97.6 | globlastp |
| LAB633_H73 | ambrosia\|11v1\|SRR346935.136635_P1 | 1117 | 6419 | 492 | 97.6 | globlastp |
| LAB633_H74 | ambrosia\|11v1\|SRR346943.106432_P1 | 1118 | 6419 | 492 | 97.6 | globlastp |
| LAB633_H75 | amorphophallus\|11v2\|SRR089351X101594_P1 | 1119 | 6423 | 492 | 97.6 | globlastp |
| LAB633_H76 | antirrhinum\|gb166\|AJ568930_P1 | 1120 | 6424 | 492 | 97.6 | globlastp |
| LAB633_H77 | antirrhinum\|gb166\|AJ789388_P1 | 1121 | 6424 | 492 | 97.6 | globlastp |
| LAB633_H78 | arnica\|11v1\|SRR099034X103156_P1 | 1122 | 6419 | 492 | 97.6 | globlastp |
| LAB633_H79 | arnica\|11v1\|SRR099034X104823_P1 | 1123 | 6419 | 492 | 97.6 | globlastp |
| LAB633_H80 | arnica\|11v1\|SRR099034X111168_P1 | 1124 | 6419 | 492 | 97.6 | globlastp |
| LAB633_H81 | artemisia\|10v1\|EY034262_P1 | 1125 | 6419 | 492 | 97.6 | globlastp |
| LAB633_H82 | artemisia\|10v1\|EY034465_P1 | 1126 | 6419 | 492 | 97.6 | globlastp |
| LAB633_H83 | artemisia\|10v1\|EY034925_P1 | 1127 | 6419 | 492 | 97.6 | globlastp |
| LAB633_H84 | artemisia\|10v1\|EY041025_P1 | 1128 | 6419 | 492 | 97.6 | globlastp |
| LAB633_H85 | centaurea\|gb166\|EH732632_P1 | 1129 | 6419 | 492 | 97.6 | globlastp |
| LAB633_H86 | centaurea\|gb166\|EL934361_P1 | 1130 | 6419 | 492 | 97.6 | globlastp |
| LAB633_H87 | chelidonium\|11v1\|SRR084752X100270_P1 | 1131 | 6419 | 492 | 97.6 | globlastp |
| LAB633_H88 | chelidonium\|11v1\|SRR084752X10178_P1 | 1132 | 6419 | 492 | 97.6 | globlastp |
| LAB633_H89 | cichorium\|gb171\|EH695839_P1 | 1133 | 6419 | 492 | 97.6 | globlastp |
| LAB633_H90 | cirsium\|11v1\|SRR346952.1001408_P1 | 1134 | 6419 | 492 | 97.6 | globlastp |
| LAB633_H91 | cirsium\|11v1\|SRR346952.105930_P1 | 1135 | 6419 | 492 | 97.6 | globlastp |
| LAB633_H92 | cirsium\|11v1\|SRR346952.114294_P1 | 1136 | 6419 | 492 | 97.6 | globlastp |
| LAB633_H93 | cirsium\|11v1\|SRR346952.116592_P1 | 1137 | 6419 | 492 | 97.6 | globlastp |
| LAB633_H94 | cleome_gynandra\|10v1\|SRR015532S0004391_P1 | 1138 | 6423 | 492 | 97.6 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H95 | cleome_gynandra\|10v1\|SRR015532S0008445_P1 | 1139 | 6423 | 492 | 97.6 | globlastp |
| LAB633_H96 | cleome_gynandra\|10v1\|SRR015532S0015385_P1 | 1140 | 6423 | 492 | 97.6 | globlastp |
| LAB633_H97 | cleome_gynandra\|10v1\|SRR015532S0017364_P1 | 1141 | 6423 | 492 | 97.6 | globlastp |
| LAB633_H98 | cleome_spinosa\|10v1\|GR933979_P1 | 1142 | 6423 | 492 | 97.6 | globlastp |
| LAB633_H99 | cleome_spinosa\|10v1\|SRR015531S0001748_P1 | 1143 | 6423 | 492 | 97.6 | globlastp |
| LAB633_H100 | cleome_spinosa\|10v1\|SRR015531S0005669_P1 | 1144 | 6423 | 492 | 97.6 | globlastp |
| LAB633_H101 | cucumber\|09v1\|AA660091_P1 | 1145 | 6425 | 492 | 97.6 | globlastp |
| LAB633_H102 | cucumber\|09v1\|CK757080_P1 | 1146 | 6426 | 492 | 97.6 | globlastp |
| LAB633_H103 | cucurbita\|11v1\|SRR091276X101055_P1 | 1147 | 6419 | 492 | 97.6 | globlastp |
| LAB633_H104 | cucurbita\|11v1\|SRR091276X10385_P1 | 1148 | 6419 | 492 | 97.6 | globlastp |
| LAB633_H105 | cucurbita\|11v1\|SRR091276X106496_P1 | 1149 | 6419 | 492 | 97.6 | globlastp |
| LAB633_H106 | cucurbita\|11v1\|SRR091276X121934_P1 | 1150 | 6419 | 492 | 97.6 | globlastp |
| LAB633_H107 | curcuma\|10v1\|DY391309_P1 | 1151 | 6423 | 492 | 97.6 | globlastp |
| LAB633_H108 | cynara\|gb167\|GE588641_P1 | 1152 | 6419 | 492 | 97.6 | globlastp |
| LAB633_H109 | cynara\|gb167\|GE589330_P1 | 1153 | 6419 | 492 | 97.6 | globlastp |
| LAB633_H110 | cynara\|gb167\|GE590889_P1 | 1154 | 6419 | 492 | 97.6 | globlastp |
| LAB633_H111 | dandelion\|10v1\|DR399179_P1 | 1155 | 6419 | 492 | 97.6 | globlastp |
| LAB633_H112 | dandelion\|10v1\|DY813410_P1 | 1156 | 6419 | 492 | 97.6 | globlastp |
| LAB633_H113 | eschscholzia\|11v1\|SRR014116.103341_P1 | 1157 | 6427 | 492 | 97.6 | globlastp |
| LAB633_H114 | eucalyptus\|11v2\|CD669362_P1 | 1158 | 6419 | 492 | 97.6 | globlastp |
| LAB633_H115 | eucalyptus\|11v2\|CU403628_P1 | 1159 | 6419 | 492 | 97.6 | globlastp |
| LAB633_H116 | euonymus\|11v1\|SRR070038X129055_P1 | 1160 | 6419 | 492 | 97.6 | globlastp |
| LAB633_H117 | euonymus\|11v1\|SRR070038X19301_P1 | 1161 | 6419 | 492 | 97.6 | globlastp |
| LAB633_H118 | euphorbia\|11v1\|DV138882_P1 | 1162 | 6419 | 492 | 97.6 | globlastp |
| LAB633_H119 | flaveria\|11v1\|SRR149229.100132_P1 | 1163 | 6419 | 492 | 97.6 | globlastp |
| LAB633_H120 | flaveria\|11v1\|SRR149229.101132_P1 | 1164 | 6419 | 492 | 97.6 | globlastp |
| LAB633_H121 | flaveria\|11v1\|SRR149229.103382_P1 | 1165 | 6419 | 492 | 97.6 | globlastp |
| LAB633_H122 | flaveria\|11v1\|SRR149229.105561_P1 | 1166 | 6419 | 492 | 97.6 | globlastp |
| LAB633_H123 | flaveria\|11v1\|SRR149229.105836_P1 | 1167 | 6419 | 492 | 97.6 | globlastp |
| LAB633_H124 | flaveria\|11v1\|SRR149229.108473_P1 | 1168 | 6419 | 492 | 97.6 | globlastp |
| LAB633_H125 | flaveria\|11v1\|SRR149229.116585_P1 | 1169 | 6419 | 492 | 97.6 | globlastp |
| LAB633_H126 | flaveria\|11v1\|SRR149229.138545_P1 | 1170 | 6419 | 492 | 97.6 | globlastp |
| LAB633_H127 | flaveria\|11v1\|SRR149229.148499_P1 | 1171 | 6419 | 492 | 97.6 | globlastp |
| LAB633_H128 | flaveria\|11v1\|SRR149229.206477XX2_P1 | 1172 | 6419 | 492 | 97.6 | globlastp |
| LAB633_H129 | flaveria\|11v1\|SRR149232.117932_P1 | 1173 | 6419 | 492 | 97.6 | globlastp |
| LAB633_H130 | flaveria\|11v1\|SRR149240.2502_P1 | 1174 | 6419 | 492 | 97.6 | globlastp |
| LAB633_H131 | flaveria\|11v1\|SRR149241.101182_P1 | 1175 | 6419 | 492 | 97.6 | globlastp |
| LAB633_H132 | flaveria\|11v1\|SRR149241.101373_P1 | 1176 | 6419 | 492 | 97.6 | globlastp |
| LAB633_H133 | flaveria\|11v1\|SRR149241.10512_P1 | 1177 | 6419 | 492 | 97.6 | globlastp |
| LAB633_H134 | flaveria\|11v1\|SRR149241.107333_P1 | 1178 | 6419 | 492 | 97.6 | globlastp |
| LAB633_H135 | flaveria\|11v1\|SRR149244.160431_P1 | 1179 | 6419 | 492 | 97.6 | globlastp |
| LAB633_H136 | foxtail_millet\|11v3\|PHY7SI023455M_P1 | 1180 | 6428 | 492 | 97.6 | globlastp |
| LAB633_H137 | fraxinus\|11v1\|SRR058827.104108_P1 | 1181 | 6425 | 492 | 97.6 | globlastp |
| LAB633_H138 | ginger\|gb164\|DY345311_P1 | 1182 | 6423 | 492 | 97.6 | globlastp |
| LAB633_H139 | ginger\|gb164\|DY347115_P1 | 1183 | 6423 | 492 | 97.6 | globlastp |
| LAB633_H140 | ginger\|gb164\|DY350603_P1 | 1184 | 6423 | 492 | 97.6 | globlastp |
| LAB633_H141 | ginger\|gb164\|DY354596_P1 | 1185 | 6423 | 492 | 97.6 | globlastp |
| LAB633_H142 | guizotia\|10v1\|GE561811_P1 | 1186 | 6419 | 492 | 97.6 | globlastp |
| LAB633_H143 | hornbeam\|12v1\|SRR364455.135058_P1 | 1187 | 6423 | 492 | 97.6 | globlastp |
| LAB633_H144 | kiwi\|gb166\|FG403438_P1 | 1188 | 6419 | 492 | 97.6 | globlastp |
| LAB633_H145 | kiwi\|gb166\|FG403625_P1 | 1189 | 6419 | 492 | 97.6 | globlastp |
| LAB633_H146 | kiwi\|gb166\|FG404684_P1 | 1190 | 6419 | 492 | 97.6 | globlastp |
| LAB633_H147 | kiwi\|gb166\|FG408209_P1 | 1191 | 6419 | 492 | 97.6 | globlastp |
| LAB633_H148 | kiwi\|gb166\|FG409549_P1 | 1192 | 6419 | 492 | 97.6 | globlastp |
| LAB633_H149 | kiwi\|gb166\|FG431746_P1 | 1193 | 6419 | 492 | 97.6 | globlastp |
| LAB633_H150 | kiwi\|gb166\|FG482106_P1 | 1194 | 6419 | 492 | 97.6 | globlastp |
| LAB633_H151 | lettuce\|10v1\|DW047671 | 1195 | 6419 | 492 | 97.6 | globlastp |
| LAB633_H152 | lettuce\|10v1\|DW049950 | 1196 | 6419 | 492 | 97.6 | globlastp |
| LAB633_H153 | lettuce\|10v1\|DW052416 | 1197 | 6419 | 492 | 97.6 | globlastp |
| LAB633_H154 | lettuce\|10v1\|DW076667 | 1198 | 6419 | 492 | 97.6 | globlastp |
| LAB633_H155 | liriodendron\|gb166\|CK747954_P1 | 1199 | 6419 | 492 | 97.6 | globlastp |
| LAB633_H156 | liriodendron\|gb166\|CK765234_P1 | 1200 | 6419 | 492 | 97.6 | globlastp |
| LAB633_H157 | maize\|10v1\|T70653_P1 | 1201 | 6429 | 492 | 97.6 | globlastp |
| LAB633_H158 | melon\|10v1\|AM716244_P1 | 1202 | 6419 | 492 | 97.6 | globlastp |
| LAB633_H159 | melon\|10v1\|EB715750_P1 | 1203 | 6419 | 492 | 97.6 | globlastp |
| LAB633_H160 | momordica\|10v1\|SRR071315S0012856_P1 | 1204 | 6419 | 492 | 97.6 | globlastp |
| LAB633_H161 | monkeyflower\|10v1\|DV208883 | 1205 | 6430 | 492 | 97.6 | globlastp |
| LAB633_H161 | monkeyflower\|12v1\|DV208883_P1 | 1206 | 6430 | 492 | 97.6 | globlastp |
| LAB633_H162 | monkeyflower\|10v1\|DV209379 | 1207 | 6430 | 492 | 97.6 | globlastp |
| LAB633_H162 | monkeyflower\|12v1\|DV209379_P1 | 1208 | 6430 | 492 | 97.6 | globlastp |
| LAB633_H163 | monkeyflower\|10v1\|DV209797 | 1209 | 6430 | 492 | 97.6 | globlastp |
| LAB633_H163 | monkeyflower\|12v1\|DV209797_P1 | 1210 | 6430 | 492 | 97.6 | globlastp |
| LAB633_H164 | oat\|11v1\|GO583800_P1 | 1211 | 6431 | 492 | 97.6 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H165 | oil_palm\|11v1\|ES370775_P1 | 1212 | 6423 | 492 | 97.6 | globlastp |
| LAB633_H166 | olea\|11v1\|SRR014463.13485 | 1213 | 6419 | 492 | 97.6 | globlastp |
| LAB633_H166 | olea\|13v1\|SRR014463X13485D1_P1 | 1214 | 6419 | 492 | 97.6 | globlastp |
| LAB633_H167 | orange\|11v1\|AB024274_P1 | 1215 | 6425 | 492 | 97.6 | globlastp |
| LAB633_H168 | orange\|11v1\|CB290639_P1 | 1216 | 6426 | 492 | 97.6 | globlastp |
| LAB633_H169 | orobanche\|10v1\|SRR023189S0000251_P1 | 1217 | 6430 | 492 | 97.6 | globlastp |
| LAB633_H170 | orobanche\|10v1\|SRR023189S0083703_P1 | 1218 | 6430 | 492 | 97.6 | globlastp |
| LAB633_H171 | parthenium\|10v1\|GW775598_P1 | 1219 | 6419 | 492 | 97.6 | globlastp |
| LAB633_H172 | parthenium\|10v1\|GW778894_P1 | 1220 | 6419 | 492 | 97.6 | globlastp |
| LAB633_H173 | parthenium\|10v1\|GW781801_P1 | 1221 | 6419 | 492 | 97.6 | globlastp |
| LAB633_H174 | phyla\|11v2\|SRR099035X10279_P1 | 1222 | 6432 | 492 | 97.6 | globlastp |
| LAB633_H175 | poppy\|11v1\|FE965497_P1 | 1223 | 6419 | 492 | 97.6 | globlastp |
| LAB633_H176 | poppy\|11v1\|FE967925_P1 | 1224 | 6419 | 492 | 97.6 | globlastp |
| LAB633_H177 | poppy\|11v1\|SRR030259.101706_P1 | 1225 | 6426 | 492 | 97.6 | globlastp |
| LAB633_H178 | poppy\|11v1\|SRR030259.101939_P1 | 1226 | 6426 | 492 | 97.6 | globlastp |
| LAB633_H179 | poppy\|11v1\|SRR096789.104022_P1 | 1227 | 6419 | 492 | 97.6 | globlastp |
| LAB633_H180 | poppy\|11v1\|SRR096789.104833_P1 | 1228 | 6419 | 492 | 97.6 | globlastp |
| LAB633_H181 | rice\|11v1\|BE040702 | 1229 | 6433 | 492 | 97.6 | globlastp |
| LAB633_H182 | rose\|12v1\|BI977379 | 1230 | 6419 | 492 | 97.6 | globlastp |
| LAB633_H183 | rye\|12v1\|BF145399 | 1231 | 6434 | 492 | 97.6 | globlastp |
| LAB633_H184 | rye\|12v1\|DRR001012.150829 | 1232 | 6434 | 492 | 97.6 | globlastp |
| LAB633_H185 | safflower\|gb162\|EL398959 | 1233 | 6419 | 492 | 97.6 | globlastp |
| LAB633_H186 | safflower\|gb162\|EL400023 | 1234 | 6419 | 492 | 97.6 | globlastp |
| LAB633_H187 | safflower\|gb162\|EL401162 | 1235 | 6419 | 492 | 97.6 | globlastp |
| LAB633_H188 | safflower\|gb162\|EL402112 | 1236 | 6419 | 492 | 97.6 | globlastp |
| LAB633_H189 | sarracenia\|11v1\|SRR192669.101330 | 1237 | 6419 | 492 | 97.6 | globlastp |
| LAB633_H190 | sarracenia\|11v1\|SRR192669.103204 | 1238 | 6419 | 492 | 97.6 | globlastp |
| LAB633_H191 | sarracenia\|11v1\|SRR192669.104490 | 1239 | 6419 | 492 | 97.6 | globlastp |
| LAB633_H192 | scabiosa\|11v1\|SRR063723X100330 | 1240 | 6419 | 492 | 97.6 | globlastp |
| LAB633_H193 | scabiosa\|11v1\|SRR063723X100627 | 1241 | 6419 | 492 | 97.6 | globlastp |
| LAB633_H194 | scabiosa\|11v1\|SRR063723X100798 | 1242 | 6419 | 492 | 97.6 | globlastp |
| LAB633_H195 | scabiosa\|11v1\|SRR063723X102228 | 1243 | 6419 | 492 | 97.6 | globlastp |
| LAB633_H196 | scabiosa\|11v1\|SRR063723X111751 | 1244 | 6419 | 492 | 97.6 | globlastp |
| LAB633_H197 | senecio\|gb170\|DY661370 | 1245 | 6419 | 492 | 97.6 | globlastp |
| LAB633_H198 | sunflower\|12v1\|CD845624 | 1246 | 6419 | 492 | 97.6 | globlastp |
| LAB633_H199 | sunflower\|12v1\|DY910343 | 1247 | 6419 | 492 | 97.6 | globlastp |
| LAB633_H200 | sunflower\|12v1\|DY914673 | 1248 | 6419 | 492 | 97.6 | globlastp |
| LAB633_H201 | sunflower\|12v1\|DY917358 | 1249 | 6419 | 492 | 97.6 | globlastp |
| LAB633_H202 | sunflower\|12v1\|DY943926 | 1250 | 6419 | 492 | 97.6 | globlastp |
| LAB633_H203 | sunflower\|12v1\|EE638178 | 1251 | 6419 | 492 | 97.6 | globlastp |
| LAB633_H204 | switchgrass\|12v1\|DN142552_P1 | 1252 | 6435 | 492 | 97.6 | globlastp |
| LAB633_H204 | switchgrass\|gb167\|DN142552 | 1253 | 6435 | 492 | 97.6 | globlastp |
| LAB633_H205 | tragopogon\|10v1\|SRR020205S0003683 | 1254 | 6419 | 492 | 97.6 | globlastp |
| LAB633_H206 | tragopogon\|10v1\|SRR020205S0032939 | 1255 | 6419 | 492 | 97.6 | globlastp |
| LAB633_H207 | triphysaria\|10v1\|DR173974 | 1256 | 6430 | 492 | 97.6 | globlastp |
| LAB633_H208 | triphysaria\|10v1\|EY000502 | 1257 | 6430 | 492 | 97.6 | globlastp |
| LAB633_H209 | triphysaria\|10v1\|EY127066 | 1258 | 6430 | 492 | 97.6 | globlastp |
| LAB633_H210 | triphysaria\|10v1\|EY128086 | 1259 | 6430 | 492 | 97.6 | globlastp |
| LAB633_H211 | triphysaria\|10v1\|EY131693 | 1260 | 6430 | 492 | 97.6 | globlastp |
| LAB633_H212 | triphysaria\|10v1\|EY133280 | 1261 | 6430 | 492 | 97.6 | globlastp |
| LAB633_H213 | utricularia\|11v1\|SRR094438.100321 | 1262 | 6424 | 492 | 97.6 | globlastp |
| LAB633_H214 | valeriana\|11v1\|SRR099039X101962 | 1263 | 6419 | 492 | 97.6 | globlastp |
| LAB633_H215 | valeriana\|11v1\|SRR099039X104138 | 1264 | 6419 | 492 | 97.6 | globlastp |
| LAB633_H216 | vinca\|11v1\|SRR098690X101183 | 1265 | 6436 | 492 | 97.6 | globlastp |
| LAB633_H217 | vinca\|11v1\|SRR098690X103298 | 1266 | 6436 | 492 | 97.6 | globlastp |
| LAB633_H218 | vinca\|11v1\|SRR098690X115104 | 1267 | 6436 | 492 | 97.6 | globlastp |
| LAB633_H219 | watermelon\|11v1\|AA660091 | 1268 | 6419 | 492 | 97.6 | globlastp |
| LAB633_H220 | watermelon\|11v1\|CK757080 | 1269 | 6419 | 492 | 97.6 | globlastp |
| LAB633_H221 | wheat\|10v2\|CA485794 | 1270 | 6433 | 492 | 97.6 | globlastp |
| LAB633_H222 | ambrosia\|11v1\|SRR346935.104209_T1 | 1271 | 6437 | 492 | 97.58 | globtblastn |
| LAB633_H865 | aquilegia\|10v2\|JGIAC011264_P1 | 1272 | 6438 | 492 | 97 | globlastp |
| LAB633_H866 | bean\|12v2\|CA901989_P1 | 1273 | 6439 | 492 | 97 | globlastp |
| LAB633_H867 | blueberry\|12v1\|SRR353282X101071D1_P1 | 1274 | 6440 | 492 | 97 | globlastp |
| LAB633_H868 | blueberry\|12v1\|SRR353282X24384D1_P1 | 1275 | 6441 | 492 | 97 | globlastp |
| LAB633_H869 | olea\|13v1\|SRR014463X21059D1_P1 | 1276 | 6442 | 492 | 97 | globlastp |
| LAB633_H870 | zostera\|12v1\|SRR057351X103945D1_P1 | 1277 | 6443 | 492 | 97 | globlastp |
| LAB633_H223 | amsonia\|11v1\|SRR098688X102958_P1 | 1278 | 6444 | 492 | 97 | globlastp |
| LAB633_H224 | amsonia\|11v1\|SRR098688X103733_P1 | 1279 | 6445 | 492 | 97 | globlastp |
| LAB633_H225 | antirrhinum\|gb166\|AJ788617_P1 | 1280 | 6446 | 492 | 97 | globlastp |
| LAB633_H226 | antirrhinum\|gb166\|AJ802464_P1 | 1281 | 6447 | 492 | 97 | globlastp |
| LAB633_H227 | apple\|11v1\|CN878272_P1 | 1282 | 6448 | 492 | 97 | globlastp |
| LAB633_H228 | aristolochia\|10v1\|FD751918_P1 | 1283 | 6449 | 492 | 97 | globlastp |
| LAB633_H229 | arnica\|11v1\|SRR099034X119562_P1 | 1284 | 6450 | 492 | 97 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H230 | bean\|12v1\|CA901989 | 1285 | 6439 | 492 | 97 | globlastp |
| LAB633_H231 | beech\|11v1\|AM062973_P1 | 1286 | 6451 | 492 | 97 | globlastp |
| LAB633_H232 | beech\|11v1\|SRR006293.30383_P1 | 1287 | 6451 | 492 | 97 | globlastp |
| LAB633_H233 | beet\|12v1\|AJ002061_P1 | 1288 | 6452 | 492 | 97 | globlastp |
| LAB633_H234 | beet\|12v1\|X98851_P1 | 1289 | 6452 | 492 | 97 | globlastp |
| LAB633_H235 | bupleurum\|11v1\|FG341924_P1 | 1290 | 6453 | 492 | 97 | globlastp |
| LAB633_H236 | cacao\|10v1\|CA794658_P1 | 1291 | 6454 | 492 | 97 | globlastp |
| LAB633_H237 | cacao\|10v1\|CA795252_P1 | 1292 | 6454 | 492 | 97 | globlastp |
| LAB633_H238 | cacao\|10v1\|CU476305_P1 | 1293 | 6454 | 492 | 97 | globlastp |
| LAB633_H239 | cacao\|10v1\|CU481444_P1 | 1294 | 6454 | 492 | 97 | globlastp |
| LAB633_H240 | cannabis\|12v1\|EW701787_P1 | 1295 | 6454 | 492 | 97 | globlastp |
| LAB633_H241 | cannabis\|12v1\|SOLX00063245_P1 | 1296 | 6454 | 492 | 97 | globlastp |
| LAB633_H242 | cassava\|09v1\|CK648184_P1 | 1297 | 6455 | 492 | 97 | globlastp |
| LAB633_H243 | cassava\|09v1\|FF534471_P1 | 1298 | 6455 | 492 | 97 | globlastp |
| LAB633_H244 | castorbean\|12v1\|EE258463_P1 | 1299 | 6455 | 492 | 97 | globlastp |
| LAB633_H245 | castorbean\|12v1\|EG657815_P1 | 1300 | 6455 | 492 | 97 | globlastp |
| LAB633_H246 | castorbean\|11v1\|EG698149 | 1301 | 6455 | 492 | 97 | globlastp |
| LAB633_H246 | castorbean\|12v1\|EG698149_P1 | 1302 | 6455 | 492 | 97 | globlastp |
| LAB633_H247 | catharanthus\|11v1\|EG555852_P1 | 1303 | 6456 | 492 | 97 | globlastp |
| LAB633_H248 | catharanthus\|11v1\|EG556119_P1 | 1304 | 6444 | 492 | 97 | globlastp |
| LAB633_H249 | centaurea\|gb166\|EH727314_P1 | 1305 | 6457 | 492 | 97 | globlastp |
| LAB633_H250 | cichorium\|gb171\|EH690425_P1 | 1306 | 6458 | 492 | 97 | globlastp |
| LAB633_H251 | cichorium\|gb171\|EH698654_P1 | 1307 | 6450 | 492 | 97 | globlastp |
| LAB633_H252 | clementine\|11v1\|AB024274_P1 | 1308 | 6459 | 492 | 97 | globlastp |
| LAB633_H253 | clementine\|11v1\|AB024275_P1 | 1309 | 6454 | 492 | 97 | globlastp |
| LAB633_H254 | clementine\|11v1\|AB024276_P1 | 1310 | 6460 | 492 | 97 | globlastp |
| LAB633_H255 | clementine\|11v1\|CB290639_P1 | 1311 | 6461 | 492 | 97 | globlastp |
| LAB633_H256 | cleome_spinosa\|10v1\|GR933175_P1 | 1312 | 6462 | 492 | 97 | globlastp |
| LAB633_H257 | cleome_spinosa\|10v1\|SRR015531S0024217_P1 | 1313 | 6463 | 492 | 97 | globlastp |
| LAB633_H258 | cleome_spinosa\|10v1\|SRR015531S0031567_P1 | 1314 | 6463 | 492 | 97 | globlastp |
| LAB633_H259 | coffea\|10v1\|DV664078_P1 | 1315 | 6444 | 492 | 97 | globlastp |
| LAB633_H260 | coffea\|10v1\|DV672722_P1 | 1316 | 6444 | 492 | 97 | globlastp |
| LAB633_H261 | coffea\|10v1\|DV677102_P1 | 1317 | 6444 | 492 | 97 | globlastp |
| LAB633_H262 | cotton\|11v1\|AI727227_P1 | 1318 | 6454 | 492 | 97 | globlastp |
| LAB633_H263 | cotton\|11v1\|CO496515_P1 | 1319 | 6454 | 492 | 97 | globlastp |
| LAB633_H264 | cotton\|11v1\|GHU13669_P1 | 1320 | 6454 | 492 | 97 | globlastp |
| LAB633_H265 | cotton\|11v1\|SRR032367.106665_P1 | 1321 | 6454 | 492 | 97 | globlastp |
| LAB633_H266 | cowpea\|12v1\|FF537329_P1 | 1322 | 6439 | 492 | 97 | globlastp |
| LAB633_H266 | cowpea\|gb166\|FF537329 | 1323 | 6439 | 492 | 97 | globlastp |
| LAB633_H267 | cucumber\|09v1\|AM716244_P1 | 1324 | 6464 | 492 | 97 | globlastp |
| LAB633_H268 | cucurbita\|11v1\|SRR091276X112115_P1 | 1325 | 6465 | 492 | 97 | globlastp |
| LAB633_H269 | cucurbita\|11v1\|SRR091276X115189_P1 | 1326 | 6465 | 492 | 97 | globlastp |
| LAB633_H270 | dandelion\|10v1\|DR399923_P1 | 1327 | 6461 | 492 | 97 | globlastp |
| LAB633_H271 | epimedium\|11v1\|SRR013502.25475_P1 | 1328 | 6438 | 492 | 97 | globlastp |
| LAB633_H272 | euonymus\|11v1\|SRR070038X107842_P1 | 1329 | 6466 | 492 | 97 | globlastp |
| LAB633_H273 | euonymus\|11v1\|SRR070038X128865_P1 | 1330 | 6465 | 492 | 97 | globlastp |
| LAB633_H274 | euonymus\|11v1\|SRR070038X132672_P1 | 1331 | 6465 | 492 | 97 | globlastp |
| LAB633_H275 | flaveria\|11v1\|SRR149232.102632_P1 | 1332 | 6467 | 492 | 97 | globlastp |
| LAB633_H276 | flaveria\|11v1\|SRR149232.111262_P1 | 1333 | 6454 | 492 | 97 | globlastp |
| LAB633_H277 | flax\|11v1\|CV478820_P1 | 1334 | 6465 | 492 | 97 | globlastp |
| LAB633_H278 | flax\|11v1\|CV478915_P1 | 1335 | 6465 | 492 | 97 | globlastp |
| LAB633_H279 | flax\|11v1\|EU829089_P1 | 1336 | 6465 | 492 | 97 | globlastp |
| LAB633_H280 | flax\|11v1\|GW865805_P1 | 1337 | 6465 | 492 | 97 | globlastp |
| LAB633_H281 | flax\|11v1\|JG022116_P1 | 1338 | 6468 | 492 | 97 | globlastp |
| LAB633_H282 | flax\|11v1\|JG082027_P1 | 1339 | 6465 | 492 | 97 | globlastp |
| LAB633_H283 | foxtail_millet\|11v3\|PHY7SI012647M_P1 | 1340 | 6469 | 492 | 97 | globlastp |
| LAB633_H284 | fraxinus\|11v1\|SRR058827.123841_P1 | 1341 | 6470 | 492 | 97 | globlastp |
| LAB633_H285 | gerbera\|09v1\|AJ751180_P1 | 1342 | 6471 | 492 | 97 | globlastp |
| LAB633_H286 | gossypium_raimondii\|12v1\|ES826736_P1 | 1343 | 6454 | 492 | 97 | globlastp |
| LAB633_H287 | gossypium_raimondii\|12v1\|GHU13669_P1 | 1344 | 6454 | 492 | 97 | globlastp |
| LAB633_H288 | guizotia\|10v1\|GE557183_P1 | 1345 | 6472 | 492 | 97 | globlastp |
| LAB633_H289 | hevea\|10v1\|EC600159_P1 | 1346 | 6455 | 492 | 97 | globlastp |
| LAB633_H290 | humulus\|11v1\|ES654825_P1 | 1347 | 6454 | 492 | 97 | globlastp |
| LAB633_H291 | humulus\|11v1\|ES654966_P1 | 1348 | 6454 | 492 | 97 | globlastp |
| LAB633_H292 | humulus\|11v1\|EX515795_P1 | 1349 | 6454 | 492 | 97 | globlastp |
| LAB633_H293 | jatropha\|09v1\|GH295935_P1 | 1350 | 6473 | 492 | 97 | globlastp |
| LAB633_H294 | lettuce\|10v1\|DW083002 | 1351 | 6474 | 492 | 97 | globlastp |
| LAB633_H295 | liriodendron\|gb166\|CK751486_P1 | 1352 | 6438 | 492 | 97 | globlastp |
| LAB633_H296 | maritime_pine\|10v1\|BX249443_P1 | 1353 | 6475 | 492 | 97 | globlastp |
| LAB633_H297 | millet\|10v1\|CD726180_P1 | 1354 | 6469 | 492 | 97 | globlastp |
| LAB633_H298 | millet\|10v1\|EVO454PM005459_P1 | 1355 | 6469 | 492 | 97 | globlastp |
| LAB633_H299 | momordica\|10v1\|SRR071315S0002019_P1 | 1356 | 6476 | 492 | 97 | globlastp |
| LAB633_H300 | nuphar\|gb166\|CK751168_P1 | 1357 | 6477 | 492 | 97 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H301 | oil_palm\|11v1\|DW248073_P1 | 1358 | 6478 | 492 | 97 | globlastp |
| LAB633_H302 | oil_palm\|11v1\|EL683839_P1 | 1359 | 6478 | 492 | 97 | globlastp |
| LAB633_H303 | oil_palm\|11v1\|EL685221_P1 | 1360 | 6479 | 492 | 97 | globlastp |
| LAB633_H304 | oil_palm\|11v1\|SRR190698.254295_P1 | 1361 | 6478 | 492 | 97 | globlastp |
| LAB633_H305 | orange\|11v1\|AB024275_P1 | 1362 | 6454 | 492 | 97 | globlastp |
| LAB633_H306 | orange\|11v1\|AB024276_P1 | 1363 | 6460 | 492 | 97 | globlastp |
| LAB633_H307 | papaya\|gb165\|EX258745_P1 | 1364 | 6480 | 492 | 97 | globlastp |
| LAB633_H308 | pine\|10v2\|AI812928_P1 | 1365 | 6475 | 492 | 97 | globlastp |
| LAB633_H309 | poplar\|10v1\|BI121380 | 1366 | 6454 | 492 | 97 | globlastp |
| LAB633_H309 | poplar\|13v1\|BI121380_P1 | 1367 | 6454 | 492 | 97 | globlastp |
| LAB633_H310 | primula\|11v1\|SRR098679X100571_P1 | 1368 | 6481 | 492 | 97 | globlastp |
| LAB633_H311 | pteridium\|11v1\|SRR043594X121574 | 1369 | 6454 | 492 | 97 | globlastp |
| LAB633_H312 | rice\|11v1\|BI806048 | 1370 | 6482 | 492 | 97 | globlastp |
| LAB633_H313 | rose\|12v1\|SRR397984.108251 | 1371 | 6483 | 492 | 97 | globlastp |
| LAB633_H314 | sarracenia\|11v1\|SRR192669.105728 | 1372 | 6484 | 492 | 97 | globlastp |
| LAB633_H315 | sarracenia\|11v1\|SRR192669.134358 | 1373 | 6485 | 492 | 97 | globlastp |
| LAB633_H316 | spurge\|gb161\|DV138882 | 1374 | 6486 | 492 | 97 | globlastp |
| LAB633_H317 | sugarcane\|10v1\|CA090188 | 1375 | 6487 | 492 | 97 | globlastp |
| LAB633_H318 | sunflower\|12v1\|CF076229 | 1376 | 6488 | 492 | 97 | globlastp |
| LAB633_H319 | switchgrass\|12v1\|DN152313_P1 | 1377 | 6489 | 492 | 97 | globlastp |
| LAB633_H319 | switchgrass\|gb167\|DN152313 | 1378 | 6489 | 492 | 97 | globlastp |
| LAB633_H320 | tabernaemontana\|11v1\|SRR098689X101164 | 1379 | 6444 | 492 | 97 | globlastp |
| LAB633_H321 | tabernaemontana\|11v1\|SRR098689X102587 | 1380 | 6444 | 492 | 97 | globlastp |
| LAB633_H322 | tabernaemontana\|11v1\|SRR098689X113197 | 1381 | 6456 | 492 | 97 | globlastp |
| LAB633_H323 | tamarix\|gb166\|EG970753 | 1382 | 6490 | 492 | 97 | globlastp |
| LAB633_H324 | tea\|10v1\|CV013991 | 1383 | 6465 | 492 | 97 | globlastp |
| LAB633_H325 | tea\|10v1\|GE650473 | 1384 | 6465 | 492 | 97 | globlastp |
| LAB633_H326 | thellungiella_halophilum\|11v1\|DN773957 | 1385 | 6481 | 492 | 97 | globlastp |
| LAB633_H327 | thellungiella_parvulum\|11v1\|DN773957 | 1386 | 6481 | 492 | 97 | globlastp |
| LAB633_H328 | tripterygium\|11v1\|SRR098677X100203 | 1387 | 6454 | 492 | 97 | globlastp |
| LAB633_H329 | tripterygium\|11v1\|SRR098677X102749 | 1388 | 6454 | 492 | 97 | globlastp |
| LAB633_H330 | tripterygium\|11v1\|SRR098677X105712 | 1389 | 6454 | 492 | 97 | globlastp |
| LAB633_H331 | tripterygium\|11v1\|SRR098677X115599 | 1390 | 6465 | 492 | 97 | globlastp |
| LAB633_H332 | valeriana\|11v1\|SRR099039X110443 | 1391 | 6438 | 492 | 97 | globlastp |
| LAB633_H333 | vinca\|11v1\|SRR098690X106416 | 1392 | 6491 | 492 | 97 | globlastp |
| LAB633_H334 | vinca\|11v1\|SRR098690X134272 | 1393 | 6444 | 492 | 97 | globlastp |
| LAB633_H335 | watermelon\|11v1\|SRR071315.123428 | 1394 | 6465 | 492 | 97 | globlastp |
| LAB633_H871 | blueberry\|12v1\|DR067871_T1 | 1395 | 6492 | 492 | 96.97 | glotblastn |
| LAB633_H336 | amorphophallus\|11v2\|SRR089351X118783_T1 | 1396 | 6493 | 492 | 96.97 | glotblastn |
| LAB633_H337 | flaveria\|11v1\|SRR149232.152046_T1 | 1397 | 6494 | 492 | 96.97 | glotblastn |
| LAB633_H338 | sarracenia\|11v1\|SRR192669.117471 | 1398 | 6495 | 492 | 96.97 | glotblastn |
| LAB633_H339 | thalictrum\|11v1\|SRR096787X163886 | 1399 | 6496 | 492 | 96.97 | glotblastn |
| LAB633_H340 | zostera\|10v1\|AM766942 | 1400 | 6497 | 492 | 96.97 | glotblastn |
| LAB633_H68, LAB633_H69 | switchgrass\|12v1\|DN147486_T1 | 1401 | 6498 | 492 | 96.97 | glotblastn |
| LAB633_H872 | b_juncea\|12v1\|E6ANDIZ01AR9Y5_P1 | 1402 | 6499 | 492 | 96.4 | globlastp |
| LAB633_H873 | banana\|12v1\|BBS3072T3_P1 | 1403 | 6500 | 492 | 96.4 | globlastp |
| LAB633_H874 | banana\|12v1\|ES434616_P1 | 1404 | 6501 | 492 | 96.4 | globlastp |
| LAB633_H875 | banana\|12v1\|FL658132_P1 | 1405 | 6500 | 492 | 96.4 | globlastp |
| LAB633_H876 | banana\|12v1\|MAGEN2012036094_P1 | 1406 | 6500 | 492 | 96.4 | globlastp |
| LAB633_H877 | bean\|12v2\|CA901986_P1 | 1407 | 6502 | 492 | 96.4 | globlastp |
| LAB633_H878 | bean\|12v2\|SRR001334.116689_P1 | 1408 | 6502 | 492 | 96.4 | globlastp |
| LAB633_H879 | nicotiana_benthamiana\|12v1\|CN744250_P1 | 1409 | 6503 | 492 | 96.4 | globlastp |
| LAB633_H880 | nicotiana_benthamiana\|12v1\|EB428533_P1 | 1410 | 6503 | 492 | 96.4 | globlastp |
| LAB633_H881 | olea\|13v1\|SRR014464X40253D1_P1 | 1411 | 6504 | 492 | 96.4 | globlastp |
| LAB633_H882 | onion\|12v1\|CF439201_P1 | 1412 | 6505 | 492 | 96.4 | globlastp |
| LAB633_H883 | onion\|12v1\|SRR073446X104846D1_P1 | 1413 | 6502 | 492 | 96.4 | globlastp |
| LAB633_H884 | zostera\|12v1\|AM408842_P1 | 1414 | 6506 | 492 | 96.4 | globlastp |
| LAB633_H885 | zostera\|12v1\|SRR057351X101597D1_P1 | 1415 | 6506 | 492 | 96.4 | globlastp |
| LAB633_H886 | zostera\|12v1\|SRR287819X33829D1_P1 | 1416 | 6506 | 492 | 96.4 | globlastp |
| LAB633_H341 | abies\|11v2\|SRR098676X11477_P1 | 1417 | 6507 | 492 | 96.4 | globlastp |
| LAB633_H342 | amborella\|12v2\|CK764243 | 1418 | 6508 | 492 | 96.4 | globlastp |
| LAB633_H343 | amorphophallus\|11v2\|SRR089351X100291_P1 | 1419 | 6500 | 492 | 96.4 | globlastp |
| LAB633_H344 | amorphophallus\|11v2\|SRR089351X124783_P1 | 1420 | 6500 | 492 | 96.4 | globlastp |
| LAB633_H345 | amorphophallus\|11v2\|SRR089351X198671_P1 | 1421 | 6500 | 492 | 96.4 | globlastp |
| LAB633_H346 | amsonia\|11v1\|SRR098688X100051_P1 | 1422 | 6509 | 492 | 96.4 | globlastp |
| LAB633_H347 | arabidopsis_lyrata\|09v1\|JGIAL002096_P1 | 1423 | 6510 | 492 | 96.4 | globlastp |
| LAB633_H348 | arabidopsis\|10v1\|AT1G19910_P1 | 1424 | 6511 | 492 | 96.4 | globlastp |
| LAB633_H349 | avocado\|10v1\|CK751989_P1 | 1425 | 6512 | 492 | 96.4 | globlastp |
| LAB633_H350 | b_oleracea\|gb161\|DY026088_P1 | 1426 | 6499 | 492 | 96.4 | globlastp |
| LAB633_H351 | b_oleracea\|gb161\|DY026959_P1 | 1427 | 6499 | 492 | 96.4 | globlastp |
| LAB633_H352 | b_rapa\|11v1\|L37488_P1 | 1428 | 6499 | 492 | 96.4 | globlastp |
| LAB633_H353 | banana\|10v1\|FL658132 | 1429 | 6500 | 492 | 96.4 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H354 | bean\|12v1\|CA901986 | 1430 | 6502 | 492 | 96.4 | globlastp |
| LAB633_H355 | bean\|12v1\|SRR001334.116689 | 1431 | 6502 | 492 | 96.4 | globlastp |
| LAB633_H356 | canola\|11v1\|CN728789_P1 | 1432 | 6499 | 492 | 96.4 | globlastp |
| LAB633_H357 | canola\|11v1\|DY007332_P1 | 1433 | 6499 | 492 | 96.4 | globlastp |
| LAB633_H358 | canola\|11v1\|EE424868_P1 | 1434 | 6499 | 492 | 96.4 | globlastp |
| LAB633_H359 | canola\|11v1\|EE458205_P1 | 1435 | 6499 | 492 | 96.4 | globlastp |
| LAB633_H360 | canola\|11v1\|EE458505_P1 | 1436 | 6499 | 492 | 96.4 | globlastp |
| LAB633_H361 | canola\|11v1\|EE460051_P1 | 1437 | 6499 | 492 | 96.4 | globlastp |
| LAB633_H362 | canola\|11v1\|EE460054_P1 | 1438 | 6499 | 492 | 96.4 | globlastp |
| LAB633_H363 | canola\|11v1\|EG020714_P1 | 1439 | 6513 | 492 | 96.4 | globlastp |
| LAB633_H364 | cassava\|09v1\|CK642847_P1 | 1440 | 6514 | 492 | 96.4 | globlastp |
| LAB633_H365 | cassava\|09v1\|CK648677_P1 | 1441 | 6515 | 492 | 96.4 | globlastp |
| LAB633_H366 | cassava\|09v1\|CK649863_P1 | 1442 | 6499 | 492 | 96.4 | globlastp |
| LAB633_H367 | cassava\|09v1\|DR085043_P1 | 1443 | 6499 | 492 | 96.4 | globlastp |
| LAB633_H368 | cassava\|09v1\|DV456713_P1 | 1444 | 6511 | 492 | 96.4 | globlastp |
| LAB633_H369 | chelidonium\|11v1\|SRR084752X104569_P1 | 1445 | 6500 | 492 | 96.4 | globlastp |
| LAB633_H370 | chestnut\|gb170\|SRR006295S0041423_P1 | 1446 | 6516 | 492 | 96.4 | globlastp |
| LAB633_H371 | cichorium\|gb171\|EH701723_P1 | 1447 | 6517 | 492 | 96.4 | globlastp |
| LAB633_H372 | cirsium\|11v1\|SRR346952.1011193_P1 | 1448 | 6518 | 492 | 96.4 | globlastp |
| LAB633_H373 | cleome_gynandra\|10v1\|SRR015532S0017877_P1 | 1449 | 6499 | 492 | 96.4 | globlastp |
| LAB633_H374 | cleome_spinosa\|10v1\|SRR015531S0001162_P1 | 1450 | 6519 | 492 | 96.4 | globlastp |
| LAB633_H375 | cotton\|11v1\|AF064202_P1 | 1451 | 6511 | 492 | 96.4 | globlastp |
| LAB633_H376 | cotton\|11v1\|AI054952_P1 | 1452 | 6511 | 492 | 96.4 | globlastp |
| LAB633_H377 | cotton\|11v1\|AI725776_P1 | 1453 | 6511 | 492 | 96.4 | globlastp |
| LAB633_H378 | cotton\|11v1\|BF272348_P1 | 1454 | 6511 | 492 | 96.4 | globlastp |
| LAB633_H379 | cotton\|11v1\|BQ405626_P1 | 1455 | 6511 | 492 | 96.4 | globlastp |
| LAB633_H380 | cotton\|11v1\|CO094873_P1 | 1456 | 6511 | 492 | 96.4 | globlastp |
| LAB633_H381 | cotton\|11v1\|DR454100_P1 | 1457 | 6511 | 492 | 96.4 | globlastp |
| LAB633_H382 | cotton\|11v1\|GHU13670_P1 | 1458 | 6520 | 492 | 96.4 | globlastp |
| LAB633_H383 | cowpea\|12v1\|FC458341_P1 | 1459 | 6502 | 492 | 96.4 | globlastp |
| LAB633_H383 | cowpea\|gb166\|FC458341 | 1460 | 6502 | 492 | 96.4 | globlastp |
| LAB633_H384 | cowpea\|12v1\|FF403369_P1 | 1461 | 6502 | 492 | 96.4 | globlastp |
| LAB633_H384 | cowpea\|gb166\|FF403369 | 1462 | 6502 | 492 | 96.4 | globlastp |
| LAB633_H385 | cycas\|gb166\|CB091951_P1 | 1463 | 6521 | 492 | 96.4 | globlastp |
| LAB633_H386 | eschscholzia\|11v1\|CD480350_P1 | 1464 | 6522 | 492 | 96.4 | globlastp |
| LAB633_H387 | eschscholzia\|11v1\|CK749635_P1 | 1465 | 6523 | 492 | 96.4 | globlastp |
| LAB633_H388 | eschscholzia\|11v1\|SRR014116.102395_P1 | 1466 | 6522 | 492 | 96.4 | globlastp |
| LAB633_H389 | eschscholzia\|11v1\|SRR014116.126067_P1 | 1467 | 6522 | 492 | 96.4 | globlastp |
| LAB633_H390 | eucalyptus\|11v2\|CD668139_P1 | 1468 | 6500 | 492 | 96.4 | globlastp |
| LAB633_H391 | euphorbia\|11v1\|BP958527_P1 | 1469 | 6524 | 492 | 96.4 | globlastp |
| LAB633_H392 | flaveria\|11v1\|SRR149229.104035_P1 | 1470 | 6525 | 492 | 96.4 | globlastp |
| LAB633_H393 | flaveria\|11v1\|SRR149232.100621_P1 | 1471 | 6525 | 492 | 96.4 | globlastp |
| LAB633_H394 | fraxinus\|11v1\|SRR058827.111126_P1 | 1472 | 6504 | 492 | 96.4 | globlastp |
| LAB633_H395 | gerbera\|09v1\|AJ750461_P1 | 1473 | 6526 | 492 | 96.4 | globlastp |
| LAB633_H396 | gossypium_raimondii\|12v1\|AF064202_P1 | 1474 | 6511 | 492 | 96.4 | globlastp |
| LAB633_H397 | gossypium_raimondii\|12v1\|AI054952_P1 | 1475 | 6511 | 492 | 96.4 | globlastp |
| LAB633_H398 | gossypium_raimondii\|12v1\|BF277739_P1 | 1476 | 6511 | 492 | 96.4 | globlastp |
| LAB633_H399 | gossypium_raimondii\|12v1\|BQ405626_P1 | 1477 | 6511 | 492 | 96.4 | globlastp |
| LAB633_H400 | iceplant\|gb164\|BE034027_P1 | 1478 | 6527 | 492 | 96.4 | globlastp |
| LAB633_H401 | iceplant\|gb164\|BE036727_P1 | 1479 | 6528 | 492 | 96.4 | globlastp |
| LAB633_H402 | ipomoea_batatas\|10v1\|BU690365_P1 | 1480 | 6529 | 492 | 96.4 | globlastp |
| LAB633_H403 | ipomoea_batatas\|10v1\|DV036354_P1 | 1481 | 6530 | 492 | 96.4 | globlastp |
| LAB633_H404 | ipomoea_batatas\|10v1\|EE878392_P1 | 1482 | 6529 | 492 | 96.4 | globlastp |
| LAB633_H405 | ipomoea_nil\|10v1\|BJ553380_P1 | 1483 | 6503 | 492 | 96.4 | globlastp |
| LAB633_H406 | ipomoea_nil\|10v1\|BJ554757_P1 | 1484 | 6503 | 492 | 96.4 | globlastp |
| LAB633_H407 | kiwi\|gb166\|FG405089_P1 | 1485 | 6500 | 492 | 96.4 | globlastp |
| LAB633_H408 | kiwi\|gb166\|FG445404_P1 | 1486 | 6531 | 492 | 96.4 | globlastp |
| LAB633_H409 | liquorice\|gb171\|FS255772_P1 | 1487 | 6502 | 492 | 96.4 | globlastp |
| LAB633_H410 | nasturtium\|11v1\|SRR032558.108757_P1 | 1488 | 6532 | 492 | 96.4 | globlastp |
| LAB633_H411 | nasturtium\|11v1\|SRR032559.155247_P1 | 1489 | 6533 | 492 | 96.4 | globlastp |
| LAB633_H412 | nicotiana_benthamiana\|12v1\|X95751_P1 | 1490 | 6503 | 492 | 96.4 | globlastp |
| LAB633_H412 | nicotiana_benthamiana\|gb162\|CN655207 | 1491 | 6503 | 492 | 96.4 | globlastp |
| LAB633_H413 | nicotiana_benthamiana\|gb162\|CN742495 | 1492 | 6503 | 492 | 96.4 | globlastp |
| LAB633_H414 | oil_palm\|11v1\|EL689034_P1 | 1493 | 6534 | 492 | 96.4 | globlastp |
| LAB633_H415 | olea\|11v1\|SRR014463.10832 | 1494 | 6504 | 492 | 96.4 | globlastp |
| LAB633_H415 | olea\|13v1\|SRR014463X10832D1_P1 | 1495 | 6504 | 492 | 96.4 | globlastp |
| LAB633_H416 | olea\|11v1\|SRR014463.12263 | 1496 | 6535 | 492 | 96.4 | globlastp |
| LAB633_H417 | olea\|11v1\|SRR014463.18790 | 1497 | 6504 | 492 | 96.4 | globlastp |
| LAB633_H417 | olea\|13v1\|SRR014463X18790D1_P1 | 1498 | 6504 | 492 | 96.4 | globlastp |
| LAB633_H418 | onion\|gb162\|CF439201 | 1499 | 6505 | 492 | 96.4 | globlastp |
| LAB633_H419 | papaya\|gb165\|AM904195_P1 | 1500 | 6499 | 492 | 96.4 | globlastp |
| LAB633_H420 | papaya\|gb165\|AM904284_P1 | 1501 | 6536 | 492 | 96.4 | globlastp |
| LAB633_H421 | phalaenopsis\|11v1\|CB032114_P1 | 1502 | 6502 | 492 | 96.4 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H422 | phalaenopsis\|11v1\|SRR125771.100193_P1 | 1503 | 6502 | 492 | 96.4 | globlastp |
| LAB633_H423 | phalaenopsis\|11v1\|SRR125771.1002777_P1 | 1504 | 6502 | 492 | 96.4 | globlastp |
| LAB633_H424 | pigeonpea\|11v1\|SRR054580X126830_P1 | 1505 | 6502 | 492 | 96.4 | globlastp |
| LAB633_H425 | pigeonpea\|11v1\|SRR054580X181428_P1 | 1506 | 6502 | 492 | 96.4 | globlastp |
| LAB633_H426 | platanus\|11v1\|SRR096786X101770_P1 | 1507 | 6500 | 492 | 96.4 | globlastp |
| LAB633_H427 | platanus\|11v1\|SRR096786X10393_P1 | 1508 | 6500 | 492 | 96.4 | globlastp |
| LAB633_H428 | platanus\|11v1\|SRR096786X107761_P1 | 1509 | 6500 | 492 | 96.4 | globlastp |
| LAB633_H429 | platanus\|11v1\|SRR096786X134140_P1 | 1510 | 6500 | 492 | 96.4 | globlastp |
| LAB633_H430 | poplar\|10v1\|AI165129 | 1511 | 6537 | 492 | 96.4 | globlastp |
| LAB633_H430 | poplar\|13v1\|AI165129_P1 | 1512 | 6511 | 492 | 96.4 | globlastp |
| LAB633_H431 | poplar\|10v1\|BI128908 | 1513 | 6538 | 492 | 96.4 | globlastp |
| LAB633_H431 | poplar\|13v1\|BI128908_P1 | 1514 | 6538 | 492 | 96.4 | globlastp |
| LAB633_H432 | poplar\|10v1\|BU890153 | 1515 | 6511 | 492 | 96.4 | globlastp |
| LAB633_H432 | poplar\|13v1\|BU890153_P1 | 1516 | 6511 | 492 | 96.4 | globlastp |
| LAB633_H433 | primula\|11v1\|SRR098679X100866_P1 | 1517 | 6539 | 492 | 96.4 | globlastp |
| LAB633_H434 | primula\|11v1\|SRR098679X100939_P1 | 1518 | 6539 | 492 | 96.4 | globlastp |
| LAB633_H435 | pseudotsuga\|10v1\|SRR065119S0015889 | 1519 | 6507 | 492 | 96.4 | globlastp |
| LAB633_H436 | radish\|gb164\|EV545689 | 1520 | 6499 | 492 | 96.4 | globlastp |
| LAB633_H437 | radish\|gb164\|EW722850 | 1521 | 6499 | 492 | 96.4 | globlastp |
| LAB633_H438 | radish\|gb164\|EX754211 | 1522 | 6499 | 492 | 96.4 | globlastp |
| LAB633_H439 | rose\|12v1\|BQ105597 | 1523 | 6540 | 492 | 96.4 | globlastp |
| LAB633_H440 | rose\|12v1\|BQ105643 | 1524 | 6540 | 492 | 96.4 | globlastp |
| LAB633_H441 | salvia\|10v1\|CV165375 | 1525 | 6541 | 492 | 96.4 | globlastp |
| LAB633_H442 | soybean\|11v1\|GLYMA11G07980 | 1526 | 6542 | 492 | 96.4 | globlastp |
| LAB633_H442 | soybean\|12v1\|GLYMA11G07980_P1 | 1527 | 6542 | 492 | 96.4 | globlastp |
| LAB633_H443 | soybean\|11v1\|GLYMA13G03470 | 1528 | 6502 | 492 | 96.4 | globlastp |
| LAB633_H443 | soybean\|12v1\|GLYMA13G03470_P1 | 1529 | 6502 | 492 | 96.4 | globlastp |
| LAB633_H444 | soybean\|11v1\|GLYMA14G23990 | 1530 | 6502 | 492 | 96.4 | globlastp |
| LAB633_H444 | soybean\|12v1\|GLYMA14G23990_P1 | 1531 | 6502 | 492 | 96.4 | globlastp |
| LAB633_H445 | strawberry\|11v1\|CO379399 | 1532 | 6543 | 492 | 96.4 | globlastp |
| LAB633_H446 | switchgrass\|12v1\|DN143026_P1 | 1533 | 6544 | 492 | 96.4 | globlastp |
| LAB633_H446 | switchgrass\|gb167\|DN143026 | 1534 | 6544 | 492 | 96.4 | globlastp |
| LAB633_H447 | switchgrass\|12v1\|FE620863_P1 | 1535 | 6544 | 492 | 96.4 | globlastp |
| LAB633_H447 | switchgrass\|gb167\|FE620863 | 1536 | 6544 | 492 | 96.4 | globlastp |
| LAB633_H448 | taxus\|10v1\|SRR032523S0004485 | 1537 | 6545 | 492 | 96.4 | globlastp |
| LAB633_H449 | thellungiella_halophilum\|11v1\|DN775718 | 1538 | 6499 | 492 | 96.4 | globlastp |
| LAB633_H450 | thellungiella_parvulum\|11v1\|DN775718 | 1539 | 6499 | 492 | 96.4 | globlastp |
| LAB633_H451 | thellungiella_parvulum\|11v1\|EPCRP019347 | 1540 | 6499 | 492 | 96.4 | globlastp |
| LAB633_H452 | tobacco\|gb162\|CV017315 | 1541 | 6503 | 492 | 96.4 | globlastp |
| LAB633_H453 | tobacco\|gb162\|CV017984 | 1542 | 6503 | 492 | 96.4 | globlastp |
| LAB633_H454 | tripterygium\|11v1\|SRR098677X104562 | 1543 | 6511 | 492 | 96.4 | globlastp |
| LAB633_H455 | tripterygium\|11v1\|SRR098677X106014 | 1544 | 6511 | 492 | 96.4 | globlastp |
| LAB633_H456 | tripterygium\|11v1\|SRR098677X111976 | 1545 | 6546 | 492 | 96.4 | globlastp |
| LAB633_H457 | vinca\|11v1\|SRR098690X113379 | 1546 | 6547 | 492 | 96.4 | globlastp |
| LAB633_H458 | walnuts\|gb166\|CV196723 | 1547 | 6548 | 492 | 96.4 | globlastp |
| LAB633_H459 | zostera\|10v1\|AM408842 | 1548 | 6506 | 492 | 96.4 | globlastp |
| LAB633_H784 | nicotiana_benthamiana\|12v1\|CN746824_P1 | 1549 | 6503 | 492 | 96.4 | globlastp |
| LAB633_H460 | fraxinus\|11v1\|SRR058827.104233_T1 | 1550 | 6549 | 492 | 96.36 | glotblastn |
| LAB633_H461 | phyla\|11v2\|SRR099037X138679_T1 | 1551 | 6550 | 492 | 96.36 | glotblastn |
| LAB633_H462 | pteridium\|11v1\|SRR043594X154147 | 1552 | 6551 | 492 | 96.36 | glotblastn |
| LAB633_H463 | salvia\|10v1\|FE537043 | 1553 | 6552 | 492 | 96.36 | glotblastn |
| LAB633_H887 | b_juncea\|12v1\|E6ANDIZ01A65VJ_P1 | 1554 | 6553 | 492 | 95.8 | globlastp |
| LAB633_H888 | b_juncea\|12v1\|E6ANDIZ01A7IMJ_P1 | 1555 | 6553 | 492 | 95.8 | globlastp |
| LAB633_H889 | b_juncea\|12v1\|E6ANDIZ01AHU2K_P1 | 1556 | 6553 | 492 | 95.8 | globlastp |
| LAB633_H890 | b_juncea\|12v1\|E6ANDIZ01AJO5K_P1 | 1557 | 6553 | 492 | 95.8 | globlastp |
| LAB633_H891 | b_juncea\|12v1\|E6ANDIZ01AT505_P1 | 1558 | 6553 | 492 | 95.8 | globlastp |
| LAB633_H892 | b_juncea\|12v1\|E6ANDIZ01AXHQE_P1 | 1559 | 6554 | 492 | 95.8 | globlastp |
| LAB633_H893 | b_juncea\|12v1\|E6ANDIZ01B2WAD_P1 | 1560 | 6553 | 492 | 95.8 | globlastp |
| LAB633_H894 | b_juncea\|12v1\|E6ANDIZ01B8XA6_P1 | 1561 | 6553 | 492 | 95.8 | globlastp |
| LAB633_H895 | b_juncea\|12v1\|E6ANDIZ01BBC2M_P1 | 1562 | 6553 | 492 | 95.8 | globlastp |
| LAB633_H896 | b_juncea\|12v1\|E6ANDIZ01BBYKN_P1 | 1563 | 6553 | 492 | 95.8 | globlastp |
| LAB633_H897 | b_juncea\|12v1\|E6ANDIZ01BJXUW2_P1 | 1564 | 6553 | 492 | 95.8 | globlastp |
| LAB633_H898 | b_juncea\|12v1\|E6ANDIZ01CB13K_P1 | 1565 | 6553 | 492 | 95.8 | globlastp |
| LAB633_H899 | banana\|12v1\|ES434916_P1 | 1566 | 6553 | 492 | 95.8 | globlastp |
| LAB633_H900 | banana\|12v1\|FL666640_P1 | 1567 | 6553 | 492 | 95.8 | globlastp |
| LAB633_H901 | banana\|12v1\|MAGEN2012005299_P1 | 1568 | 6553 | 492 | 95.8 | globlastp |
| LAB633_H902 | banana\|12v1\|MAGEN2012013147_P1 | 1569 | 6553 | 492 | 95.8 | globlastp |
| LAB633_H903 | bean\|12v2\|SRR001334.123194_P1 | 1570 | 6555 | 492 | 95.8 | globlastp |
| LAB633_H904 | lettuce\|12v1\|DW045455_P1 | 1571 | 6556 | 492 | 95.8 | globlastp |
| LAB633_H905 | onion\|12v1\|CF434881_P1 | 1572 | 6557 | 492 | 95.8 | globlastp |
| LAB633_H906 | onion\|12v1\|CF435456_P1 | 1573 | 6557 | 492 | 95.8 | globlastp |
| LAB633_H907 | onion\|12v1\|SRR073446X106316D1_P1 | 1574 | 6557 | 492 | 95.8 | globlastp |
| LAB633_H908 | pepper\|12v1\|C0906858_P1 | 1575 | 6558 | 492 | 95.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H909 | prunus_mume\|13v1\|BF717208_P1 | 1576 | 6559 | 492 | 95.8 | globlastp |
| LAB633_H910 | prunus_mume\|13v1\|BU043346_P1 | 1577 | 6560 | 492 | 95.8 | globlastp |
| LAB633_H911 | prunus_mume\|13v1\|BU572557_P1 | 1578 | 6560 | 492 | 95.8 | globlastp |
| LAB633_H912 | prunus_mume\|13v1\|CA853985_P1 | 1579 | 6559 | 492 | 95.8 | globlastp |
| LAB633_H913 | soybean\|12v1\|BE020400_P1 | 1580 | 6555 | 492 | 95.8 | globlastp |
| LAB633_H914 | zostera\|12v1\|SRR057351X100909D1_P1 | 1581 | 6561 | 492 | 95.8 | globlastp |
| LAB633_H464 | acacia\|10v1\|FS589942_P1 | 1582 | 6562 | 492 | 95.8 | globlastp |
| LAB633_H465 | ambrosia\|11v1\|SRR346935.113388_P1 | 1583 | 6563 | 492 | 95.8 | globlastp |
| LAB633_H466 | ambrosia\|11v1\|SRR346935.204909_P1 | 1584 | 6563 | 492 | 95.8 | globlastp |
| LAB633_H467 | ambrosia\|11v1\|SRR346943.108120_P1 | 1585 | 6564 | 492 | 95.8 | globlastp |
| LAB633_H468 | apple\|11v1\|CK900604_P1 | 1586 | 6559 | 492 | 95.8 | globlastp |
| LAB633_H469 | apple\|11v1\|CN489095_P1 | 1587 | 6560 | 492 | 95.8 | globlastp |
| LAB633_H470 | apple\|11v1\|CN492567_P1 | 1588 | 6560 | 492 | 95.8 | globlastp |
| LAB633_H471 | apple\|11v1\|CN901400_P1 | 1589 | 6560 | 492 | 95.8 | globlastp |
| LAB633_H472 | arabidopsis_lyrata\|09v1\|JGIAL012090_P1 | 1590 | 6553 | 492 | 95.8 | globlastp |
| LAB633_H473 | arabidopsis_lyrata\|09v1\|JGIAL023973_P1 | 1591 | 6553 | 492 | 95.8 | globlastp |
| LAB633_H474 | arabidopsis_lyrata\|09v1\|JGIAL024512_P1 | 1592 | 6553 | 492 | 95.8 | globlastp |
| LAB633_H475 | arabidopsis\|10v1\|AT1G75630_P1 | 1593 | 6565 | 492 | 95.8 | globlastp |
| LAB633_H476 | arabidopsis\|10v1\|AT2G16510_P1 | 1594 | 6553 | 492 | 95.8 | globlastp |
| LAB633_H477 | arabidopsis\|10v1\|AT4G34720_P1 | 1595 | 6553 | 492 | 95.8 | globlastp |
| LAB633_H478 | arabidopsis\|10v1\|AT4G38920_P1 | 1596 | 6553 | 492 | 95.8 | globlastp |
| LAB633_H479 | arnica\|11v1\|SRR099034X10144_P1 | 1597 | 6566 | 492 | 95.8 | globlastp |
| LAB633_H480 | arnica\|11v1\|SRR099034X107784_P1 | 1598 | 6563 | 492 | 95.8 | globlastp |
| LAB633_H481 | arnica\|11v1\|SRR099034X121503_P1 | 1599 | 6563 | 492 | 95.8 | globlastp |
| LAB633_H482 | avocado\|10v1\|CK748427_P1 | 1600 | 6567 | 492 | 95.8 | globlastp |
| LAB633_H483 | avocado\|10v1\|CK768014_P1 | 1601 | 6568 | 492 | 95.8 | globlastp |
| LAB633_H484 | b_juncea\|10v2\|E6ANDIZ01A65VJ | 1602 | 6553 | 492 | 95.8 | globlastp |
| LAB633_H485 | b_juncea\|10v2\|E6ANDIZ01A7IMJ | 1603 | 6553 | 492 | 95.8 | globlastp |
| LAB633_H486 | b_juncea\|10v2\|E6ANDIZ01AHU2K | 1604 | 6553 | 492 | 95.8 | globlastp |
| LAB633_H487 | b_juncea\|10v2\|E6ANDIZ01AJYKA | 1605 | 6553 | 492 | 95.8 | globlastp |
| LAB633_H488 | b_juncea\|10v2\|E6ANDIZ01AL5YG | 1606 | 6553 | 492 | 95.8 | globlastp |
| LAB633_H489 | b_juncea\|10v2\|E6ANDIZ01B8XA6 | 1607 | 6553 | 492 | 95.8 | globlastp |
| LAB633_H490 | b_juncea\|10v2\|E6ANDIZ01BBC2M | 1608 | 6553 | 492 | 95.8 | globlastp |
| LAB633_H491 | b_juncea\|10v2\|E6ANDIZ01D9LBK | 1609 | 6553 | 492 | 95.8 | globlastp |
| LAB633_H492 | b_oleracea\|gb161\|AM059534_P1 | 1610 | 6553 | 492 | 95.8 | globlastp |
| LAB633_H493 | b_oleracea\|gb161\|DY027262_P1 | 1611 | 6553 | 492 | 95.8 | globlastp |
| LAB633_H494 | b_oleracea\|gb161\|DY029496_P1 | 1612 | 6553 | 492 | 95.8 | globlastp |
| LAB633_H495 | b_rapa\|11v1\|AT000515_P1 | 1613 | 6553 | 492 | 95.8 | globlastp |
| LAB633_H496 | b_rapa\|11v1\|BG544216_P1 | 1614 | 6553 | 492 | 95.8 | globlastp |
| LAB633_H497 | b_rapa\|11v1\|BQ791842_P1 | 1615 | 6553 | 492 | 95.8 | globlastp |
| LAB633_H498 | b_rapa\|11v1\|CD812344_P1 | 1616 | 6569 | 492 | 95.8 | globlastp |
| LAB633_H499 | b_rapa\|11v1\|CD823270_P1 | 1617 | 6553 | 492 | 95.8 | globlastp |
| LAB633_H500 | b_rapa\|11v1\|H74958_P1 | 1618 | 6553 | 492 | 95.8 | globlastp |
| LAB633_H501 | banana\|10v1\|ES431631 | 1619 | 6553 | 492 | 95.8 | globlastp |
| LAB633_H502 | banana\|10v1\|FL666640 | 1620 | 6553 | 492 | 95.8 | globlastp |
| LAB633_H504 | canola\|11v1\|CN726029_P1 | 1621 | 6553 | 492 | 95.8 | globlastp |
| LAB633_H505 | canola\|11v1\|CN733181_P1 | 1622 | 6553 | 492 | 95.8 | globlastp |
| LAB633_H506 | canola\|11v1\|CN735102_P1 | 1623 | 6553 | 492 | 95.8 | globlastp |
| LAB633_H507 | canola\|11v1\|CN826256_P1 | 1624 | 6553 | 492 | 95.8 | globlastp |
| LAB633_H508 | canola\|11v1\|CN829751_P1 | 1625 | 6553 | 492 | 95.8 | globlastp |
| LAB633_H509 | canola\|11v1\|DQ068175_P1 | 1626 | 6553 | 492 | 95.8 | globlastp |
| LAB633_H510 | canola\|11v1\|EE454783_P1 | 1627 | 6553 | 492 | 95.8 | globlastp |
| LAB633_H511 | canola\|11v1\|EE456100_P1 | 1628 | 6553 | 492 | 95.8 | globlastp |
| LAB633_H512 | canola\|11v1\|EE476229_P1 | 1629 | 6553 | 492 | 95.8 | globlastp |
| LAB633_H513 | canola\|11v1\|EE483618_P1 | 1630 | 6553 | 492 | 95.8 | globlastp |
| LAB633_H514 | canola\|11v1\|EE545969_P1 | 1631 | 6553 | 492 | 95.8 | globlastp |
| LAB633_H515 | canola\|11v1\|EV024287_P1 | 1632 | 6553 | 492 | 95.8 | globlastp |
| LAB633_H516 | canola\|11v1\|GR443245_P1 | 1633 | 6553 | 492 | 95.8 | globlastp |
| LAB633_H517 | catharanthus\|11v1\|EG554231_P1 | 1634 | 6570 | 492 | 95.8 | globlastp |
| LAB633_H518 | centaurea\|gb166\|EH746240_P1 | 1635 | 6571 | 492 | 95.8 | globlastp |
| LAB633_H519 | centaurea\|gb166\|EH781668_P1 | 1636 | 6571 | 492 | 95.8 | globlastp |
| LAB633_H520 | centaurea\|gb166\|EL933730_P1 | 1637 | 6571 | 492 | 95.8 | globlastp |
| LAB633_H521 | cephalotaxus\|11v1\|SRR064395X104314_P1 | 1638 | 6572 | 492 | 95.8 | globlastp |
| LAB633_H522 | chickpea\|11v1\|FE669019 | 1639 | 6562 | 492 | 95.8 | globlastp |
| LAB633_H522 | chickpea\|13v2\|FE669019_P1 | 1640 | 6562 | 492 | 95.8 | globlastp |
| LAB633_H523 | cichorium\|gb171\|EH708074_P1 | 1641 | 6573 | 492 | 95.8 | globlastp |
| LAB633_H524 | cirsium\|11v1\|SRR346952.1004285_P1 | 1642 | 6571 | 492 | 95.8 | globlastp |
| LAB633_H525 | cirsium\|11v1\|SRR346952.1075157_P1 | 1643 | 6571 | 492 | 95.8 | globlastp |
| LAB633_H526 | cirsium\|11v1\|SRR346952.1138663_P1 | 1644 | 6566 | 492 | 95.8 | globlastp |
| LAB633_H527 | cirsium\|11v1\|SRR346952.117634_P1 | 1645 | 6571 | 492 | 95.8 | globlastp |
| LAB633_H528 | cowpea\|12v1\|AF022925_P1 | 1646 | 6574 | 492 | 95.8 | globlastp |
| LAB633_H528 | cowpea\|gb166\|AF022925 | 1647 | 6574 | 492 | 95.8 | globlastp |
| LAB633_H529 | cowpea\|12v1\|FG833662_P1 | 1648 | 6555 | 492 | 95.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H529 | cowpea\|gb166\|FG833662 | 1649 | 6555 | 492 | 95.8 | globlastp |
| LAB633_H530 | cyamopsis\|10v1\|EG986846_P1 | 1650 | 6575 | 492 | 95.8 | globlastp |
| LAB633_H531 | cyamopsis\|10v1\|EG986904_P1 | 1651 | 6575 | 492 | 95.8 | globlastp |
| LAB633_H532 | cynara\|gb167\|GE587704_P1 | 1652 | 6571 | 492 | 95.8 | globlastp |
| LAB633_H533 | dandelion\|10v1\|DR402372_P1 | 1653 | 6556 | 492 | 95.8 | globlastp |
| LAB633_H534 | eggplant\|10v1\|FS004904_P1 | 1654 | 6576 | 492 | 95.8 | globlastp |
| LAB633_H535 | euphorbia\|11v1\|BP953990_P1 | 1655 | 6577 | 492 | 95.8 | globlastp |
| LAB633_H536 | euphorbia\|11v1\|BP956377_P1 | 1656 | 6578 | 492 | 95.8 | globlastp |
| LAB633_H537 | euphorbia\|11v1\|DV140898_P1 | 1657 | 6579 | 492 | 95.8 | globlastp |
| LAB633_H538 | flaveria\|11v1\|SRR149229.100682_P1 | 1658 | 6563 | 492 | 95.8 | globlastp |
| LAB633_H539 | flaveria\|11v1\|SRR149229.101144_P1 | 1659 | 6563 | 492 | 95.8 | globlastp |
| LAB633_H540 | flaveria\|11v1\|SRR149229.138381_P1 | 1660 | 6563 | 492 | 95.8 | globlastp |
| LAB633_H541 | flaveria\|11v1\|SRR149229.15135_P1 | 1661 | 6563 | 492 | 95.8 | globlastp |
| LAB633_H542 | flaveria\|11v1\|SRR149232.100048_P1 | 1662 | 6563 | 492 | 95.8 | globlastp |
| LAB633_H543 | flaveria\|11v1\|SRR149238.344732_P1 | 1663 | 6563 | 492 | 95.8 | globlastp |
| LAB633_H544 | grape\|11v1\|GSVIVT01008857001_P1 | 1664 | 6553 | 492 | 95.8 | globlastp |
| LAB633_H545 | grape\|11v1\|GSVIVT01024165001_P1 | 1665 | 6553 | 492 | 95.8 | globlastp |
| LAB633_H546 | guizotia\|10v1\|GE553934XX1_P1 | 1666 | 6563 | 492 | 95.8 | globlastp |
| LAB633_H547 | guizotia\|10v1\|GE555882_P1 | 1667 | 6580 | 492 | 95.8 | globlastp |
| LAB633_H548 | hevea\|10v1\|EC600598_P1 | 1668 | 6581 | 492 | 95.8 | globlastp |
| LAB633_H549 | ipomoea_batatas\|10v1\|EE875038_P1 | 1669 | 6582 | 492 | 95.8 | globlastp |
| LAB633_H550 | ipomoea_nil\|10v1\|BJ553845_P1 | 1670 | 6583 | 492 | 95.8 | globlastp |
| LAB633_H551 | jatropha\|09v1\|GH295876_P1 | 1671 | 6584 | 492 | 95.8 | globlastp |
| LAB633_H552 | lettuce\|10v1\|DW045455 | 1672 | 6556 | 492 | 95.8 | globlastp |
| LAB633_H553 | liquorice\|gb171\|FS239750_P1 | 1673 | 6562 | 492 | 95.8 | globlastp |
| LAB633_H554 | lotus\|09v1\|AI967344_P1 | 1674 | 6562 | 492 | 95.8 | globlastp |
| LAB633_H555 | lotus\|09v1\|LLAW719316_P1 | 1675 | 6562 | 492 | 95.8 | globlastp |
| LAB633_H556 | lotus\|09v1\|LLBI417561_P1 | 1676 | 6562 | 492 | 95.8 | globlastp |
| LAB633_H557 | nasturtium\|11v1\|GH163683_P1 | 1677 | 6562 | 492 | 95.8 | globlastp |
| LAB633_H558 | nasturtium\|11v1\|GH170991_P1 | 1678 | 6585 | 492 | 95.8 | globlastp |
| LAB633_H559 | nasturtium\|11v1\|SRR032558.101099_P1 | 1679 | 6562 | 492 | 95.8 | globlastp |
| LAB633_H560 | nicotiana_benthamiana\|12v1\|CN741678_P1 | 1680 | 6576 | 492 | 95.8 | globlastp |
| LAB633_H560 | nicotiana_benthamiana\|gb162\|CN741678 | 1681 | 6576 | 492 | 95.8 | globlastp |
| LAB633_H561 | oak\|10v1\|CU657672_P1 | 1682 | 6586 | 492 | 95.8 | globlastp |
| LAB633_H562 | oil_palm\|11v1\|EL688767_P1 | 1683 | 6587 | 492 | 95.8 | globlastp |
| LAB633_H563 | parthenium\|10v1\|GW777804_P1 | 1684 | 6580 | 492 | 95.8 | globlastp |
| LAB633_H564 | peanut\|10v1\|CD037907_P1 | 1685 | 6562 | 492 | 95.8 | globlastp |
| LAB633_H565 | peanut\|10v1\|EE123399_P1 | 1686 | 6562 | 492 | 95.8 | globlastp |
| LAB633_H567 | petunia\|gb171\|CV295702_P1 | 1687 | 6588 | 492 | 95.8 | globlastp |
| LAB633_H568 | phalaenopsis\|11v1\|CB033183_P1 | 1688 | 6557 | 492 | 95.8 | globlastp |
| LAB633_H569 | phalaenopsis\|11v1\|CB034659_P1 | 1689 | 6557 | 492 | 95.8 | globlastp |
| LAB633_H570 | phalaenopsis\|11v1\|SRR125771.101114_P1 | 1690 | 6557 | 492 | 95.8 | globlastp |
| LAB633_H571 | phalaenopsis\|11v1\|SRR125771.1033780_P1 | 1691 | 6589 | 492 | 95.8 | globlastp |
| LAB633_H572 | pigeonpea\|11v1\|GR472597_P1 | 1692 | 6555 | 492 | 95.8 | globlastp |
| LAB633_H573 | pigeonpea\|11v1\|SRR054580X100195_P1 | 1693 | 6555 | 492 | 95.8 | globlastp |
| LAB633_H574 | pigeonpea\|11v1\|SRR054580X105049_P1 | 1694 | 6575 | 492 | 95.8 | globlastp |
| LAB633_H575 | poplar\|10v1\|AI161891 | 1695 | 6553 | 492 | 95.8 | globlastp |
| LAB633_H575 | poplar\|13v1\|AI161453_P1 | 1696 | 6553 | 492 | 95.8 | globlastp |
| LAB633_H576 | poplar\|10v1\|AI162669 | 1697 | 6553 | 492 | 95.8 | globlastp |
| LAB633_H576 | poplar\|13v1\|AI162669_P1 | 1698 | 6553 | 492 | 95.8 | globlastp |
| LAB633_H577 | potato\|10v1\|AJ487387_P1 | 1699 | 6576 | 492 | 95.8 | globlastp |
| LAB633_H578 | primula\|11v1\|SRR098679X105958_P1 | 1700 | 6553 | 492 | 95.8 | globlastp |
| LAB633_H579 | prunus\|10v1\|BF717208 | 1701 | 6559 | 492 | 95.8 | globlastp |
| LAB633_H580 | prunus\|10v1\|BU043346 | 1702 | 6560 | 492 | 95.8 | globlastp |
| LAB633_H581 | prunus\|10v1\|BU572557 | 1703 | 6560 | 492 | 95.8 | globlastp |
| LAB633_H582 | prunus\|10v1\|CA853985 | 1704 | 6559 | 492 | 95.8 | globlastp |
| LAB633_H583 | radish\|gb164\|EV526213 | 1705 | 6553 | 492 | 95.8 | globlastp |
| LAB633_H584 | radish\|gb164\|EV527059 | 1706 | 6553 | 492 | 95.8 | globlastp |
| LAB633_H585 | radish\|gb164\|EV527473 | 1707 | 6553 | 492 | 95.8 | globlastp |
| LAB633_H586 | radish\|gb164\|EV535171 | 1708 | 6553 | 492 | 95.8 | globlastp |
| LAB633_H587 | radish\|gb164\|EV536495 | 1709 | 6553 | 492 | 95.8 | globlastp |
| LAB633_H588 | radish\|gb164\|EW722892 | 1710 | 6553 | 492 | 95.8 | globlastp |
| LAB633_H589 | radish\|gb164\|EW723024 | 1711 | 6553 | 492 | 95.8 | globlastp |
| LAB633_H590 | radish\|gb164\|EX746799 | 1712 | 6553 | 492 | 95.8 | globlastp |
| LAB633_H591 | radish\|gb164\|EX772034 | 1713 | 6553 | 492 | 95.8 | globlastp |
| LAB633_H592 | radish\|gb164\|EX777106 | 1714 | 6553 | 492 | 95.8 | globlastp |
| LAB633_H593 | radish\|gb164\|EX886866 | 1715 | 6553 | 492 | 95.8 | globlastp |
| LAB633_H594 | radish\|gb164\|EX896158 | 1716 | 6553 | 492 | 95.8 | globlastp |
| LAB633_H595 | radish\|gb164\|EX897706 | 1717 | 6553 | 492 | 95.8 | globlastp |
| LAB633_H596 | radish\|gb164\|FD966674 | 1718 | 6553 | 492 | 95.8 | globlastp |
| LAB633_H597 | rhizophora\|10v1\|SRR005793S0031467 | 1719 | 6590 | 492 | 95.8 | globlastp |
| LAB633_H598 | silene\|11v1\|GH292760 | 1720 | 6591 | 492 | 95.8 | globlastp |
| LAB633_H599 | solanum_phureja\|09v1\|SPHBG123887 | 1721 | 6576 | 492 | 95.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H600 | solanum_phureja\|09v1\|SPHBG124463 | 1722 | 6576 | 492 | 95.8 | globlastp |
| LAB633_H601 | soybean\|11v1\|GLYMA01G37320 | 1723 | 6592 | 492 | 95.8 | globlastp |
| LAB633_H601 | soybean\|12v1\|GLYMA01G37320_P1 | 1724 | 6592 | 492 | 95.8 | globlastp |
| LAB633_H602 | soybean\|11v1\|GLYMA02G05630 | 1725 | 6555 | 492 | 95.8 | globlastp |
| LAB633_H602 | soybean\|12v1\|GLYMA02G05630_P1 | 1726 | 6555 | 492 | 95.8 | globlastp |
| LAB633_H603 | soybean\|11v1\|GLYMA04G00950 | 1727 | 6555 | 492 | 95.8 | globlastp |
| LAB633_H603 | soybean\|12v1\|GLYMA04G00950_P1 | 1728 | 6555 | 492 | 95.8 | globlastp |
| LAB633_H604 | soybean\|11v1\|GLYMA06G00980 | 1729 | 6555 | 492 | 95.8 | globlastp |
| LAB633_H604 | soybean\|12v1\|GLYMA06G00980_P1 | 1730 | 6555 | 492 | 95.8 | globlastp |
| LAB633_H605 | soybean\|11v1\|GLYMA11G11760 | 1731 | 6575 | 492 | 95.8 | globlastp |
| LAB633_H605 | soybean\|12v1\|GLYMA11G11760_P1 | 1732 | 6575 | 492 | 95.8 | globlastp |
| LAB633_H606 | soybean\|11v1\|GLYMA12G04090 | 1733 | 6575 | 492 | 95.8 | globlastp |
| LAB633_H606 | soybean\|12v1\|GLYMA12G04090T2_P1 | 1734 | 6575 | 492 | 95.8 | globlastp |
| LAB633_H607 | soybean\|11v1\|GLYMA16G24220 | 1735 | 6555 | 492 | 95.8 | globlastp |
| LAB633_H607 | soybean\|12v1\|GLYMA16G24220_P1 | 1736 | 6555 | 492 | 95.8 | globlastp |
| LAB633_H608 | spruce\|11v1\|ES252681 | 1737 | 6593 | 492 | 95.8 | globlastp |
| LAB633_H609 | spurge\|gb161\|DV140898 | 1738 | 6579 | 492 | 95.8 | globlastp |
| LAB633_H610 | strawberry\|11v1\|AI795150 | 1739 | 6594 | 492 | 95.8 | globlastp |
| LAB633_H611 | strawberry\|11v1\|CO380387 | 1740 | 6594 | 492 | 95.8 | globlastp |
| LAB633_H612 | sunflower\|12v1\|CD848168 | 1741 | 6563 | 492 | 95.8 | globlastp |
| LAB633_H613 | sunflower\|12v1\|DY915982 | 1742 | 6563 | 492 | 95.8 | globlastp |
| LAB633_H614 | tea\|10v1\|GE650613 | 1743 | 6595 | 492 | 95.8 | globlastp |
| LAB633_H615 | thalictrum\|11v1\|SRR096787X10562 | 1744 | 6596 | 492 | 95.8 | globlastp |
| LAB633_H616 | thellungiella_halophilum\|11v1\|BY804483 | 1745 | 6553 | 492 | 95.8 | globlastp |
| LAB633_H617 | thellungiella_halophilum\|11v1\|DN778897 | 1746 | 6553 | 492 | 95.8 | globlastp |
| LAB633_H618 | thellungiella_parvulum\|11v1\|EC599604 | 1747 | 6553 | 492 | 95.8 | globlastp |
| LAB633_H619 | tobacco\|gb162\|CV016246 | 1748 | 6597 | 492 | 95.8 | globlastp |
| LAB633_H620 | tobacco\|gb162\|EB678620 | 1749 | 6576 | 492 | 95.8 | globlastp |
| LAB633_H621 | tobacco\|gb162\|X95751 | 1750 | 6598 | 492 | 95.8 | globlastp |
| LAB633_H622 | tobacco\|gb162\|X95752 | 1751 | 6576 | 492 | 95.8 | globlastp |
| LAB633_H623 | tomato\|11v1\|BG123887 | 1752 | 6576 | 492 | 95.8 | globlastp |
| LAB633_H624 | tomato\|11v1\|BG124463 | 1753 | 6576 | 492 | 95.8 | globlastp |
| LAB633_H625 | tragopogon\|10v1\|SRR020205S0002204 | 1754 | 6556 | 492 | 95.8 | globlastp |
| LAB633_H626 | zostera\|10v1\|SRR057351S0003924 | 1755 | 6561 | 492 | 95.8 | globlastp |
| LAB633_H627 | ambrosia\|11v1\|SRR346935.153166_T1 | 1756 | 6599 | 492 | 95.76 | glotblastn |
| LAB633_H628 | gossypium_raimondii\|12v1\|GHU13670_T1 | 1757 | 6600 | 492 | 95.76 | glotblastn |
| LAB633_H629 | onion\|gb162\|CF435456 | 1758 | 6601 | 492 | 95.76 | glotblastn |
| LAB633_H630 | platanus\|11v1\|SRR096786X152052_T1 | 1759 | 6602 | 492 | 95.76 | glotblastn |
| LAB633_H915 | b_juncea\|12v1\|E6ANDIZ01A8FCE_P1 | 1760 | 6603 | 492 | 95.2 | globlastp |
| LAB633_H916 | b_juncea\|12v1\|E6ANDIZ01B8WYM_P1 | 1761 | 6604 | 492 | 95.2 | globlastp |
| LAB633_H917 | blueberry\|12v1\|SRR353282X19012D1_P1 | 1762 | 6605 | 492 | 95.2 | globlastp |
| LAB633_H918 | lettuce\|12v1\|DW051555_P1 | 1763 | 6606 | 492 | 95.2 | globlastp |
| LAB633_H919 | pepper\|12v1\|BM060269_P1 | 1764 | 6607 | 492 | 95.2 | globlastp |
| LAB633_H920 | pepper\|12v1\|BM060287_P1 | 1765 | 6607 | 492 | 95.2 | globlastp |
| LAB633_H921 | pepper\|12v1\|BM062536_P1 | 1766 | 6608 | 492 | 95.2 | globlastp |
| LAB633_H922 | pepper\|12v1\|BM062580_P1 | 1767 | 6607 | 492 | 95.2 | globlastp |
| LAB633_H631 | acacia\|10v1\|FS585870_P1 | 1768 | 6609 | 492 | 95.2 | globlastp |
| LAB633_H632 | amborella\|12v3\|CK747014_P1 | 1769 | 6610 | 492 | 95.2 | globlastp |
| LAB633_H633 | apple\|11v1\|CN489524_P1 | 1770 | 6611 | 492 | 95.2 | globlastp |
| LAB633_H634 | aristolochia\|10v1\|SRR039082S0037087_P1 | 1771 | 6612 | 492 | 95.2 | globlastp |
| LAB633_H635 | arnica\|11v1\|SRR099034X113896_P1 | 1772 | 6613 | 492 | 95.2 | globlastp |
| LAB633_H636 | arnica\|11v1\|SRR099034X139968_P1 | 1773 | 6606 | 492 | 95.2 | globlastp |
| LAB633_H637 | b_rapa\|11v1\|CD817357_P1 | 1774 | 6614 | 492 | 95.2 | globlastp |
| LAB633_H638 | b_rapa\|11v1\|CD819176_P1 | 1775 | 6615 | 492 | 95.2 | globlastp |
| LAB633_H639 | canola\|11v1\|EV030960_P1 | 1776 | 6616 | 492 | 95.2 | globlastp |
| LAB633_H640 | canola\|11v1\|SRR329661.370494_P1 | 1777 | 6617 | 492 | 95.2 | globlastp |
| LAB633_H641 | castorbean\|12v1\|EE260752_P1 | 1778 | 6618 | 492 | 95.2 | globlastp |
| LAB633_H642 | cedrus\|11v1\|SRR065007X100260_P1 | 1779 | 6619 | 492 | 95.2 | globlastp |
| LAB633_H643 | centaurea\|gb166\|EH738599_P1 | 1780 | 6620 | 492 | 95.2 | globlastp |
| LAB633_H644 | cephalotaxus\|11v1\|SRR064395X104333_P1 | 1781 | 6621 | 492 | 95.2 | globlastp |
| LAB633_H645 | chickpea\|11v1\|FE670073 | 1782 | 6609 | 492 | 95.2 | globlastp |
| LAB633_H645 | chickpea\|13v2\|FE670073_P1 | 1783 | 6609 | 492 | 95.2 | globlastp |
| LAB633_H646 | chickpea\|11v1\|SRR133517.113981 | 1784 | 6609 | 492 | 95.2 | globlastp |
| LAB633_H646 | chickpea\|13v2\|GR912192_P1 | 1785 | 6609 | 492 | 95.2 | globlastp |
| LAB633_H647 | cirsium\|11v1\|SRR346952.1015153_P1 | 1786 | 6622 | 492 | 95.2 | globlastp |
| LAB633_H648 | cirsium\|11v1\|SRR346952.127159_P1 | 1787 | 6623 | 492 | 95.2 | globlastp |
| LAB633_H649 | clover\|gb162\|BB928874_P1 | 1788 | 6609 | 492 | 95.2 | globlastp |
| LAB633_H650 | cryptomeria\|gb166\|BP175787_P1 | 1789 | 6624 | 492 | 95.2 | globlastp |
| LAB633_H651 | cryptomeria\|gb166\|BY878554_P1 | 1790 | 6625 | 492 | 95.2 | globlastp |
| LAB633_H652 | curcuma\|10v1\|DY391579_P1 | 1791 | 6626 | 492 | 95.2 | globlastp |
| LAB633_H653 | cynara\|gb167\|GE587668_P1 | 1792 | 6622 | 492 | 95.2 | globlastp |
| LAB633_H654 | dandelion\|10v1\|DR403014_P1 | 1793 | 6627 | 492 | 95.2 | globlastp |
| LAB633_H655 | distylium\|11v1\|SRR065077X10448_P1 | 1794 | 6628 | 492 | 95.2 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H656 | eggplant\|10v1\|FS003157_P1 | 1795 | 6607 | 492 | 95.2 | globlastp |
| LAB633_H657 | eggplant\|10v1\|FS008042_P1 | 1796 | 6629 | 492 | 95.2 | globlastp |
| LAB633_H658 | eggplant\|10v1\|FS024666_P1 | 1797 | 6607 | 492 | 95.2 | globlastp |
| LAB633_H659 | euphorbia\|11v1\|SRR098678X130658_P1 | 1798 | 6630 | 492 | 95.2 | globlastp |
| LAB633_H660 | gerbera\|09v1\|AJ750022_P1 | 1799 | 6631 | 492 | 95.2 | globlastp |
| LAB633_H661 | gerbera\|09v1\|AJ750922_P1 | 1800 | 6632 | 492 | 95.2 | globlastp |
| LAB633_H662 | grape\|11v1\|GSVIVT01009832001_P1 | 1801 | 6633 | 492 | 95.2 | globlastp |
| LAB633_H663 | ipomoea_nil\|10v1\|BJ554296_P1 | 1802 | 6607 | 492 | 95.2 | globlastp |
| LAB633_H664 | ipomoea_nil\|10v1\|BJ554580_P1 | 1803 | 6607 | 492 | 95.2 | globlastp |
| LAB633_H665 | lettuce\|10v1\|DW051555 | 1804 | 6606 | 492 | 95.2 | globlastp |
| LAB633_H666 | liquorice\|gb171\|FS258203_P1 | 1805 | 6609 | 492 | 95.2 | globlastp |
| LAB633_H667 | lotus\|09v1\|AV426568_P1 | 1806 | 6609 | 492 | 95.2 | globlastp |
| LAB633_H668 | marchantia\|gb166\|BJ843111_P1 | 1807 | 6634 | 492 | 95.2 | globlastp |
| LAB633_H669 | marchantia\|gb166\|C95837_P1 | 1808 | 6634 | 492 | 95.2 | globlastp |
| LAB633_H670 | maritime_pine\|10v1\|BX255316_P1 | 1809 | 6635 | 492 | 95.2 | globlastp |
| LAB633_H671 | medicago\|12v1\|AW689836_P1 | 1810 | 6609 | 492 | 95.2 | globlastp |
| LAB633_H672 | medicago\|12v1\|BF636341_P1 | 1811 | 6609 | 492 | 95.2 | globlastp |
| LAB633_H673 | nasturtium\|11v1\|GH165984_P1 | 1812 | 6636 | 492 | 95.2 | globlastp |
| LAB633_H674 | nicotiana_benthamiana\|12v1\|X95752_P1 | 1813 | 6637 | 492 | 95.2 | globlastp |
| LAB633_H674 | nicotiana_benthamiana\|gb162\|CN743417 | 1814 | 6637 | 492 | 95.2 | globlastp |
| LAB633_H675 | oak\|10v1\|FP024881_P1 | 1815 | 6638 | 492 | 95.2 | globlastp |
| LAB633_H676 | oak\|10v1\|FP035224_P1 | 1816 | 6638 | 492 | 95.2 | globlastp |
| LAB633_H677 | parthenium\|10v1\|GW777451_P1 | 1817 | 6639 | 492 | 95.2 | globlastp |
| LAB633_H678 | peanut\|10v1\|CD038517_P1 | 1818 | 6609 | 492 | 95.2 | globlastp |
| LAB633_H679 | pepper\|gb171\|BM060269 | 1819 | 6607 | 492 | 95.2 | globlastp |
| LAB633_H680 | pepper\|gb171\|BM060287 | 1820 | 6607 | 492 | 95.2 | globlastp |
| LAB633_H681 | pepper\|gb171\|BM062536 | 1821 | 6608 | 492 | 95.2 | globlastp |
| LAB633_H682 | pepper\|gb171\|BM062580 | 1822 | 6607 | 492 | 95.2 | globlastp |
| LAB633_H683 | petunia\|gb171\|CV294015_P1 | 1823 | 6640 | 492 | 95.2 | globlastp |
| LAB633_H684 | petunia\|gb171\|CV294463_P1 | 1824 | 6607 | 492 | 95.2 | globlastp |
| LAB633_H685 | petunia\|gb171\|CV296321_P1 | 1825 | 6607 | 492 | 95.2 | globlastp |
| LAB633_H686 | petunia\|gb171\|CV296920_P1 | 1826 | 6607 | 492 | 95.2 | globlastp |
| LAB633_H687 | potato\|10v1\|BF153914_P1 | 1827 | 6629 | 492 | 95.2 | globlastp |
| LAB633_H688 | primula\|11v1\|SRR098679X126927_P1 | 1828 | 6641 | 492 | 95.2 | globlastp |
| LAB633_H689 | safflower\|gb162\|EL404742 | 1829 | 6642 | 492 | 95.2 | globlastp |
| LAB633_H690 | sciadopitys\|10v1\|SRR065035S0000720 | 1830 | 6643 | 492 | 95.2 | globlastp |
| LAB633_H691 | sciadopitys\|10v1\|SRR065035S0053046 | 1831 | 6644 | 492 | 95.2 | globlastp |
| LAB633_H692 | senecio\|gb170\|DY659496 | 1832 | 6622 | 492 | 95.2 | globlastp |
| LAB633_H693 | sequoia\|10v1\|SRR065044S0000919 | 1833 | 6645 | 492 | 95.2 | globlastp |
| LAB633_H694 | sequoia\|10v1\|SRR065044S0010934 | 1834 | 6646 | 492 | 95.2 | globlastp |
| LAB633_H695 | silene\|11v1\|GH292064 | 1835 | 6647 | 492 | 95.2 | globlastp |
| LAB633_H696 | solanum_phureja\|09v1\|SPHAA824831 | 1836 | 6629 | 492 | 95.2 | globlastp |
| LAB633_H697 | solanum_phureja\|09v1\|SPHAF010228 | 1837 | 6629 | 492 | 95.2 | globlastp |
| LAB633_H698 | solanum_phureja\|09v1\|SPHBG124348 | 1838 | 6629 | 492 | 95.2 | globlastp |
| LAB633_H699 | sunflower\|12v1\|AJ828980 | 1839 | 6648 | 492 | 95.2 | globlastp |
| LAB633_H700 | sunflower\|12v1\|CD849428 | 1840 | 6639 | 492 | 95.2 | globlastp |
| LAB633_H701 | sunflower\|12v1\|CD857457 | 1841 | 6648 | 492 | 95.2 | globlastp |
| LAB633_H702 | sunflower\|12v1\|CF082790 | 1842 | 6639 | 492 | 95.2 | globlastp |
| LAB633_H703 | sunflower\|12v1\|DY907561 | 1843 | 6648 | 492 | 95.2 | globlastp |
| LAB633_H704 | tobacco\|gb162\|EB426153 | 1844 | 6649 | 492 | 95.2 | globlastp |
| LAB633_H705 | tomato\|11v1\|AA824831 | 1845 | 6629 | 492 | 95.2 | globlastp |
| LAB633_H706 | tomato\|11v1\|X95751 | 1846 | 6629 | 492 | 95.2 | globlastp |
| LAB633_H707 | tragopogon\|10v1\|SRR020205S0001460 | 1847 | 6639 | 492 | 95.2 | globlastp |
| LAB633_H708 | trigonella\|11v1\|SRR066194X103686 | 1848 | 6650 | 492 | 95.2 | globlastp |
| LAB633_H709 | trigonella\|11v1\|SRR066194X105520 | 1849 | 6609 | 492 | 95.2 | globlastp |
| LAB633_H710 | trigonella\|11v1\|SRR066194X118875 | 1850 | 6609 | 492 | 95.2 | globlastp |
| LAB633_H711 | vinca\|11v1\|SRR098690X106063 | 1851 | 6651 | 492 | 95.2 | globlastp |
| LAB633_H712 | vinca\|11v1\|SRR098690X134544 | 1852 | 6651 | 492 | 95.2 | globlastp |
| LAB633_H923 | zostera\|12v1\|SRR287819X116135D1_T1 | 1853 | 6652 | 492 | 95.15 | glotblastn |
| LAB633_H713 | cirsium\|11v1\|SRR346952.1012989_T1 | 1854 | 6653 | 492 | 95.15 | glotblastn |
| LAB633_H714 | gossypium_raimondii\|12v1\|SRR032881.152023_T1 | 1855 | 6654 | 492 | 95.15 | glotblastn |
| LAB633_H715 | nasturtium\|11v1\|SRR032558.351072_T1 | 1856 | 6655 | 492 | 95.15 | glotblastn |
| LAB633_H716 | phalaenopsis\|11v1\|CB033601_T1 | 1857 | 6656 | 492 | 95.15 | glotblastn |
| LAB633_H717 | phyla\|11v2\|SRR099035X141876_T1 | 1858 | 6657 | 492 | 95.15 | glotblastn |
| LAB633_H718 | primula\|11v1\|SRR098679X122176_T1 | 1859 | 6658 | 492 | 95.15 | glotblastn |
| LAB633_H719 | thalictrum\|11v1\|SRR096787X11182 | 1860 | 6659 | 492 | 95.15 | glotblastn |
| LAB633_H720 | chestnut\|gb170\|SRR006295S0000372_P1 | 1861 | 6660 | 492 | 94.6 | globlastp |
| LAB633_H721 | cirsium\|11v1\|SRR346952.130427_P1 | 1862 | 6661 | 492 | 94.6 | globlastp |
| LAB633_H722 | euphorbia\|11v1\|SRR098678X105764_P1 | 1863 | 6662 | 492 | 94.6 | globlastp |
| LAB633_H723 | gerbera\|09v1\|AJ752133_P1 | 1864 | 6663 | 492 | 94.6 | globlastp |
| LAB633_H724 | guizotia\|10v1\|GE553211_P1 | 1865 | 6664 | 492 | 94.6 | globlastp |
| LAB633_H725 | lovegrass\|gb167\|DN483212_P1 | 1866 | 6665 | 492 | 94.6 | globlastp |
| LAB633_H726 | marchantia\|gb166\|BJ852612_P1 | 1867 | 6666 | 492 | 94.6 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H727 | oak\|10v1\|CU656108_P1 | 1868 | 6660 | 492 | 94.6 | globlastp |
| LAB633_H728 | oak\|10v1\|DB997616_P1 | 1869 | 6667 | 492 | 94.6 | globlastp |
| LAB633_H729 | silene\|11v1\|SRR096785X102971 | 1870 | 6668 | 492 | 94.6 | globlastp |
| LAB633_H924 | banana\|12v1\|MUAC12v1PRD004325_T1 | 1871 | 6669 | 492 | 94.55 | glotblastn |
| LAB633_H730 | arabidopsis_lyrata\|09v1\|JGIAL007835_T1 | 1872 | 6670 | 492 | 94.55 | glotblastn |
| LAB633_H731 | fraxinus\|11v1\|SRR058827.101146_T1 | 1873 | 6671 | 492 | 94.55 | glotblastn |
| LAB633_H732 | antirrhinum\|gb166\|AJ806196_P1 | 1874 | 6672 | 492 | 94.5 | globlastp |
| LAB633_H733 | cirsium\|11v1\|SRR346952.131960_P1 | 1875 | 6673 | 492 | 94.5 | globlastp |
| LAB633_H734 | euonymus\|11v1\|SRR070038X275752_P1 | 1876 | 6674 | 492 | 94.5 | globlastp |
| LAB633_H735 | fagopyrum\|11v1\|SRR063689X100219_P1 | 1877 | 6675 | 492 | 94.5 | globlastp |
| LAB633_H736 | fagopyrum\|11v1\|SRR063689X103959_P1 | 1878 | 6676 | 492 | 94.5 | globlastp |
| LAB633_H737 | fagopyrum\|11v1\|SRR063689X104259_P1 | 1879 | 6677 | 492 | 94.5 | globlastp |
| LAB633_H738 | fagopyrum\|11v1\|SRR063689X107251_P1 | 1880 | 6675 | 492 | 94.5 | globlastp |
| LAB633_H739 | fagopyrum\|11v1\|SRR063703X107404_P1 | 1881 | 6678 | 492 | 94.5 | globlastp |
| LAB633_H740 | fagopyrum\|11v1\|SRR063703X111206_P1 | 1882 | 6675 | 492 | 94.5 | globlastp |
| LAB633_H741 | medicago\|12v1\|AA660999_P1 | 1883 | 6679 | 492 | 94.5 | globlastp |
| LAB633_H742 | nicotiana_benthamiana\|gb162\|CN743981 | 1884 | 6680 | 492 | 94.5 | globlastp |
| LAB633_H743 | pine\|10v2\|BX255316_P1 | 1885 | 6681 | 492 | 94.5 | globlastp |
| LAB633_H744 | podocarpus\|10v1\|SRR065014S0007955_P1 | 1886 | 6682 | 492 | 94.5 | globlastp |
| LAB633_H745 | rye\|12v1\|DRR001012.223082 | 1887 | 6683 | 492 | 94.5 | globlastp |
| LAB633_H746 | silene\|11v1\|GH292886 | 1888 | 6684 | 492 | 94.5 | globlastp |
| LAB633_H747 | tobacco\|gb162\|DV159858 | 1889 | 6685 | 492 | 94.5 | globlastp |
| LAB633_H748 | tobacco\|gb162\|DW003201 | 1890 | 6680 | 492 | 94.5 | globlastp |
| LAB633_H749 | vinca\|11v1\|SRR098690X104549 | 1891 | 6686 | 492 | 94.5 | globlastp |
| LAB633_H750 | zamia\|gb166\|DT589580 | 1892 | 6687 | 492 | 94.5 | globlastp |
| LAB633_H925 | blueberry\|12v1\|SRR353282X37911D1_P1 | 1893 | 6688 | 492 | 94.1 | globlastp |
| LAB633_H751 | antirrhinum\|gb166\|AJ790387_P1 | 1894 | 6689 | 492 | 94 | globlastp |
| LAB633_H752 | chestnut\|gb170\|SRR006295S0012127_P1 | 1895 | 6690 | 492 | 94 | globlastp |
| LAB633_H753 | apple\|11v1\|MDPRD009363_T1 | 1896 | 6691 | 492 | 93.98 | glotblastn |
| LAB633_H926 | bean\|12v2\|CA901622_T1 | 1897 | 6692 | 492 | 93.94 | glotblastn |
| LAB633_H754 | fagopyrum\|11v1\|SRR063689X1149_T1 | 1898 | 6693 | 492 | 93.94 | glotblastn |
| LAB633_H755 | trigonella\|11v1\|SRR066198X1080363 | 1899 | 6694 | 492 | 93.94 | glotblastn |
| LAB633_H756 | nicotiana_benthamiana\|12v1\|CN743981_P1 | 1900 | 6695 | 492 | 93.9 | globlastp |
| LAB633_H742 | acacia\|10v1\|GR482333_P1 | 1901 | 6696 | 492 | 93.9 | globlastp |
| LAB633_H757 | bruguiera\|gb166\|BP940407_P1 | 1902 | 6697 | 492 | 93.9 | globlastp |
| LAB633_H758 | cedrus\|11v1\|SRR065007X100670_P1 | 1903 | 6698 | 492 | 93.9 | globlastp |
| LAB633_H759 | spikemoss\|gb165\|FE472216 | 1904 | 6699 | 492 | 93.9 | globlastp |
| LAB633_H760 | spikemoss\|gb165\|FE492704 | 1905 | 6699 | 492 | 93.9 | globlastp |
| LAB633_H761 | walnuts\|gb166\|EL900477 | 1906 | 6700 | 492 | 93.9 | globlastp |
| LAB633_H762 | wheat\|10v2\|CA625845 | 1907 | 6701 | 492 | 93.9 | globlastp |
| LAB633_H763 | ipomoea_batatas\|10v1\|DV036086_P1 | 1908 | 6702 | 492 | 93.4 | globlastp |
| LAB633_H764 | fescue\|gb161\|DT698181_P1 | 1909 | 6703 | 492 | 93.3 | globlastp |
| LAB633_H765 | spruce\|11v1\|ES250042 | 1910 | 6704 | 492 | 93.3 | globlastp |
| LAB633_H766 | phalaenopsis\|11v1\|CK856722_T1 | 1911 | 6705 | 492 | 92.9 | glotblastn |
| LAB633_H767 | abies\|11v2\|SRR098676X129884_P1 | 1912 | 6706 | 492 | 92.8 | globlastp |
| LAB633_H768 | ceratodon\|10v1\|SRR074890S0015626_P1 | 1913 | 6707 | 492 | 92.8 | globlastp |
| LAB633_H769 | physcomitrella\|10v1\|AW145377_P1 | 1914 | 6708 | 492 | 92.8 | globlastp |
| LAB633_H770 | physcomitrella\|10v1\|AW739068_P1 | 1915 | 6708 | 492 | 92.8 | globlastp |
| LAB633_H771 | physcomitrella\|10v1\|BQ827717_P1 | 1916 | 6708 | 492 | 92.8 | globlastp |
| LAB633_H772 | pteridium\|11v1\|SRR043594X116683 | 1917 | 6709 | 492 | 92.8 | globlastp |
| LAB633_H773 | spikemoss\|gb165\|DN837789 | 1918 | 6710 | 492 | 92.8 | globlastp |
| LAB633_H774 | spikemoss\|gb165\|FE426809 | 1919 | 6710 | 492 | 92.8 | globlastp |
| LAB633_H775 | rye\|12v1\|DRR001015.210174 | 1920 | 6711 | 492 | 92.73 | glotblastn |
| LAB633_H776 | basilicum\|10v1\|DY328364_P1 | 1921 | 6712 | 492 | 92.7 | globlastp |
| LAB633_H777 | hevea\|10v1\|EC609905_P1 | 1922 | 6713 | 492 | 92.7 | globlastp |
| LAB633_H779 | walnuts\|gb166\|CV196465 | 1923 | 6714 | 492 | 92.7 | globlastp |
| LAB633_H780 | ceratodon\|10v1\|SRR074890S0030085_P1 | 1924 | 6715 | 492 | 92.2 | globlastp |
| LAB633_H781 | ceratodon\|10v1\|SRR074890S0054257_P1 | 1925 | 6715 | 492 | 92.2 | globlastp |
| LAB633_H782 | ceratodon\|10v1\|SRR074890S0083877_P1 | 1926 | 6716 | 492 | 92.2 | globlastp |
| LAB633_H783 | fern\|gb171\|DK954061_P1 | 1927 | 6717 | 492 | 92.2 | globlastp |
| LAB633_H784 | nicotiana_benthamiana\|gb162\|CN746824 | 1928 | 6718 | 492 | 92.12 | glotblastn |
| LAB633_H927 | b_juncea\|12v1\|E6ANDIZ01A573W_P1 | 1929 | 6719 | 492 | 92.1 | globlastp |
| LAB633_H928 | b_juncea\|12v1\|E6ANDIZ01CT2PY_P1 | 1930 | 6720 | 492 | 92.1 | globlastp |
| LAB633_H929 | zostera\|11v1\|SRR057351X189445D1_P1 | 1931 | 6721 | 492 | 91.6 | globlastp |
| LAB633_H785 | physcomitrella\|10v1\|AW145628_P1 | 1932 | 6722 | 492 | 91.6 | globlastp |
| LAB633_H786 | physcomitrella\|10v1\|BJ166310_P1 | 1933 | 6723 | 492 | 91.6 | globlastp |
| LAB633_H787 | pteridium\|11v1\|GW574806 | 1934 | 6724 | 492 | 91.6 | globlastp |
| LAB633_H788 | flaveria\|11v1\|SRR149229.102831_P1 | 1935 | 6725 | 492 | 91.5 | globlastp |
| LAB633_H789 | poppy\|11v1\|SRR096789.151123_P1 | 1936 | 6726 | 492 | 91.5 | globlastp |
| LAB633_H790 | zostera\|10v1\|SRR057351S0040057 | 1937 | 6727 | 492 | 90.91 | glotblastn |
| LAB633_H791 | epimedium\|11v1\|SRR013502.2653_P1 | 1938 | 6728 | 492 | 90.4 | globlastp |
| LAB633_H930 | zostera\|12v1\|SRR057351X128134D1_T1 | 1939 | 6729 | 492 | 90.3 | glotblastn |
| LAB633_H792 | utricularia\|11v1\|SRR094438.106519 | 1940 | 6730 | 492 | 89.7 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB633_H793 | fern\|gb171\|DK945424_P1 | 1941 | 6731 | 492 | 89.2 | globlastp |
| LAB633_H794 | safflower\|gb162\|EL400731 | 1942 | 6732 | 492 | 89.2 | globlastp |
| LAB633_H795 | pteridium\|11v1\|SRR043594X185320 | 1943 | 6733 | 492 | 89.09 | glotblastn |
| LAB633_H796 | tea\|10v1\|CV013952 | 1944 | 6734 | 492 | 88.8 | globlastp |
| LAB633_H797 | amaranthus\|10v1\|SRR039411S0010523_P1 | 1945 | 6735 | 492 | 88.5 | globlastp |
| LAB633_H798 | b_juncea\|10v2\|E6ANDIZ01A7QBZ | 1946 | 6736 | 492 | 88.5 | globlastp |
| LAB633_H799 | mesostigma\|gb166\|DN254417_P1 | 1947 | 6737 | 492 | 88.5 | globlastp |
| LAB633_H800 | mesostigma\|gb166\|EC727008_P1 | 1948 | 6737 | 492 | 88.5 | globlastp |
| LAB633_H801 | rye\|12v1\|DRR001012.11979 | 1949 | 6738 | 492 | 88.5 | globlastp |
| LAB633_H802 | zinnia\|gb171\|AU292884 | 1950 | 6739 | 492 | 88.3 | globlastp |
| LAB633_H803 | cirsium\|11v1\|SRR346952.1010164_P1 | 1951 | 6740 | 492 | 88 | globlastp |
| LAB633_H804 | cirsium\|11v1\|SRR349641.123187_P1 | 1952 | 6740 | 492 | 88 | globlastp |
| LAB633_H805 | b_juncea\|10v2\|E6ANDIZ01A7UOU | 1953 | 6741 | 492 | 87.9 | globlastp |
| LAB633_H931 | chickpea\|13v2\|GR420845_T1 | 1954 | 6742 | 492 | 87.88 | glotblastn |
| LAB633_H806 | cirsium\|11v1\|SRR349641.128132_P1 | 1955 | 6743 | 492 | 87.4 | globlastp |
| LAB633_H807 | eschscholzia\|11v1\|SRR014116.119052_P1 | 1956 | 6744 | 492 | 87.3 | globlastp |
| LAB633_H808 | foxtail_millet\|11v3\|SICRP018324_P1 | 1957 | 6745 | 492 | 87.3 | globlastp |
| LAB633_H809 | guizotia\|10v1\|GE569499_T1 | 1958 | 6746 | 492 | 86.23 | glotblastn |
| LAB633_H810 | cycas\|gb166\|CB092281_P1 | 1959 | 6747 | 492 | 86.1 | globlastp |
| LAB633_H811 | chlamydomonas\|gb162\|AW676113_T1 | 1960 | 6748 | 492 | 86.06 | glotblastn |
| LAB633_H812 | rice\|11v1\|CI252454 | 1961 | 6749 | 492 | 85.5 | globlastp |
| LAB633_H813 | taxus\|10v1\|SRR032523S0003980 | 1962 | 6750 | 492 | 85.2 | globlastp |
| LAB633_H932 | switchgrass\|12v1\|FL726205_P1 | 1963 | 6751 | 492 | 84.9 | globlastp |
| LAB633_H814 | leymus\|gb166\|EG392695_P1 | 1964 | 6752 | 492 | 84.8 | globlastp |
| LAB633_H815 | basilicum\|10v1\|DY332297_P1 | 1965 | 6753 | 492 | 84.4 | globlastp |
| LAB633_H816 | onion\|gb162\|CF434881 | 1966 | 6754 | 492 | 84.3 | globlastp |
| LAB633_H933 | switchgrass\|12v1\|SRR408048.161684_P1 | 1967 | 6755 | 492 | 84.2 | globlastp |
| LAB633_H817 | chestnut\|gb170\|SRR006295S0007214_P1 | 1968 | 6756 | 492 | 83.7 | globlastp |
| LAB633_H818 | poppy\|11v1\|SRR096789.177680_P1 | 1969 | 6757 | 492 | 83.6 | globlastp |
| LAB633_H819 | b_juncea\|10v2\|E6ANDIZ01AR9Y5 | 1970 | 6758 | 492 | 83 | globlastp |
| LAB633_H820 | banana\|10v1\|ES434616 | 1971 | 6759 | 492 | 83 | globlastp |
| LAB633_H821 | curcuma\|10v1\|DY386269_P1 | 1972 | 6760 | 492 | 83 | globlastp |
| LAB633_H822 | tea\|10v1\|GT969344 | 1973 | 6761 | 492 | 82.8 | globlastp |
| LAB633_H823 | pteridium\|11v1\|SRR043594X14056 | 1974 | 6762 | 492 | 82.6 | globlastp |
| LAB633_H824 | rye\|12v1\|DRR001016.1634 | 1975 | 6763 | 492 | 82.4 | globlastp |
| LAB633_H825 | artemisia\|10v1\|EY036129_P1 | 1976 | 6764 | 492 | 81.8 | globlastp |
| LAB633_H826 | euonymus\|11v1\|SRR070038X105022_P1 | 1977 | 6764 | 492 | 81.8 | globlastp |
| LAB633_H827 | fagopyrum\|11v1\|SRR063689X101360_P1 | 1978 | 6765 | 492 | 81.8 | globlastp |
| LAB633_H828 | fagopyrum\|11v1\|SRR063703X135285_P1 | 1979 | 6765 | 492 | 81.8 | globlastp |
| LAB633_H829 | hornbeam\|12v1\|SRR364455.218571_P1 | 1980 | 6764 | 492 | 81.8 | globlastp |
| LAB633_H830 | sarracenia\|11v1\|SRR192669.113809 | 1981 | 6764 | 492 | 81.8 | globlastp |
| LAB633_H831 | tea\|10v1\|GE652210 | 1982 | 6764 | 492 | 81.8 | globlastp |
| LAB633_H832 | thalictrum\|11v1\|SRR096787X101012 | 1983 | 6764 | 492 | 81.8 | globlastp |
| LAB633_H833 | thalictrum\|11v1\|SRR096787X159032 | 1984 | 6764 | 492 | 81.8 | globlastp |
| LAB633_H834 | utricularia\|11v1\|SRR094438.118396 | 1985 | 6766 | 492 | 81.8 | globlastp |
| LAB633_H835 | volvox\|12v1\|FD805229_P1 | 1986 | 6767 | 492 | 81.8 | globlastp |
| LAB633_H835 | volvox\|gb162\|BE453521 | 1987 | 6767 | 492 | 81.8 | globlastp |
| LAB633_H836 | bruguiera\|gb166\|BP943146_P1 | 1988 | 6768 | 492 | 81.2 | globlastp |
| LAB633_H837 | cannabis\|12v1\|JK498119_P1 | 1989 | 6769 | 492 | 81.2 | globlastp |
| LAB633_H838 | cannabis\|12v1\|SOLX00046202_P1 | 1990 | 6770 | 492 | 81.2 | globlastp |
| LAB633_H839 | cacao\|10v1\|CGD0025650_T1 | 1991 | 6771 | 492 | 81.07 | glotblastn |
| LAB633_H840 | canola\|11v1\|EE562026_T1 | 1992 | 6772 | 492 | 80.93 | glotblastn |
| LAB633_H934 | barley\|12v1\|BF621839_T1 | 1993 | 6773 | 492 | 80.61 | glotblastn |
| LAB633_H841 | ostreococcus\|gb162\|XM001418882_T1 | 1994 | 6774 | 492 | 80.61 | glotblastn |
| LAB633_H842 | rye\|12v1\|DRR001012.459948 | 1995 | 6775 | 492 | 80.6 | globlastp |
| LAB633_H843 | eucalyptus\|11v2\|SRR001658X7371_T1 | 1996 | 6776 | 492 | 80.12 | glotblastn |
| LAB633_H844 | b_juncea\|10v2\|E6ANDIZ01A573W | 1997 | 6777 | 492 | 80 | globlastp |
| LAB633_H845 | pea\|11v1\|GH719836_P1 | 1998 | 6777 | 492 | 80 | globlastp |
| LAB634_H1 | pseudoroegneria\|gb167\|FF350988 | 1999 | 6778 | 493 | 94.9 | globlastp |
| LAB634_H2 | wheat\|10v2\|BE425353 | 2000 | 6779 | 493 | 94.9 | globlastp |
| LAB634_H5 | wheat\|12v3\|BE425353_P1 | 2001 | 6780 | 493 | 94 | globlastp |
| LAB634_H3 | rye\|12v1\|BE637264 | 2002 | 6781 | 493 | 92.2 | globlastp |
| LAB634_H4 | leymus\|gb166\|EG376082_P1 | 2003 | 6782 | 493 | 90.3 | globlastp |
| LAB635_H9 | wheat\|12v3\|AL826606_P1 | 2004 | 6783 | 494 | 96.2 | globlastp |
| LAB635_H1 | wheat\|10v2\|BE406517 | 2005 | 6783 | 494 | 96.2 | globlastp |
| LAB635_H2 | rye\|12v1\|BE588100 | 2006 | 6784 | 494 | 91.3 | globlastp |
| LAB635_H3 | pseudoroegneria\|gb167\|FF362055 | 2007 | 6785 | 494 | 88.2 | globlastp |
| LAB635_H4 | barley\|10v2\|BE193614 | 2008 | 6786 | 494 | 88 | globlastp |
| LAB635_H4 | barley\|12v1\|BE193614_P1 | 2009 | 6786 | 494 | 88 | globlastp |
| LAB635_H5 | wheat\|10v2\|BF291652 | 2010 | 6787 | 494 | 87 | globlastp |
| LAB635_H5, LAB635_H6 | wheat\|12v3\|BE406517_P1 | 2011 | 6788 | 494 | 85.9 | globlastp |
| LAB635_H6 | wheat\|10v2\|AL829848 | 2012 | 6789 | 494 | 85.5 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB635_H7 | wheat|10v2|CK198297 | 2013 | 6790 | 494 | 83.61 | glotblastn |
| LAB635_H8 | oat|11v1|GR365487_P1 | 2014 | 6791 | 494 | 80 | globlastp |
| LAB636_H10 | wheat|12v3|BE403352_P1 | 2015 | 6792 | 495 | 99.8 | globlastp |
| LAB636_H1 | rye|12v1|DRR001012.126194 | 2016 | 6793 | 495 | 98.9 | globlastp |
| LAB636_H11 | wheat|12v3|BE426366_P1 | 2017 | 6794 | 495 | 98.5 | globlastp |
| LAB636_H12 | wheat|12v3|CA705468_P1 | 2018 | 6795 | 495 | 97.8 | globlastp |
| LAB636_H13 | wheat|12v3|ERR125574X528675D1_P1 | 2019 | 6796 | 495 | 96.7 | globlastp |
| LAB636_H14 | wheat|12v3|CA633935_T1 | 2020 | 6797 | 495 | 94.14 | glotblastn |
| LAB636_H2 | brachypodium|12v1|BRADI4G16830_P1 | 2021 | 6798 | 495 | 93.4 | globlastp |
| LAB636_H15 | wheat|12v3|CJ623427_P1 | 2022 | 6799 | 495 | 92.9 | globlastp |
| LAB636_H16 | wheat|12v3|CJ603244_P1 | 2023 | 6800 | 495 | 92.3 | globlastp |
| LAB636_H17 | wheat|12v3|BE403104_P1 | 2024 | 6801 | 495 | 92.1 | globlastp |
| LAB636_H3 | rye|12v1|DRR001012.221386 | 2025 | 6802 | 495 | 92 | globlastp |
| LAB636_H4 | wheat|10v2|BQ243840 | 2026 | 6803 | 495 | 91.6 | globlastp |
| LAB636_H18 | wheat|12v3|CA708510_P1 | 2027 | 6804 | 495 | 91.2 | globlastp |
| LAB636_H4 | wheat|12v3|BQ243840_P1 | 2028 | 6805 | 495 | 91 | globlastp |
| LAB636_H5 | rice|11v1|AU058178 | 2029 | 6806 | 495 | 88.9 | globlastp |
| LAB636_H6 | switchgrass|12v1|FL772792_P1 | 2030 | 6807 | 495 | 88.6 | globlastp |
| LAB636_H6 | switchgrass|gb167|FL752075 | 2031 | 6808 | 495 | 88.1 | globlastp |
| LAB636_H7 | foxtail_millet|11v3|PHY7SI026189M_P1 | 2032 | 6809 | 495 | 87.5 | globlastp |
| LAB636_H8 | maize|10v1|AI612281_P1 | 2033 | 6810 | 495 | 87.2 | globlastp |
| LAB636_H9 | sorghum|12v1|SB05G020870 | 2034 | 6811 | 495 | 86.9 | globlastp |
| LAB770_H7 | wheat|12v3|CA728913_P1 | 2035 | 6812 | 496 | 96.3 | globlastp |
| LAB770_H7 | wheat|12v3|CA728913_P1 | 2035 | 6812 | 617 | 90.5 | globlastp |
| LAB637_H1 | rye|12v1|DRR001012.140904 | 2036 | 6813 | 496 | 94.9 | globlastp |
| LAB637_H1 | rye|12v1|DRR001012.140904 | 2036 | 6813 | 617 | 88.6 | globlastp |
| LAB637_H2 | brachypodium|12v1|BRADI3G04440_P1 | 2037 | 6814 | 496 | 93.1 | globlastp |
| LAB637_H2 | brachypodium|12v1|BRADI3G04440_P1 | 2037 | 6814 | 617 | 90.5 | globlastp |
| LAB637_H3 | switchgrass|12v1|FL690184_P1 | 2038 | 6815 | 496 | 92 | globlastp |
| LAB637_H3 | switchgrass|12v1|FL690184_P1 | 2038 | 6815 | 617 | 95.4 | globlastp |
| LAB637_H3, LAB770_H1 | switchgrass|gb167|FL690184 | 2039 | 6815 | 496 | 92 | globlastp |
| LAB637_H3, LAB770_H1 | switchgrass|gb167|FL690184 | 2039 | 6815 | 617 | 95.4 | globlastp |
| LAB637_H4, LAB770_H2 | switchgrass|gb167|DN143610 | 2040 | 6816 | 496 | 91.7 | globlastp |
| LAB637_H4, LAB770_H2 | switchgrass|gb167|DN143610 | 2040 | 6816 | 617 | 94.8 | globlastp |
| LAB637_H5, LAB770_H3 | foxtail_millet|11v3|PHY7SI017691M_P1 | 2041 | 6817 | 496 | 91.1 | globlastp |
| LAB637_H5, LAB770_H3 | foxtail_millet|11v3|PHY7SI017691M_P1 | 2041 | 6817 | 617 | 94.8 | globlastp |
| LAB637_H7 | rice|11v1|AU162360 | 2042 | 6818 | 496 | 90.5 | globlastp |
| LAB637_H7 | rice|11v1|AU162360 | 2042 | 6818 | 617 | 89.3 | globlastp |
| LAB637_H6, LAB770_H4 | maize|10v1|BQ279765_P1 | 2043 | 6819 | 496 | 90.5 | globlastp |
| LAB637_H6, LAB770_H4 | maize|10v1|BQ279765_P1 | 2043 | 6819 | 617 | 95.1 | globlastp |
| LAB637_H8, LAB770_H5 | maize|10v1|DT535423_P1 | 2044 | 6820 | 496 | 89.1 | globlastp |
| LAB637_H8, LAB770_H5 | maize|10v1|DT535423_P1 | 2044 | 6820 | 617 | 93.7 | globlastp |
| LAB637_H9, ALB770_H6 | sugarcane|10v1|CA072247 | 2045 | 6821 | 496 | 85.7 | globlastp |
| LAB637_H9, LAB770_H6 | sugarcane|10v1|CA072247 | 2045 | 6821 | 617 | 91.9 | globlastp |
| LAB638_H1 | rye|12v1|DRR001012.500005 | 2046 | 6822 | 497 | 94.3 | globlastp |
| LAB638_H2 | rye|12v1|DRR001012.106893 | 2047 | 6823 | 497 | 92.9 | globlastp |
| LAB638_H3 | rye|12v1|DRR001012.211062 | 2048 | 6823 | 497 | 92.9 | globlastp |
| LAB638_H8 | wheat|12v3|CA605197_P1 | 2049 | 6824 | 497 | 91.4 | globlastp |
| LAB638_H4 | wheat|10v2|BE401581 | 2050 | 6824 | 497 | 91.4 | globlastp |
| LAB638_H5 | wheat|10v2|BE406265 | 2051 | 6824 | 497 | 91.4 | globlastp |
| LAB638_H5 | wheat|12v3|BE401581_P1 | 2052 | 6824 | 497 | 91.4 | globlastp |
| LAB638_H6 | wheat|10v2|BQ840966 | 2053 | 6825 | 497 | 91.4 | globlastp |
| LAB638_H7 | pseudoroegneria|gb167|FF363756 | 2054 | 6826 | 497 | 81.4 | globlastp |
| LAB657_H1 | sugarcane|10v1|CA065162 | 2055 | 6827 | 497 | 81.4 | globlastp |
| LAB657_H1 | sugarcane|10v1|CA065162 | 2055 | 6827 | 513 | 92.9 | globlastp |
| LAB657_H2 | millet|10v1|EVO454PM028970_P1 | 2056 | 6828 | 497 | 80 | globlastp |
| LAB657_H2 | millet|10v1|EVO454PM028970_P1 | 2056 | 6828 | 513 | 97.1 | globlastp |
| LAB657_H3 | sorghum|12v1|SB06G022040 | 2057 | 6829 | 497 | 80 | globlastp |
| LAB657_H3 | sorghum|12v1|SB06G022040 | 2057 | 6829 | 513 | 92.9 | globlastp |
| LAB639_H4 | rye|12v1|DRR001012.208915 | 2058 | 6830 | 498 | 83.7 | globlastp |
| LAB640_H1 | rye|12v1|BE636799 | 2059 | 6831 | 499 | 96.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB640_H2, LAB640_H7 | wheat\|12v3\|BE488290_P1 | 2060 | 6832 | 499 | 96.8 | globlastp |
| LAB640_H2 | wheat\|10v2\|CD933714 | 2061 | 6833 | 499 | 95.7 | globlastp |
| LAB640_H3 | rye\|12v1\|DRR001012.112482 | 2062 | 6834 | 499 | 94.6 | globlastp |
| LAB640_H4 | rye\|12v1\|DRR001012.369542 | 2063 | 6835 | 499 | 92.6 | globlastp |
| LAB640_H5 | wheat\|10v2\|CA678891 | 2064 | 6836 | 499 | 91.5 | globlastp |
| LAB640_H6 | fescue\|gb161\|DT685234_P1 | 2065 | 6837 | 499 | 89.4 | globlastp |
| LAB640_H7 | wheat\|10v2\|BE419563 | 2066 | — | 499 | 88.2 | globlastp |
| LAB640_H8 | wheat\|10v2\|BE488290 | 2067 | 6838 | 499 | 86 | globlastp |
| LAB640_H9 | oat\|11v1\|GR320771_P1 | 2068 | 6839 | 499 | 85.6 | globlastp |
| LAB640_H10 | rye\|12v1\|DRR001012.259187 | 2069 | 6840 | 499 | 85.1 | globlastp |
| LAB640_H11 | oat\|11v1\|GR329111_P1 | 2070 | 6841 | 499 | 84.5 | globlastp |
| LAB640_H12 | barley\|10v2\|AV835029 | 2071 | 6842 | 499 | 83.9 | globlastp |
| LAB640_H12 | barley\|12v1\|AV835029_P1 | 2072 | 6842 | 499 | 83.9 | globlastp |
| LAB640_H13 | oat\|11v1\|SRR020741.148089_P1 | 2073 | 6843 | 499 | 80 | globlastp |
| LAB641_H2 | wheat\|10v2\|BE499264 | 2074 | 6844 | 500 | 96.4 | globlastp |
| LAB641_H1 | rye\|12v1\|DRR001012.116715 | 2075 | 6845 | 500 | 93.8 | globlastp |
| LAB641_H3 | brachypodium\|12v1\|BRADI3G27670_P1 | 2076 | 6846 | 500 | 92.1 | globlastp |
| LAB641_H4 | rice\|11v1\|BI813394 | 2077 | 6847 | 500 | 89.4 | globlastp |
| LAB641_H5 | foxtail_millet\|11v3\|EC612743_P1 | 2078 | 6848 | 500 | 87.4 | globlastp |
| LAB641_H7 | sorghum\|12v1\|SB01G020590 | 2079 | 6849 | 500 | 86.4 | globlastp |
| LAB641_H8 | maize\|10v1\|AI612279_P1 | 2080 | 6850 | 500 | 85.3 | globlastp |
| LAB641_H10 | foxtail_millet\|11v3\|PHY7SI034851M_P1 | 2081 | 6851 | 500 | 84.4 | globlastp |
| LAB641_H17 | maize\|10v1\|AI621452_P1 | 2082 | 6852 | 500 | 83.3 | globlastp |
| LAB641_H15 | sorghum\|12v1\|SB01G046880 | 2083 | 6853 | 500 | 83.3 | globlastp |
| LAB641_H14 | rice\|11v1\|BI808766 | 2084 | 6854 | 500 | 83.28 | glotblastn |
| LAB641_H18 | brachypodium\|12v1\|BRADI1G75010_P1 | 2085 | 6855 | 500 | 82.8 | globlastp |
| LAB641_H19 | wheat\|12v3\|BE499264_P1 | 2086 | 6856 | 500 | 82.4 | globlastp |
| LAB641_H20 | rye\|12v1\|BE586817_P1 | 2087 | 6857 | 500 | 80.4 | globlastp |
| LAB641_H21 | wheat\|12v3\|BF478432_T1 | 2088 | 6858 | 500 | 80.24 | glotblastn |
| LAB642_H2 | wheat\|12v3\|CA651174_P1 | 2089 | 6859 | 501 | 95.6 | globlastp |
| LAB642_H1 | rye\|12v1\|DRR001017.1022469 | 2090 | 6860 | 501 | 93.5 | globlastp |
| LAB647 | barley\|12v1\|BI958652_P1 | 2091 | 6861 | 504 | 88.3 | globlastp |
| LAB649_H1 | b_rapa\|11v1\|EE410383_P1 | 2092 | 6862 | 505 | 98.7 | globlastp |
| LAB649_H7 | b_juncea\|12v1\|E6ANDIZ01C585V_P1 | 2093 | 6863 | 505 | 97.6 | globlastp |
| LAB649_H2 | radish\|gb164\|EX897837 | 2094 | 6864 | 505 | 95.8 | globlastp |
| LAB649_H3 | thellungiella_parvulum\|11v1\|DN773696 | 2095 | 6865 | 505 | 93.5 | globlastp |
| LAB649_H4 | arabidopsis_lyrata\|09v1\|JGIAL005384_P1 | 2096 | 6866 | 505 | 92.7 | globlastp |
| LAB649_H5 | arabidopsis\|10v1\|AT1G64710_P1 | 2097 | 6867 | 505 | 92.7 | globlastp |
| LAB649_H6 | thellungiella_halophilum\|11v1\|DN773696 | 2098 | 6868 | 505 | 92.2 | globlastp |
| LAB650_H1 | gossypium_raimondii\|12v1\|BE053207_P1 | 2099 | 6869 | 506 | 98.6 | globlastp |
| LAB650_H2 | cotton\|11v1\|AI726238_P1 | 2100 | 6870 | 506 | 96.7 | globlastp |
| LAB650_H3 | gossypium_raimondii\|12v1\|AI726238_P1 | 2101 | 6871 | 506 | 96.4 | globlastp |
| LAB650_H4 | cacao\|10v1\|CU474291_P1 | 2102 | 6872 | 506 | 90.2 | globlastp |
| LAB650_H5 | cacao\|10v1\|CGD0008734_P1 | 2103 | 6873 | 506 | 86 | globlastp |
| LAB650_H6 | beech\|11v1\|SRR006293.1794_T1 | 2104 | 6874 | 506 | 84.65 | glotblastn |
| LAB650_H7 | clementine\|11v1\|BQ623853_P1 | 2105 | 6875 | 506 | 84 | globlastp |
| LAB650_H8 | oak\|10v1\|DN949864_P1 | 2106 | 6876 | 506 | 83.1 | globlastp |
| LAB650_H9 | cassava\|09v1\|DB922130_P1 | 2107 | 6877 | 506 | 83 | globlastp |
| LAB650_H10 | chestnut\|gb170\|SRR006295S0004705_P1 | 2108 | 6878 | 506 | 83 | globlastp |
| LAB650_H11 | beech\|11v1\|SRR006294.4421_T1 | 2109 | 6879 | 506 | 82.97 | glotblastn |
| LAB650_H12 | pigeonpea\|11v1\|SRR054580X126577_P1 | 2110 | 6880 | 506 | 82.5 | globlastp |
| LAB650_H13 | soybean\|11v1\|GLYMA20G26580 | 2111 | 6881 | 506 | 82 | globlastp |
| LAB650_H13 | soybean\|12v1\|GLYMA20G26580_P1 | 2112 | 6881 | 506 | 82 | globlastp |
| LAB650_H14 | cassava\|09v1\|JGICASSAVA1624VALIDM1_P1 | 2113 | 6882 | 506 | 81.8 | globlastp |
| LAB650_H15 | oak\|10v1\|SRR039739S0118316_P1 | 2114 | 6883 | 506 | 81.6 | globlastp |
| LAB650_H17 | poplar\|13v1\|BI129523_P1 | 2115 | 6884 | 506 | 81.6 | globlastp |
| LAB650_H16 | monkeyflower\|10v1\|GO997063 | 2116 | 6885 | 506 | 81.4 | globlastp |
| LAB650_H16 | monkeyflower\|12v1\|GR128319_P1 | 2117 | 6885 | 506 | 81.4 | globlastp |
| LAB650_H17 | poplar\|10v1\|BI129523 | 2118 | 6886 | 506 | 81.3 | globlastp |
| LAB650_H18 | soybean\|11v1\|GLYMA10G40730 | 2119 | 6887 | 506 | 81.3 | globlastp |
| LAB650_H18 | soybean\|12v1\|GLYMA10G40730_P1 | 2120 | 6887 | 506 | 81.3 | globlastp |
| LAB650_H19 | watermelon\|11v1\|AM721949 | 2121 | 6888 | 506 | 81.1 | globlastp |
| LAB650_H20 | peanut\|10v1\|GO331868_T1 | 2122 | 6889 | 506 | 81.06 | glotblastn |
| LAB650_H21 | grape\|11v1\|GSVIVT01037915001_P1 | 2123 | 6890 | 506 | 80.9 | globlastp |
| LAB650_H22 | medicago\|12v1\|AW685152_P1 | 2124 | 6891 | 506 | 80.9 | globlastp |
| LAB650_H23 | poplar\|10v1\|CNS17402 | 2125 | 6892 | 506 | 80.9 | globlastp |
| LAB650_H24 | prunus\|10v1\|BU042480 | 2126 | 6893 | 506 | 80.9 | globlastp |
| LAB650_H25 | trigonella\|11v1\|SRR066194X100544 | 2127 | 6894 | 506 | 80.9 | globlastp |
| LAB650_H26 | castorbean\|12v1\|EE257257_T1 | 2128 | 6895 | 506 | 80.82 | glotblastn |
| LAB650_H27 | chelidonium\|11v1\|SRR084752X101076_P1 | 2129 | 6896 | 506 | 80.7 | globlastp |
| LAB650_H38 | prunus_mume\|13v1\|BU042480_P1 | 2130 | 6897 | 506 | 80.6 | globlastp |
| LAB650_H23 | poplar\|13v1\|CN517402_P1 | 2131 | 6898 | 506 | 80.6 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB650_H28 | eucalyptus\|11v2\|CT985402_P1 | 2132 | 6899 | 506 | 80.6 | globlastp |
| LAB650_H29 | solanum_phureja\|09v1\|SPHBG129553 | 2133 | 6900 | 506 | 80.5 | globlastp |
| LAB650_H30 | tomato\|11v1\|BG129553 | 2134 | 6901 | 506 | 80.5 | globlastp |
| LAB650_H33 | nicotiana_benthamiana\|12v1\|CK283693_P1 | 2135 | 6902 | 506 | 80.5 | globlastp |
| LAB650_H31 | aristolochia\|10v1\|FD763402_P1 | 2136 | 6903 | 506 | 80.4 | globlastp |
| LAB650_H32 | chickpea\|11v1\|GR405235 | 2137 | 6904 | 506 | 80.3 | globlastp |
| LAB650_H32 | chickpea\|13v2\|GR405235_P1 | 2138 | 6904 | 506 | 80.3 | globlastp |
| LAB650_H39 | nicotiana_benthamiana\|12v1\|EB692551_P1 | 2139 | 6905 | 506 | 80.2 | globlastp |
| LAB650_H33 | nicotiana_benthamiana\|gb162\|CK283693 | 2140 | 6906 | 506 | 80.2 | globlastp |
| LAB650_H40 | bean\|12v2\|CA910823_P1 | 2141 | 6907 | 506 | 80.1 | globlastp |
| LAB650_H41 | sesame\|12v1\|SESI12V1414105P1_T1 | 2142 | 6908 | 506 | 80.1 | glotblastn |
| LAB650_H34 | cannabis\|12v1\|EW701633_P1 | 2143 | 6909 | 506 | 80.1 | globlastp |
| LAB650_H35 | melon\|10v1\|AM721949_P1 | 2144 | 6910 | 506 | 80.1 | globlastp |
| LAB650_H36 | beet\|12v1\|BQ490190_P1 | 2145 | 6911 | 506 | 80 | globlastp |
| LAB650_H37 | tobacco\|gb162\|CV016030 | 2146 | 6912 | 506 | 80 | globlastp |
| LAB651_H1 | switchgrass\|gb167\|DN150484 | 2147 | 6913 | 507 | 89.8 | globlastp |
| LAB651_H2 | sorghum\|12v1\|SB03G012910 | 2148 | 6914 | 507 | 84.7 | globlastp |
| LAB651_H3 | millet\|10v1\|EVO454PM013366_T1 | 2149 | 6915 | 507 | 82.85 | glotblastn |
| LAB652_H1 | switchgrass\|12v1\|FL699953_P1 | 2150 | 6916 | 508 | 96.7 | globlastp |
| LAB652_H1 | switchgrass\|gb167\|FL699953 | 2151 | 6916 | 508 | 96.7 | globlastp |
| LAB652_H18 | switchgrass\|12v1\|FL726103_P1 | 2152 | 6917 | 508 | 96.3 | globlastp |
| LAB652_H2 | cenchrus\|gb166\|EB654383_P1 | 2153 | 6918 | 508 | 96.3 | globlastp |
| LAB652_H3 | millet\|10v1\|EVO454PM019178_P1 | 2154 | 6919 | 508 | 96.3 | globlastp |
| LAB652_H4 | maize\|10v1\|AW147035_P1 | 2155 | 6920 | 508 | 95.8 | globlastp |
| LAB652_H5 | sorghum\|12v1\|SB01G008390 | 2156 | 6921 | 508 | 95.8 | globlastp |
| LAB652_H6 | sugarcane\|10v1\|AA525684 | 2157 | 6922 | 508 | 95.4 | globlastp |
| LAB652_H7 | maize\|10v1\|AI861318_P1 | 2158 | 6923 | 508 | 93 | globlastp |
| LAB652_H8 | oat\|11v1\|CK780289_P1 | 2159 | 6924 | 508 | 91.7 | globlastp |
| LAB652_H9 | brachypodium\|12v1\|BRADI1G08900_P1 | 2160 | 6925 | 508 | 91.2 | globlastp |
| LAB652_H10 | rye\|12v1\|DRR001012.110234XX1 | 2161 | 6926 | 508 | 90.7 | globlastp |
| LAB652_H11 | barley\|10v2\|BF625316 | 2162 | 6927 | 508 | 90.3 | globlastp |
| LAB652_H12 | rice\|11v1\|BI806501 | 2163 | 6928 | 508 | 90.3 | globlastp |
| LAB652_H13 | wheat\|10v2\|BE488914 | 2164 | 6929 | 508 | 90.3 | globlastp |
| LAB652_H13, LAB652_H14 | wheat\|12v3\|BE423280XX1_P1 | 2165 | 6929 | 508 | 90.3 | globlastp |
| LAB652_H14 | wheat\|10v2\|BE423280 | 2166 | 6930 | 508 | 89.8 | globlastp |
| LAB652_H15 | leymus\|gb166\|EG388927_P1 | 2167 | 6931 | 508 | 88.9 | globlastp |
| LAB652_H16 | pseudoroegneria\|gb167\|FF354039 | 2168 | 6932 | 508 | 84.3 | globlastp |
| LAB652_H17 | lolium\|10v1\|ES699861_P1 | 2169 | 6933 | 508 | 83.3 | globlastp |
| LAB653_H1 | switchgrass\|12v1\|FE602252_P1 | 2170 | 6934 | 509 | 92.7 | globlastp |
| LAB653_H1 | switchgrass\|gb167\|FE602252 | 2171 | 6934 | 509 | 92.7 | globlastp |
| LAB653_H2 | millet\|10v1\|CD725229_P1 | 2172 | 6935 | 509 | 91.6 | globlastp |
| LAB653_H3 | cenchrus\|gb166\|EB655845_P1 | 2173 | 6936 | 509 | 90.4 | globlastp |
| LAB653_H4 | sugarcane\|10v1\|BU103389 | 2174 | 6937 | 509 | 86 | globlastp |
| LAB653_H5 | sorghum\|12v1\|SB01G041550 | 2175 | 6938 | 509 | 85.1 | globlastp |
| LAB653_H6 | maize\|10v1\|AI979554_P1 | 2176 | 6939 | 509 | 83.4 | globlastp |
| LAB653_H7 | foxtail_millet\|11v3\|PHY7SI036525M_P1 | 2177 | 6940 | 509 | 81.8 | globlastp |
| LAB653_H8 | leymus\|gb166\|EG383933_P1 | 2178 | 6941 | 509 | 80.1 | globlastp |
| LAB653_H9 | brachypodium\|12v1\|BRADI1G68670_P1 | 2179 | 6942 | 509 | 80 | globlastp |
| LAB654_H4 | switchgrass\|12v1\|FE617373_P1 | 2180 | 6943 | 510 | 88.8 | globlastp |
| LAB654_H5 | switchgrass\|12v1\|FL691713_P1 | 2181 | 6944 | 510 | 84.4 | globlastp |
| LAB654_H1 | maize\|10v1\|AI943869_P1 | 2182 | 6945 | 510 | 82.9 | globlastp |
| LAB654_H2 | brachypodium\|12v1\|BRADI5G15377_P1 | 2183 | 6946 | 510 | 80.7 | globlastp |
| LAB654_H3 | rice\|11v1\|BQ906477 | 2184 | 6947 | 510 | 80 | glotblastn |
| LAB655_H1 | switchgrass\|12v1\|FE624783_P1 | 2185 | 6948 | 511 | 90.6 | globlastp |
| LAB655_H1 | switchgrass\|gb167\|FE624783 | 2186 | 6949 | 511 | 90.1 | globlastp |
| LAB655_H2 | sorghum\|12v1\|SB06G017040 | 2187 | 6950 | 511 | 89.6 | globlastp |
| LAB655_H3 | maize\|10v1\|AI600705_P1 | 2188 | 6951 | 511 | 86.4 | globlastp |
| LAB655_H4 | sugarcane\|10v1\|CA069664 | 2189 | 6952 | 511 | 84.6 | globlastp |
| LAB655_H5 | rice\|11v1\|AU056428 | 2190 | 6953 | 511 | 84.4 | globlastp |
| LAB655_H6 | rye\|12v1\|DRR001012.145027 | 2191 | 6954 | 511 | 83.3 | globlastp |
| LAB655_H7 | barley\|10v2\|AV833450 | 2192 | 6955 | 511 | 82.8 | globlastp |
| LAB655_H10 | wheat\|12v3\|CD877355_P1 | 2193 | 6956 | 511 | 82.3 | globlastp |
| LAB655_H8 | millet\|10v1\|EVO454PM012444_P1 | 2194 | 6957 | 511 | 82.2 | globlastp |
| LAB655_H9 | brachypodium\|12v1\|BRADI1G54570_P1 | 2195 | 6958 | 511 | 82 | globlastp |
| LAB655_H11 | switchgrass\|12v1\|FL741655_P1 | 2196 | 6959 | 511 | 80.1 | globlastp |
| LAB657_H4 | maize\|10v1\|BE640184_P1 | 2197 | 6960 | 513 | 94.3 | globlastp |
| LAB657_H5 | switchgrass\|gb167\|FL933929 | 2198 | 6961 | 513 | 92.9 | globlastp |
| LAB657_H6 | switchgrass\|12v1\|FL842338_P1 | 2199 | 6962 | 513 | 91.4 | globlastp |
| LAB657_H6 | switchgrass\|gb167\|FL842338 | 2200 | 6962 | 513 | 91.4 | globlastp |
| LAB657_H7 | maize\|10v1\|BM075068_P1 | 2201 | 6963 | 513 | 85.7 | globlastp |
| LAB657_H8 | oat\|11v1\|GO588823_P1 | 2202 | 6964 | 513 | 81.4 | globlastp |
| LAB657_H9 | rice\|11v1\|BI305745 | 2203 | 6965 | 513 | 80.3 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB657_H10 | lolium|10v1|SRR029314S0009965_P1 | 2204 | 6966 | 513 | 80 | globlastp |
| LAB659_H2 | switchgrass|12v1|FL912449_P1 | 2205 | 6967 | 514 | 87.3 | globlastp |
| LAB659_H1 | switchgrass|gb167|DN148892 | 2206 | 6968 | 514 | 86.7 | globlastp |
| LAB660_H10 | switchgrass|12v1|FL721296_P1 | 2207 | 6969 | 515 | 96.6 | globlastp |
| LAB660_H1 | sorghum|12v1|SB04G037680 | 2208 | 6970 | 515 | 96.3 | globlastp |
| LAB660_H11 | switchgrass|12v1|FL694575_P1 | 2209 | 6971 | 515 | 95.7 | globlastp |
| LAB660_H2 | sugarcane|10v1|CA079386 | 2210 | 6972 | 515 | 95.7 | globlastp |
| LAB660_H3 | maize|10v1|AI734594_P1 | 2211 | 6973 | 515 | 94.2 | globlastp |
| LAB660_H4 | millet|10v1|EVO454PM065219_P1 | 2212 | 6974 | 515 | 92.7 | globlastp |
| LAB660_H5 | rice|11v1|BI813701 | 2213 | 6975 | 515 | 86.7 | globlastp |
| LAB660_H6 | brachypodium|12v1|BRADI3G55860_P1 | 2214 | 6976 | 515 | 85.4 | globlastp |
| LAB660_H12 | wheat|12v3|BF202425_T1 | 2215 | 6977 | 515 | 81.38 | glotblastn |
| LAB660_H7 | leymus|gb166|EG397532_P1 | 2216 | 6978 | 515 | 80.2 | globlastp |
| LAB660_H8 | rye|12v1|DRR001012.107103 | 2217 | 6979 | 515 | 80.1 | globlastp |
| LAB660_H9 | wheat|10v2|BE415043 | 2218 | 6980 | 515 | 80 | glotblastn |
| LAB661_H1 | millet|10v1|EVO454PM071337_P1 | 2219 | 6981 | 516 | 96.3 | globlastp |
| LAB661_H8 | switchgrass|12v1|FL701955_P1 | 2220 | 6982 | 516 | 91.3 | globlastp |
| LAB661_H2 | sorghum|12v1|SB09G023080 | 2221 | 6983 | 516 | 87.8 | globlastp |
| LAB661_H3 | maize|10v1|AW067087_P1 | 2222 | 6984 | 516 | 87.2 | globlastp |
| LAB661_H4 | sugarcane|10v1|CA066631 | 2223 | 6985 | 516 | 86.25 | glotblastn |
| LAB661_H5 | rice|11v1|AU085819 | 2224 | 6986 | 516 | 84 | globlastp |
| LAB661_H9 | switchgrass|12v1|GD008314_P1 | 2225 | 6987 | 516 | 83.3 | globlastp |
| LAB661_H6 | rice|11v1|AU085820 | 2226 | 6988 | 516 | 82.8 | glotblastn |
| LAB661_H7 | brachypodium|12v1|BRADI2G22630_P1 | 2227 | 6989 | 516 | 81.7 | globlastp |
| LAB662_H1 | sorghum|12v1|AW678665 | 2228 | 6990 | 517 | 90.7 | globlastp |
| LAB662_H2 | switchgrass|12v1|FE597736_P1 | 2229 | 6991 | 517 | 89.2 | globlastp |
| LAB662_H2 | switchgrass|gb167|FE597736 | 2230 | 6991 | 517 | 89.2 | globlastp |
| LAB662_H3 | sugarcane|10v1|CA071116 | 2231 | 6992 | 517 | 88.4 | globlastp |
| LAB662_H4 | maize|10v1|AI600387_P1 | 2232 | 6993 | 517 | 86.8 | globlastp |
| LAB662_H5 | rice|11v1|AA754481 | 2233 | 6994 | 517 | 85.1 | globlastp |
| LAB662_H6 | brachypodium|12v1|BRADI4G39197_P1 | 2234 | 6995 | 517 | 83.5 | globlastp |
| LAB662_H7 | rice|11v1|BE230153 | 2235 | 6996 | 517 | 80.3 | globlastp |
| LAB663_H7 | switchgrass|12v1|SRR187766.701178_P1 | 2236 | 6997 | 518 | 92.2 | globlastp |
| LAB663_H8 | switchgrass|12v1|GD040220_P1 | 2237 | 6998 | 518 | 90.5 | globlastp |
| LAB663_H1 | sorghum|12v1|SB02G035910 | 2238 | 6999 | 518 | 89.1 | globlastp |
| LAB663_H2 | maize|10v1|AI783052_P1 | 2239 | 7000 | 518 | 85.7 | globlastp |
| LAB663_H3 | pseudoroegneria|gb167|FF346150 | 2240 | 7001 | 518 | 81 | globlastp |
| LAB663_H5 | wheat|12v3|BQ842544_P1 | 2241 | 7002 | 518 | 81 | globlastp |
| LAB663_H4 | rye|12v1|DRR001012.138219 | 2242 | 7003 | 518 | 80.6 | globlastp |
| LAB663_H5 | wheat|10v2|BQ842544 | 2243 | 7004 | 518 | 80.6 | globlastp |
| LAB663_H6 | brachypodium|12v1|BRADI4G08120_P1 | 2244 | 7005 | 518 | 80.3 | globlastp |
| LAB664_H1 | millet|10v1|EVO454PM000526_P1 | 2245 | 7006 | 519 | 99.3 | globlastp |
| LAB664_H23 | switchgrass|12v1|FE601121_P1 | 2246 | 7007 | 519 | 97.9 | globlastp |
| LAB664_H2 | maize|10v1|AI372152_P1 | 2247 | 7008 | 519 | 95 | globlastp |
| LAB664_H3 | sorghum|12v1|SB09G024810 | 2248 | 7009 | 519 | 95 | globlastp |
| LAB664_H4 | sugarcane|10v1|CA073888 | 2249 | 7009 | 519 | 95 | globlastp |
| LAB664_H5 | maize|10v1|BE511858_P1 | 2250 | 7010 | 519 | 92.9 | globlastp |
| LAB664_H6 | rice|11v1|AA750057 | 2251 | 7011 | 519 | 91.8 | globlastp |
| LAB664_H7 | leymus|gb166|EG391638_P1 | 2252 | 7012 | 519 | 90.4 | globlastp |
| LAB664_H8 | fescue|gb161|DT702544_P1 | 2253 | 7013 | 519 | 90 | globlastp |
| LAB664_H9 | barley|10v2|BE413105 | 2254 | 7014 | 519 | 89.3 | globlastp |
| LAB664_H10 | brachypodium|12v1|BRADI2G20570_P1 | 2255 | 7015 | 519 | 89 | globlastp |
| LAB664_H11 | oat|11v1|CN814662_P1 | 2256 | 7016 | 519 | 89 | globlastp |
| LAB664_H12 | rye|12v1|DRR001012.145532 | 2257 | 7017 | 519 | 88.6 | globlastp |
| LAB664_H13 | wheat|10v2|BE404120 | 2258 | 7018 | 519 | 88.6 | globlastp |
| LAB664_H13 | wheat|12v3|BE493085_P1 | 2259 | 7018 | 519 | 88.6 | globlastp |
| LAB664_H14 | pseudoroegneria|gb167|FF350314 | 2260 | 7019 | 519 | 88.57 | glotblastn |
| LAB664_H15 | rye|12v1|DRR001012.103031 | 2261 | 7020 | 519 | 87.86 | glotblastn |
| LAB664_H16 | lovegrass|gb167|EH184319_T1 | 2262 | 7021 | 519 | 85.71 | glotblastn |
| LAB664_H17 | foxtail_millet|11v3|GT091141_P1 | 2263 | 7022 | 519 | 84 | globlastp |
| LAB664_H18 | millet|10v1|CD724411_P1 | 2264 | 7023 | 519 | 84 | globlastp |
| LAB664_H19 | rice|11v1|AF225922 | 2265 | 7024 | 519 | 83.3 | globlastp |
| LAB664_H24 | switchgrass|12v1|FL896166_P1 | 2266 | 7025 | 519 | 82.9 | globlastp |
| LAB664_H20 | maize|10v1|AI978031_P1 | 2267 | 7026 | 519 | 82.9 | globlastp |
| LAB664_H25 | switchgrass|12v1|GD018645_P1 | 2268 | 7027 | 519 | 82.6 | globlastp |
| LAB664_H21 | cenchrus|gb166|EB654951_P1 | 2269 | 7028 | 519 | 82.5 | globlastp |
| LAB664_H22 | wheat|10v2|CA497859 | 2270 | 7029 | 519 | 80.1 | globlastp |
| LAB665_H1 | cenchrus|gb166|EB652424_P1 | 2271 | 520 | 520 | 100 | globlastp |
| LAB665_H2 | lovegrass|gb167|EH188259_P1 | 2272 | 520 | 520 | 100 | globlastp |
| LAB665_H3 | maize|10v1|AA979992_P1 | 2273 | 520 | 520 | 100 | globlastp |
| LAB665_H4 | millet|10v1|EVO454PM043274_P1 | 2274 | 520 | 520 | 100 | globlastp |
| LAB665_H5 | rice|11v1|CB212121 | 2275 | 520 | 520 | 100 | globlastp |
| LAB665_H6 | sugarcane|10v1|CA082741 | 2276 | 520 | 520 | 100 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB665_H7 | switchgrass\|12v1\|FL730481_P1 | 2277 | 520 | 520 | 100 | globlastp |
| LAB665_H7 | switchgrass\|gb167\|FL730481 | 2278 | 520 | 520 | 100 | globlastp |
| LAB665_H8 | switchgrass\|12v1\|FL730485_P1 | 2279 | 520 | 520 | 100 | globlastp |
| LAB665_H8 | switchgrass\|gb167\|FL730485 | 2280 | 7030 | 520 | 100 | glotblastn |
| LAB665_H9 | sorghum\|12v1\|SB06G033360 | 2281 | 7031 | 520 | 99.5 | globlastp |
| LAB665_H10 | maize\|10v1\|AI586586_P1 | 2282 | 7032 | 520 | 99 | globlastp |
| LAB665_H11 | brachypodium\|12v1\|BRADI5G26806_P1 | 2283 | 7033 | 520 | 98 | globlastp |
| LAB665_H12 | oat\|11v1\|GO598723_P1 | 2284 | 7034 | 520 | 98 | globlastp |
| LAB665_H13 | pseudoroegneria\|gb167\|FF345898 | 2285 | 7034 | 520 | 98 | globlastp |
| LAB665_H201 | wheat\|12v3\|BQ238405_P1 | 2286 | 7035 | 520 | 97.5 | globlastp |
| LAB665_H14 | rye\|12v1\|DRR001012.112075 | 2287 | 7035 | 520 | 97.5 | globlastp |
| LAB665_H15 | rye\|12v1\|DRR001012.154017 | 2288 | 7035 | 520 | 97.5 | globlastp |
| LAB665_H16 | wheat\|10v2\|BE352625 | 2289 | 7035 | 520 | 97.5 | globlastp |
| LAB665_H17 | barley\|10v2\|BE420600XX1 | 2290 | 7036 | 520 | 97 | globlastp |
| LAB665_H18 | wheat\|12v3\|BE402395_P1 | 2291 | 7037 | 520 | 97 | globlastp |
| LAB665_H18 | wheat\|10v2\|BF202015 | 2292 | 7038 | 520 | 96.6 | globlastp |
| LAB665_H17 | barley\|12v1\|BE420600_P1 | 2293 | 7039 | 520 | 96.1 | globlastp |
| LAB665_H19 | rye\|12v1\|DRR001012.108092 | 2294 | 7040 | 520 | 96.1 | globlastp |
| LAB665_H20 | fescue\|gb161\|DT683669_P1 | 2295 | 7041 | 520 | 93.6 | globlastp |
| LAB665_H202 | banana\|12v1\|BBS3243T3_P1 | 2296 | 7042 | 520 | 93.1 | globlastp |
| LAB665_H203 | banana\|12v1\|FF559212_P1 | 2297 | 7043 | 520 | 93.1 | globlastp |
| LAB665_H21 | banana\|10v1\|BBS3243T3 | 2298 | 7044 | 520 | 92.6 | globlastp |
| LAB665_H22 | banana\|10v1\|FF559212 | 2299 | 7045 | 520 | 92.6 | globlastp |
| LAB665_H23 | phalaenopsis\|11v1\|SRR125771.1036098_T1 | 2300 | 7046 | 520 | 92.08 | glotblastn |
| LAB665_H24 | oil_palm\|11v1\|EL682034_P1 | 2301 | 7047 | 520 | 91.6 | globlastp |
| LAB665_H25 | oil_palm\|11v1\|EY396282_P1 | 2302 | 7048 | 520 | 91.6 | globlastp |
| LAB665_H26 | ambrosia\|11v1\|SRR346935.31340_P1 | 2303 | 7049 | 520 | 90.6 | globlastp |
| LAB665_H27 | euonymus\|11v1\|SRR070038X125124_P1 | 2304 | 7050 | 520 | 90.6 | globlastp |
| LAB665_H28 | flaveria\|11v1\|SRR149229.12876_P1 | 2305 | 7051 | 520 | 90.6 | globlastp |
| LAB665_H29 | flaveria\|11v1\|SRR149232.176966_P1 | 2306 | 7051 | 520 | 90.6 | globlastp |
| LAB665_H30 | oil_palm\|11v1\|EL683871_P1 | 2307 | 7052 | 520 | 90.6 | globlastp |
| LAB665_H31 | phalaenopsis\|11v1\|SRR125771.105004_P1 | 2308 | 7053 | 520 | 90.6 | globlastp |
| LAB665_H32 | sunflower\|12v1\|DY914938 | 2309 | 7049 | 520 | 90.6 | globlastp |
| LAB665_H33 | sunflower\|12v1\|DY921222 | 2310 | 7049 | 520 | 90.6 | globlastp |
| LAB665_H204 | pepper\|12v1\|CO775983_P1 | 2311 | 7054 | 520 | 90.1 | globlastp |
| LAB665_H205 | zostera\|12v1\|AM767783_P1 | 2312 | 7055 | 520 | 90.1 | globlastp |
| LAB665_H34 | amorphophallus\|11v2\|SRR089351X119460_P1 | 2313 | 7056 | 520 | 90.1 | globlastp |
| LAB665_H35 | apple\|11v1\|CO066264_P1 | 2314 | 7057 | 520 | 90.1 | globlastp |
| LAB665_H36 | cucumber\|09v1\|DV632421_P1 | 2315 | 7058 | 520 | 90.1 | globlastp |
| LAB665_H37 | curcuma\|10v1\|DY388180_T1 | 2316 | 7059 | 520 | 90.1 | glotblastn |
| LAB665_H38 | euonymus\|11v1\|SRR070038X220957_P1 | 2317 | 7060 | 520 | 90.1 | globlastp |
| LAB665_H39 | grape\|11v1\|GSVIVT01026851001_P1 | 2318 | 7061 | 520 | 90.1 | globlastp |
| LAB665_H40 | melon\|10v1\|DV632421_P1 | 2319 | 7058 | 520 | 90.1 | globlastp |
| LAB665_H41 | nasturtium\|11v1\|SRR032558.104418_P1 | 2320 | 7062 | 520 | 90.1 | globlastp |
| LAB665_H42 | pepper\|gb171\|CO775983 | 2321 | 7054 | 520 | 90.1 | globlastp |
| LAB665_H43 | solanum_phureja\|09v1\|SPHBG134742 | 2322 | 7063 | 520 | 90.1 | globlastp |
| LAB665_H44 | watermelon\|11v1\|DV632421 | 2323 | 7058 | 520 | 90.1 | globlastp |
| LAB665_H45 | zostera\|10v1\|AM767783 | 2324 | 7055 | 520 | 90.1 | globlastp |
| LAB665_H206 | nicotiana_benthamiana\|12v1\|EB425041_P1 | 2325 | 7064 | 520 | 89.6 | globlastp |
| LAB665_H207 | nicotiana_benthamiana\|12v1\|EB425373_P1 | 2326 | 7065 | 520 | 89.6 | globlastp |
| LAB665_H208 | olea\|13v1\|SRR014464X2967D1_P1 | 2327 | 7066 | 520 | 89.6 | globlastp |
| LAB665_H209 | prunus_mume\|13v1\|CB821286_P1 | 2328 | 7067 | 520 | 89.6 | globlastp |
| LAB665_H46 | ambrosia\|11v1\|SRR346935.14014_P1 | 2329 | 7068 | 520 | 89.6 | globlastp |
| LAB665_H47 | amsonia\|11v1\|SRR098688X101442_P1 | 2330 | 7069 | 520 | 89.6 | globlastp |
| LAB665_H48 | apple\|11v1\|CN877976_P1 | 2331 | 7070 | 520 | 89.6 | globlastp |
| LAB665_H49 | aristolochia\|10v1\|SRR039082S0195342_P1 | 2332 | 7071 | 520 | 89.6 | globlastp |
| LAB665_H50 | blueberry\|10v1\|DR067023 | 2333 | 7072 | 520 | 89.6 | globlastp |
| LAB665_H50 | blueberry\|12v1\|DR067023_P1 | 2334 | 7072 | 520 | 89.6 | globlastp |
| LAB665_H51 | cannabis\|12v1\|JK498315_P1 | 2335 | 7073 | 520 | 89.6 | globlastp |
| LAB665_H52 | castorbean\|12v1\|EG660628_P1 | 2336 | 7074 | 520 | 89.6 | globlastp |
| LAB665_H53 | catharanthus\|11v1\|SRR098691X13789_P1 | 2337 | 7069 | 520 | 89.6 | globlastp |
| LAB665_H54 | clementine\|11v1\|CV884222_P1 | 2338 | 7075 | 520 | 89.6 | globlastp |
| LAB665_H55 | orange\|11v1\|CV884222_P1 | 2338 | 7075 | 520 | 89.6 | globlastp |
| LAB665_H56 | cotton\|11v1\|BG441601_P1 | 2339 | 7076 | 520 | 89.6 | globlastp |
| LAB665_H57 | cucurbita\|11v1\|SRR091276X101458_P1 | 2340 | 7077 | 520 | 89.6 | globlastp |
| LAB665_H58 | eschscholzia\|11v1\|CD480050_P1 | 2341 | 7078 | 520 | 89.6 | globlastp |
| LAB665_H59 | gossypium_raimondii\|12v1\|BG441601_P1 | 2342 | 7076 | 520 | 89.6 | globlastp |
| LAB665_H60 | phyla\|11v2\|SRR099037X224103_P1 | 2343 | 7079 | 520 | 89.6 | globlastp |
| LAB665_H61 | prunus\|10v1\|CB821286 | 2344 | 7067 | 520 | 89.6 | globlastp |
| LAB665_H62 | rose\|12v1\|EC587004 | 2345 | 7080 | 520 | 89.6 | globlastp |
| LAB665_H63 | tabernaemontana\|11v1\|SRR098689X105357 | 2346 | 7069 | 520 | 89.6 | globlastp |
| LAB665_H64 | tobacco\|gb162\|EB425041 | 2347 | 7065 | 520 | 89.6 | globlastp |
| LAB665_H65 | tripterygium\|11v1\|SRR098677X118644 | 2348 | 7081 | 520 | 89.6 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB665_H66 | abies\|11v2\|SRR098676X13758_P1 | 2349 | 7082 | 520 | 89.1 | globlastp |
| LAB665_H67 | cacao\|10v1\|CU472895_P1 | 2350 | 7083 | 520 | 89.1 | globlastp |
| LAB665_H68 | cichorium\|gb171\|EH673922_P1 | 2351 | 7084 | 520 | 89.1 | globlastp |
| LAB665_H69 | cichorium\|gb171\|EL362644_P1 | 2352 | 7085 | 520 | 89.1 | globlastp |
| LAB665_H70 | cirsium\|11v1\|SRR346952.1008524_P1 | 2353 | 7084 | 520 | 89.1 | globlastp |
| LAB665_H71 | cirsium\|11v1\|SRR346952.105703_P1 | 2354 | 7084 | 520 | 89.1 | globlastp |
| LAB665_H72 | cirsium\|11v1\|SRR346952.1116817_P1 | 2355 | 7084 | 520 | 89.1 | globlastp |
| LAB665_H73 | coffea\|10v1\|DV663807_P1 | 2356 | 7086 | 520 | 89.1 | globlastp |
| LAB665_H74 | cotton\|11v1\|BQ405654_P1 | 2357 | 7087 | 520 | 89.1 | globlastp |
| LAB665_H75 | euonymus\|11v1\|SRR070038X106975_P1 | 2358 | 7088 | 520 | 89.1 | globlastp |
| LAB665_H76 | euphorbia\|11v1\|BI962048_P1 | 2359 | 7089 | 520 | 89.1 | globlastp |
| LAB665_H77 | gossypium_raimondii\|12v1\|BQ405654_P1 | 2360 | 7087 | 520 | 89.1 | globlastp |
| LAB665_H78 | maritime_pine\|10v1\|CT578510_P1 | 2361 | 7090 | 520 | 89.1 | globlastp |
| LAB665_H79 | oak\|10v1\|DB998869_P1 | 2362 | 7091 | 520 | 89.1 | globlastp |
| LAB665_H80 | pine\|10v2\|AI812693_P1 | 2363 | 7090 | 520 | 89.1 | globlastp |
| LAB665_H81 | platanus\|11v1\|SRR096786X105416_P1 | 2364 | 7092 | 520 | 89.1 | globlastp |
| LAB665_H82 | pseudotsuga\|10v1\|SRR065119S0016350 | 2365 | 7082 | 520 | 89.1 | globlastp |
| LAB665_H83 | safflower\|gb162\|EL410612 | 2366 | 7084 | 520 | 89.1 | globlastp |
| LAB665_H84 | scabiosa\|11v1\|SRR063723X110095 | 2367 | 7093 | 520 | 89.1 | globlastp |
| LAB665_H85 | strawberry\|11v1\|DV439471 | 2368 | 7094 | 520 | 89.1 | globlastp |
| LAB665_H86 | tobacco\|gb162\|EB425373 | 2369 | 7095 | 520 | 89.1 | globlastp |
| LAB665_H87 | tomato\|11v1\|BG134742 | 2370 | 7096 | 520 | 89.1 | globlastp |
| LAB665_H88 | tragopogon\|10v1\|SRR020205S0044553 | 2371 | 7097 | 520 | 89.1 | globlastp |
| LAB665_H89 | tripterygium\|11v1\|SRR098677X10565 | 2372 | 7098 | 520 | 89.1 | globlastp |
| LAB665_H92 | olea\|13v1\|SRR014463X37018D1_P1 | 2373 | 7099 | 520 | 89.1 | globlastp |
| LAB665_H90 | onion\|gb162\|CF441137 | 2374 | 7100 | 520 | 88.73 | globlastn |
| LAB665_H91 | fraxinus\|11v1\|SRR058827.114618_T1 | 2375 | 7101 | 520 | 88.61 | glotblastn |
| LAB665_H92 | olea\|11v1\|SRR014463.37018 | 2376 | 7102 | 520 | 88.61 | glotblastn |
| LAB665_H210 | lettuce\|12v1\|DW048831_P1 | 2377 | 7103 | 520 | 88.6 | globlastp |
| LAB665_H93 | beet\|12v1\|BQ060495_P1 | 2378 | 7104 | 520 | 88.6 | globlastp |
| LAB665_H94 | cassava\|09v1\|CK650539_P1 | 2379 | 7105 | 520 | 88.6 | globlastp |
| LAB665_H95 | centaurea\|gb166\|EH718958_P1 | 2380 | 7106 | 520 | 88.6 | globlastp |
| LAB665_H96 | centaurea\|gb166\|EH726695_P1 | 2381 | 7107 | 520 | 88.6 | globlastp |
| LAB665_H97 | cephalotaxus\|11v1\|SRR064395X104104_P1 | 2382 | 7108 | 520 | 88.6 | globlastp |
| LAB665_H98 | cirsium\|11v1\|SRR346952.1003274_P1 | 2383 | 7106 | 520 | 88.6 | globlastp |
| LAB665_H99 | cirsium\|11v1\|SRR346952.1004063_P1 | 2384 | 7109 | 520 | 88.6 | globlastp |
| LAB665_H100 | cirsium\|11v1\|SRR346952.103982_P1 | 2385 | 7110 | 520 | 88.6 | globlastp |
| LAB665_H101 | cirsium\|11v1\|SRR346952.688630_P1 | 2386 | 7106 | 520 | 88.6 | globlastp |
| LAB665_H102 | cowpea\|12v1\|FF384587_P1 | 2387 | 7111 | 520 | 88.6 | globlastp |
| LAB665_H102 | cowpea\|gb166\|FF384587 | 2388 | 7111 | 520 | 88.6 | globlastp |
| LAB665_H103 | cynara\|gb167\|GE589630_P1 | 2389 | 7112 | 520 | 88.6 | globlastp |
| LAB665_H104 | distylium\|11v1\|SRR065077X108220_P1 | 2390 | 7108 | 520 | 88.6 | globlastp |
| LAB665_H105 | eucalyptus\|11v2\|CU395885_P1 | 2391 | 7113 | 520 | 88.6 | globlastp |
| LAB665_H106 | euonymus\|11v1\|SRR070038X245901_P1 | 2392 | 7114 | 520 | 88.6 | globlastp |
| LAB665_H107 | guizotia\|10v1\|GE562490_P1 | 2393 | 7115 | 520 | 88.6 | globlastp |
| LAB665_H108 | lettuce\|10v1\|DW048831 | 2394 | 7103 | 520 | 88.6 | globlastp |
| LAB665_H109 | lotus\|09v1\|LLAW163924_P1 | 2395 | 7111 | 520 | 88.6 | globlastp |
| LAB665_H110 | podocarpus\|10v1\|SRR065014S0005514_P1 | 2396 | 7108 | 520 | 88.6 | globlastp |
| LAB665_H111 | poplar\|10v1\|AI162253 | 2397 | 7116 | 520 | 88.6 | globlastp |
| LAB665_H112 | rhizophora\|10v1\|SRR005793S0001754 | 2398 | 7117 | 520 | 88.6 | globlastp |
| LAB665_H113 | spruce\|11v1\|ES864294 | 2399 | 7118 | 520 | 88.6 | globlastp |
| LAB665_H211 | onion\|12v1\|CF441137_P1 | 2400 | 7119 | 520 | 88.2 | globlastp |
| LAB665_H111 | poplar\|13v1\|AI162253_P1 | 2401 | 7120 | 520 | 88.2 | globlastp |
| LAB665_H114 | poppy\|11v1\|SRR030259.125578_T1 | 2402 | 7121 | 520 | 88.12 | glotblastn |
| LAB665_H212 | bean\|12v2\|CA911163_P1 | 2403 | 7122 | 520 | 88.1 | globlastp |
| LAB665_H115 | amborella\|12v2\|SRR038634.26901 | 2404 | 7123 | 520 | 88.1 | globlastp |
| LAB665_H116 | bean\|12v1\|CA911163 | 2405 | 7122 | 520 | 88.1 | globlastp |
| LAB665_H117 | chestnut\|gb170\|SRR006295S0022473_P1 | 2406 | 7124 | 520 | 88.1 | globlastp |
| LAB665_H118 | dandelion\|10v1\|DY825393_P1 | 2407 | 7125 | 520 | 88.1 | globlastp |
| LAB665_H119 | monkeyflower\|10v1\|GO959032 | 2408 | 7126 | 520 | 88.1 | globlastp |
| LAB665_H119 | monkeyflower\|12v1\|GR068674_P1 | 2409 | 7126 | 520 | 88.1 | globlastp |
| LAB665_H120 | oak\|10v1\|CU656269_P1 | 2410 | 7124 | 520 | 88.1 | globlastp |
| LAB665_H121 | papaya\|gb165\|EX256097_P1 | 2411 | 7127 | 520 | 88.1 | globlastp |
| LAB665_H122 | petunia\|gb171\|CV299439_P1 | 2412 | 7128 | 520 | 88.1 | globlastp |
| LAB665_H123 | phyla\|11v2\|SRR099035X139714_P1 | 2413 | 7129 | 520 | 88.1 | globlastp |
| LAB665_H124 | sciadopitys\|10v1\|SRR065035S0012181 | 2414 | 7130 | 520 | 88.1 | globlastp |
| LAB665_H125 | soybean\|11v1\|GLYMA10G38120 | 2415 | 7131 | 520 | 88.1 | globlastp |
| LAB665_H125 | soybean\|12v1\|GLYMA10G38125_P1 | 2416 | 7131 | 520 | 88.1 | globlastp |
| LAB665_H126 | soybean\|11v1\|GLYMA20G29700 | 2417 | 7132 | 520 | 88.1 | globlastp |
| LAB665_H126 | soybean\|12v1\|GLYMA20G29700_P1 | 2418 | 7132 | 520 | 88.1 | globlastp |
| LAB665_H127 | taxus\|10v1\|SRR032523S0010724 | 2419 | 7133 | 520 | 88.1 | globlastp |
| LAB665_H128 | triphysaria\|10v1\|EY144131 | 2420 | 7134 | 520 | 88.1 | globlastp |
| LAB665_H129 | artemisia\|10v1\|EY037160_T1 | 2421 | 7135 | 520 | 87.62 | glotblastn |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB665_H130 | poppy\|11v1\|SRR096789.104591__T1 | 2422 | 7121 | 520 | 87.62 | glotblastn |
| LAB665_H213 | aquilegia\|10v2\|DT730739__P1 | 2423 | 7136 | 520 | 87.6 | globlastp |
| LAB665_H131 | aquilegia\|10v1\|DT730739 | 2424 | 7137 | 520 | 87.6 | globlastp |
| LAB665_H132 | eucalyptus\|11v2\|CD669026__P1 | 2425 | 7138 | 520 | 87.6 | globlastp |
| LAB665_H133 | fagopyrum\|11v1\|SRR063689X219139__P1 | 2426 | 7139 | 520 | 87.6 | globlastp |
| LAB665_H134 | ipomoea_nil\|10v1\|BJ558772__P1 | 2427 | 7140 | 520 | 87.6 | globlastp |
| LAB665_H135 | medicago\|12v1\|AW981006__P1 | 2428 | 7141 | 520 | 87.6 | globlastp |
| LAB665_H136 | pigeonpea\|11v1\|SRR054580X110091__P1 | 2429 | 7142 | 520 | 87.6 | globlastp |
| LAB665_H137 | thalictrum\|11v1\|SRR096787X10242 | 2430 | 7143 | 520 | 87.6 | globlastp |
| LAB665_H138 | trigonella\|11v1\|SRR066194X244665 | 2431 | 7141 | 520 | 87.6 | globlastp |
| LAB665_H139 | tripterygium\|11v1\|SRR098677X101877 | 2432 | 7144 | 520 | 87.6 | globlastp |
| LAB665_H214 | onion\|12v1\|SRR073446X17449D1__P1 | 2433 | 7145 | 520 | 87.3 | globlastp |
| LAB665_H140 | beech\|11v1\|SRR006293.11651__T1 | 2434 | 7146 | 520 | 87.13 | glotblastn |
| LAB665_H141 | vinca\|11v1\|SRR098690X207127 | 2435 | 7147 | 520 | 87.13 | glotblastn |
| LAB665_H142 | chickpea\|11v1\|FE669148 | 2436 | 7148 | 520 | 87.1 | globlastp |
| LAB665_H142 | chickpea\|13v2\|FE669148__P1 | 2437 | 7148 | 520 | 87.1 | globlastp |
| LAB665_H143 | cleome_spinosa\|10v1\|GR931406__P1 | 2438 | 7149 | 520 | 87.1 | globlastp |
| LAB665_H144 | fagopyrum\|11v1\|SRR063689X10482XX1__P1 | 2439 | 7150 | 520 | 87.1 | globlastp |
| LAB665_H145 | flax\|11v1\|GW866721__P1 | 2440 | 7151 | 520 | 87.1 | globlastp |
| LAB665_H146 | grape\|11v1\|GSVIVT01028985001__P1 | 2441 | 7152 | 520 | 87.1 | globlastp |
| LAB665_H147 | safflower\|gb162\|EL399119 | 2442 | 7153 | 520 | 87.1 | globlastp |
| LAB665_H148 | beech\|11v1\|SRR006293.21464__T1 | 2443 | 7154 | 520 | 86.63 | glotblastn |
| LAB665_H149 | sarracenia\|11v1\|SRR192669.127721 | 2444 | 7155 | 520 | 86.63 | glotblastn |
| LAB665_H150 | eggplant\|10v1\|FS026985__P1 | 2445 | 7156 | 520 | 86.6 | globlastp |
| LAB665_H151 | potato\|10v1\|BG096434__P1 | 2446 | 7157 | 520 | 86.6 | globlastp |
| LAB665_H152 | potato\|10v1\|CK862208__P1 | 2447 | 7158 | 520 | 86.6 | globlastp |
| LAB665_H153 | solanum_phureja\|09v1\|SPHBG134632 | 2448 | 7157 | 520 | 86.6 | globlastp |
| LAB665_H154 | tobacco\|gb162\|EB436339 | 2449 | 7159 | 520 | 86.6 | globlastp |
| LAB665_H155 | peanut\|10v1\|ES722255__P1 | 2450 | 7160 | 520 | 86.3 | globlastp |
| LAB665_H156 | utricularia\|11v1\|SRR094438.103057 | 2451 | 7161 | 520 | 86.14 | glotblastn |
| LAB665_H157 | nasturtium\|11v1\|SRR032558.125288__P1 | 2452 | 7162 | 520 | 86.1 | globlastp |
| LAB665_H158 | platanus\|11v1\|SRR096786X13023__P1 | 2453 | 7163 | 520 | 86.1 | globlastp |
| LAB665_H159 | radish\|gb164\|EW731504 | 2454 | 7164 | 520 | 86.1 | globlastp |
| LAB665_H160 | solanum_phureja\|09v1\|SPHAI483593 | 2455 | 7165 | 520 | 86.1 | globlastp |
| LAB665_H161 | thellungiella_halophilum\|11v1\|BY827571 | 2456 | 7166 | 520 | 86.1 | globlastp |
| LAB665_H162 | thellungiella_parvulum\|11v1\|BY827571 | 2457 | 7166 | 520 | 86.1 | globlastp |
| LAB665_H215 | pepper\|12v1\|CA516783__P1 | 2458 | 7167 | 520 | 85.6 | globlastp |
| LAB665_H163 | canola\|11v1\|DY011019__P1 | 2459 | 7168 | 520 | 85.6 | globlastp |
| LAB665_H164 | pepper\|gb171\|CA516783 | 2460 | 7167 | 520 | 85.6 | globlastp |
| LAB665_H165 | primula\|11v1\|SRR098679X101965__P1 | 2461 | 7169 | 520 | 85.6 | globlastp |
| LAB665_H166 | radish\|gb164\|EV524582 | 2462 | 7170 | 520 | 85.6 | globlastp |
| LAB665_H167 | silene\|11v1\|GH292861 | 2463 | 7171 | 520 | 85.6 | globlastp |
| LAB665_H168 | silene\|11v1\|SRR096785X140356 | 2464 | 7172 | 520 | 85.6 | globlastp |
| LAB665_H169 | triphysaria\|10v1\|BM357298 | 2465 | 7173 | 520 | 85.6 | globlastp |
| LAB665_H170 | hornbeam\|12v1\|SRR364455.108780__T1 | 2466 | 7174 | 520 | 85.15 | glotblastn |
| LAB665_H216 | b_juncea\|12v1\|E6ANDIZ01B0B7B__P1 | 2467 | 7175 | 520 | 85.1 | globlastp |
| LAB665_H217 | b_juncea\|12v1\|E6ANDIZ01BMX69__P1 | 2468 | 7176 | 520 | 85.1 | globlastp |
| LAB665_H171 | arabidopsis_lyrata\|09v1\|JGIAL025551__P1 | 2469 | 7177 | 520 | 85.1 | globlastp |
| LAB665_H172 | b_oleracea\|gb161\|DY027041__P1 | 2470 | 7176 | 520 | 85.1 | globlastp |
| LAB665_H173 | b_rapa\|11v1\|CD814800__P1 | 2471 | 7176 | 520 | 85.1 | globlastp |
| LAB665_H174 | b_rapa\|11v1\|CD817890__P1 | 2472 | 7178 | 520 | 85.1 | globlastp |
| LAB665_H175 | canola\|11v1\|EG019998__P1 | 2473 | 7176 | 520 | 85.1 | globlastp |
| LAB665_H176 | radish\|gb164\|EX756827 | 2474 | 7179 | 520 | 85.1 | globlastp |
| LAB665_H177 | tomato\|11v1\|BG134632 | 2475 | 7180 | 520 | 85.1 | globlastp |
| LAB665_H178 | arabidopsis\|10v1\|AT4G25550__P1 | 2476 | 7181 | 520 | 84.7 | globlastp |
| LAB665_H179 | b_juncea\|10v2\|E6ANDIZ01D72XG | 2477 | 7182 | 520 | 84.7 | globlastp |
| LAB665_H180 | gnetum\|10v1\|DN954711__P1 | 2478 | 7183 | 520 | 84.7 | globlastp |
| LAB665_H181 | potato\|10v1\|BG594190__P1 | 2479 | 7184 | 520 | 84.7 | globlastp |
| LAB665_H182 | radish\|gb164\|EV529337 | 2480 | 7185 | 520 | 84.7 | globlastp |
| LAB665_H218 | b_juncea\|12v1\|E6ANDIZ01CD18A__P1 | 2481 | 7186 | 520 | 84.2 | globlastp |
| LAB665_H183 | b_rapa\|11v1\|CD822007__P1 | 2482 | 7186 | 520 | 84.2 | globlastp |
| LAB665_H184 | canola\|11v1\|EE452927__P1 | 2483 | 7186 | 520 | 84.2 | globlastp |
| LAB665_H185 | cynara\|gb167\|GE598725__P1 | 2484 | 7187 | 520 | 84.2 | globlastp |
| LAB665_H186 | radish\|gb164\|EV536302 | 2485 | 7188 | 520 | 84.2 | globlastp |
| LAB665_H187 | cycas\|gb166\|EX924706__P1 | 2486 | 7189 | 520 | 83.7 | globlastp |
| LAB665_H188 | ambrosia\|11v1\|SRR346943.110084__T1 | 2487 | 7190 | 520 | 83.66 | glotblastn |
| LAB665_H189 | wheat\|10v2\|DR737429 | 2488 | 7191 | 520 | 83.25 | glotblastn |
| LAB665_H190 | clover\|gb162\|BB916672__P1 | 2489 | 7192 | 520 | 83.2 | globlastp |
| LAB665_H191 | arnica\|11v1\|SRR099034X123140__T1 | 2490 | 7193 | 520 | 83.17 | glotblastn |
| LAB665_H192 | vinca\|11v1\|SRR098690X106849 | 2491 | 7194 | 520 | 83.17 | glotblastn |
| LAB665_H193 | centaurea\|gb166\|EH717510__T1 | 2492 | 7195 | 520 | 82.67 | glotblastn |
| LAB665_H194 | ceratodon\|10v1\|AW087005__P1 | 2493 | 7196 | 520 | 82.2 | globlastp |
| LAB665_H195 | marchantia\|gb166\|BJ844093__P1 | 2494 | 7197 | 520 | 82.2 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB665_H196 | physcomitrella\|10v1\|BJ198295_P1 | 2495 | 7196 | 520 | 82.2 | globlastp |
| LAB665_H197 | eschscholzia\|11v1\|SRR014116.109721_P1 | 2496 | 7198 | 520 | 81.2 | globlastp |
| LAB665_H219 | olea\|13v1\|SRR014464X40446D1_P1 | 2497 | 7199 | 520 | 80.7 | globlastp |
| LAB665_H198 | spikemoss\|gb165\|FE452878 | 2498 | 7200 | 520 | 80.7 | globlastp |
| LAB665_H199 | ambrosia\|11v1\|SRR346947.163642_T1 | 2499 | 7201 | 520 | 80.3 | globlastp |
| LAB665_H200 | cedrus\|11v1\|SRR065007X109893_P1 | 2500 | 7202 | 520 | 80.2 | globlastp |
| LAB666_H1 | millet\|10v1\|CD725078_P1 | 2501 | 7203 | 521 | 94.3 | globlastp |
| LAB666_H2 | switchgrass\|12v1\|DN144222_P1 | 2502 | 7204 | 521 | 94.3 | globlastp |
| LAB666_H2 | switchgrass\|gb167\|DN144222 | 2503 | 7204 | 521 | 94.3 | globlastp |
| LAB666_H3 | switchgrass\|12v1\|FE633933_P1 | 2504 | 7205 | 521 | 94.3 | globlastp |
| LAB666_H3 | switchgrass\|gb167\|FE633933 | 2505 | 7205 | 521 | 94.3 | globlastp |
| LAB666_H4 | sorghum\|12v1\|SB09G021980 | 2506 | 7206 | 521 | 93.1 | globlastp |
| LAB666_H5 | maize\|10v1\|AI372214_P1 | 2507 | 7207 | 521 | 92.6 | globlastp |
| LAB666_H6 | cynodon\|10v1\|ES296768_P1 | 2508 | 7208 | 521 | 90.3 | globlastp |
| LAB666_H7 | sugarcane\|10v1\|CA080464 | 2509 | 7209 | 521 | 90.3 | globlastp |
| LAB666_H8 | sorghum\|12v1\|SB04G004800 | 2510 | 7210 | 521 | 88.6 | globlastp |
| LAB666_H9 | maize\|10v1\|BG837406_T1 | 2511 | 7211 | 521 | 86.86 | glotblastn |
| LAB667_H1 | switchgrass\|12v1\|DN143859_P1 | 2512 | 7212 | 522 | 93.6 | globlastp |
| LAB667_H1 | switchgrass\|gb167\|DN143859 | 2513 | 7213 | 522 | 93.6 | globlastp |
| LAB667_H12 | switchgrass\|12v1\|FE604583_P1 | 2514 | 7214 | 522 | 92.8 | globlastp |
| LAB667_H2 | sorghum\|12v1\|SB02G029480 | 2515 | 7215 | 522 | 91.5 | globlastp |
| LAB667_H3 | sugarcane\|10v1\|CA069945 | 2516 | 7216 | 522 | 90.6 | globlastp |
| LAB667_H4 | maize\|10v1\|BE511154_P1 | 2517 | 7217 | 522 | 87.8 | globlastp |
| LAB667_H5 | maize\|10v1\|BG837077_P1 | 2518 | 7218 | 522 | 87.7 | globlastp |
| LAB667_H6 | rice\|11v1\|BI813601 | 2519 | 7219 | 522 | 81.9 | globlastp |
| LAB667_H7 | oat\|11v1\|GR343968_T1 | 2520 | 7220 | 522 | 81.82 | glotblastn |
| LAB667_H10 | wheat\|12v3\|CA646540_P1 | 2521 | 7221 | 522 | 81.7 | globlastp |
| LAB667_H8 | millet\|10v1\|EVO454PM033571_P1 | 2522 | 7222 | 522 | 81.3 | globlastp |
| LAB667_H9 | barley\|10v2\|BQ761834 | 2523 | 7223 | 522 | 81.2 | globlastp |
| LAB667_H10 | wheat\|10v2\|AL826210 | 2524 | 7224 | 522 | 81.19 | glotblastn |
| LAB667_H11 | brachypodium\|12v1\|BRADI4G34820_P1 | 2525 | 7225 | 522 | 80.4 | globlastp |
| LAB668_H1 | millet\|10v1\|EVO454PM010518_P1 | 2526 | 7226 | 523 | 97.7 | globlastp |
| LAB668_H2 | cenchrus\|gb166\|EB661950_P1 | 2527 | 7227 | 523 | 97 | globlastp |
| LAB668_H3 | switchgrass\|12v1\|FE614179_P1 | 2528 | 7228 | 523 | 96.6 | globlastp |
| LAB668_H3 | switchgrass\|gb167\|DN145311 | 2529 | 7229 | 523 | 96.2 | globlastp |
| LAB668_H4 | sugarcane\|10v1\|CA072523 | 2530 | 7230 | 523 | 95.9 | globlastp |
| LAB668_H5 | maize\|10v1\|AI979603_P1 | 2531 | 7231 | 523 | 94.7 | globlastp |
| LAB668_H6 | sorghum\|12v1\|SB02G040620 | 2532 | 7232 | 523 | 93.7 | globlastp |
| LAB668_H7 | cynodon\|10v1\|ES299677_P1 | 2533 | 7233 | 523 | 92.9 | globlastp |
| LAB668_H8 | maize\|10v1\|AI622591_P1 | 2534 | 7234 | 523 | 92.9 | globlastp |
| LAB668_H9 | rice\|11v1\|AU101972 | 2535 | 7235 | 523 | 91 | globlastp |
| LAB668_H10 | pseudoroegneria\|gb167\|FF345069 | 2536 | 7236 | 523 | 89.3 | globlastp |
| LAB668_H11 | barley\|10v2\|BE421662 | 2537 | 7237 | 523 | 88.5 | globlastp |
| LAB668_H12 | fescue\|gb161\|DT685490_P1 | 2538 | 7238 | 523 | 88.5 | globlastp |
| LAB668_H13 | oat\|11v1\|GR352405_P1 | 2539 | 7239 | 523 | 88.1 | globlastp |
| LAB668_H14 | rye\|12v1\|DRR001012.103256 | 2540 | 7240 | 523 | 88.1 | globlastp |
| LAB668_H24 | wheat\|12v3\|BE403245_P1 | 2541 | 7241 | 523 | 87.8 | globlastp |
| LAB668_H15 | leymus\|gb166\|EG398694_P1 | 2542 | 7242 | 523 | 87.8 | globlastp |
| LAB668_H16 | rye\|12v1\|DRR001012.113351 | 2543 | 7243 | 523 | 87.8 | globlastp |
| LAB668_H17 | wheat\|10v2\|BE400825 | 2544 | 7244 | 523 | 87.8 | globlastp |
| LAB668_H17 | wheat\|12v3\|BE400825_P1 | 2545 | 7245 | 523 | 87.4 | globlastp |
| LAB668_H18 | brachypodium\|12v1\|BRADI1G20080_P1 | 2546 | 7246 | 523 | 85.8 | globlastp |
| LAB668_H19 | rye\|12v1\|DRR001012.132819 | 2547 | 7247 | 523 | 82.5 | globlastp |
| LAB668_H20 | foxtail_millet\|11v3\|PHY7SI036853M_P1 | 2548 | 7248 | 523 | 80.8 | globlastp |
| LAB668_H21 | millet\|10v1\|EVO454PM007482_P1 | 2549 | 7249 | 523 | 80.6 | globlastp |
| LAB668_H22 | pseudoroegneria\|gb167\|FF360520 | 2550 | 7250 | 523 | 80.2 | globlastp |
| LAB668_H25 | switchgrass\|12v1\|FL793498_P1 | 2551 | 7251 | 523 | 80.1 | globlastp |
| LAB668_H23 | switchgrass\|gb167\|DN141485 | 2552 | 7252 | 523 | 80.1 | globlastp |
| LAB669_H1 | switchgrass\|12v1\|FL750676_P1 | 2553 | 7253 | 524 | 98.1 | globlastp |
| LAB669_H89 | switchgrass\|12v1\|FE597846_P1 | 2554 | 7254 | 524 | 97.9 | globlastp |
| LAB669_H1 | switchgrass\|gb167\|FE597846 | 2555 | 7255 | 524 | 97.8 | globlastp |
| LAB669_H2 | sorghum\|12v1\|SB01G037170 | 2556 | 7256 | 524 | 97.65 | glotblastn |
| LAB669_H3 | maize\|10v1\|AW120158_P1 | 2557 | 7257 | 524 | 97 | globlastp |
| LAB669_H4 | maize\|10v1\|AI396559_P1 | 2558 | 7258 | 524 | 96.8 | globlastp |
| LAB669_H5 | rye\|12v1\|DRR001012.115999 | 2559 | 7259 | 524 | 96 | globlastp |
| LAB669_H6 | wheat\|10v2\|BQ166811 | 2560 | 7259 | 524 | 96 | globlastp |
| LAB669_H6 | wheat\|12v3\|BQ246981_P1 | 2561 | 7260 | 524 | 95.7 | globlastp |
| LAB669_H8 | brachypodium\|12v1\|BRADI1G64190_P1 | 2562 | 7261 | 524 | 95.3 | globlastp |
| LAB669_H9 | fescue\|gb161\|CK801052_P1 | 2563 | 7262 | 524 | 94.9 | globlastp |
| LAB669_H90 | wheat\|12v3\|BE516939_P1 | 2564 | 7263 | 524 | 92.1 | globlastp |
| LAB669_H91 | banana\|12v1\|ES436911_P1 | 2565 | 7264 | 524 | 89.4 | globlastp |
| LAB669_H10 | clementine\|11v1\|CX071916_P1 | 2566 | 7265 | 524 | 88.8 | globlastp |
| LAB669_H11 | orange\|11v1\|CX071916_P1 | 2567 | 7265 | 524 | 88.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB669_H12 | soybean\|11v1\|GLYMA19G40600 | 2568 | 7266 | 524 | 88.5 | globlastp |
| LAB669_H12 | soybean\|12v1\|GLYMA19G40600_P1 | 2569 | 7266 | 524 | 88.5 | globlastp |
| LAB669_H13 | pigeonpea\|11v1\|SRR054580X100999_P1 | 2570 | 7267 | 524 | 88.2 | globlastp |
| LAB669_H14 | soybean\|11v1\|GLYMA02G01390 | 2571 | 7268 | 524 | 88.2 | globlastp |
| LAB669_H14 | soybean\|12v1\|GLYMA02G01390_P1 | 2572 | 7268 | 524 | 88.2 | globlastp |
| LAB669_H15 | pigeonpea\|11v1\|SRR054580X100166_P1 | 2573 | 7269 | 524 | 88.1 | globlastp |
| LAB669_H16 | soybean\|11v1\|GLYMA03G37980 | 2574 | 7270 | 524 | 88.1 | globlastp |
| LAB669_H16 | soybean\|12v1\|GLYMA03G37980_P1 | 2575 | 7270 | 524 | 88.1 | globlastp |
| LAB669_H17 | zostera\|10v1\|SRR057351S0006025 | 2576 | 7271 | 524 | 87.97 | glotblastn |
| LAB669_H18 | medicago\|12v1\|AA660189_P1 | 2577 | 7272 | 524 | 87.8 | globlastp |
| LAB669_H19 | eucalyptus\|11v2\|ES590896_P1 | 2578 | 7273 | 524 | 87.7 | globlastp |
| LAB669_H20 | amborella\|12v3\|FD432109_P1 | 2579 | 7274 | 524 | 87.6 | globlastp |
| LAB669_H92 | bean\|12v2\|FG229598_P1 | 2580 | 7275 | 524 | 87.5 | globlastp |
| LAB669_H93 | sesame\|12v1\|SESI12V1382795_P1 | 2581 | 7276 | 524 | 87.5 | globlastp |
| LAB669_H21 | bean\|12v1\|FG229598 | 2582 | 7275 | 524 | 87.5 | globlastp |
| LAB669_H22 | cotton\|11v1\|CO111529XX1_P1 | 2583 | 7277 | 524 | 87.5 | globlastp |
| LAB669_H23 | arabidopsis_lyrata\|09v1\|CRPALE021972_P1 | 2584 | 7278 | 524 | 87.4 | globlastp |
| LAB669_H24 | gossypium_raimondii\|12v1\|BQ405139_P1 | 2585 | 7279 | 524 | 87.4 | globlastp |
| LAB669_H25 | grape\|11v1\|GSVIVT01028153001_P1 | 2586 | 7280 | 524 | 87.4 | globlastp |
| LAB669_H26 | trigonella\|11v1\|SRR066194X147217 | 2587 | 7281 | 524 | 87.4 | glotblastn |
| LAB669_H27 | cacao\|10v1\|CU469910_P1 | 2588 | 7282 | 524 | 87.3 | globlastp |
| LAB669_H28 | cucumber\|09v1\|AM727579_P1 | 2589 | 7283 | 524 | 87.3 | globlastp |
| LAB669_H29 | castorbean\|12v1\|EG663818_P1 | 2590 | 7284 | 524 | 87.2 | globlastp |
| LAB669_H30 | watermelon\|11v1\|AM727579 | 2591 | 7285 | 524 | 87.2 | globlastp |
| LAB669_H31 | poppy\|11v1\|SRR030259.102963_P1 | 2592 | 7286 | 524 | 87.1 | globlastp |
| LAB669_H94 | chickpea\|13v2\|FE670490_P1 | 2593 | 7287 | 524 | 87 | globlastp |
| LAB669_H32 | cannabis\|12v1\|JK494800_P1 | 2594 | 7288 | 524 | 87 | globlastp |
| LAB669_H33 | thellungiella_parvulum\|11v1\|BY816163 | 2595 | 7289 | 524 | 87 | globlastp |
| LAB669_H95 | lettuce\|12v1\|DW070893_P1 | 2596 | 7290 | 524 | 86.9 | globlastp |
| LAB669_H96 | prunus_mume\|13v1\|DY636576_P1 | 2597 | 7291 | 524 | 86.9 | globlastp |
| LAB669_H34 | lettuce\|10v1\|DW070893 | 2598 | 7292 | 524 | 86.87 | glotblastn |
| LAB669_H35 | amsonia\|11v1\|SRR098688X104922_P1 | 2599 | 7293 | 524 | 86.8 | globlastp |
| LAB669_H36 | apple\|11v1\|CN496452_P1 | 2600 | 7294 | 524 | 86.8 | globlastp |
| LAB669_H37 | chickpea\|11v1\|FE670490 | 2601 | 7295 | 524 | 86.8 | globlastp |
| LAB669_H38 | eschscholzia\|11v1\|CD478433_P1 | 2602 | 7296 | 524 | 86.8 | globlastp |
| LAB669_H39 | gnetum\|10v1\|SRR064399S0052953_T1 | 2603 | 7297 | 524 | 86.76 | glotblastn |
| LAB669_H97 | nicotiana_benthamiana\|12v1\|EB447116_P1 | 2604 | 7298 | 524 | 86.7 | globlastp |
| LAB669_H40 | ambrosia\|11v1\|SRR346935.153110_P1 | 2605 | 7299 | 524 | 86.7 | globlastp |
| LAB669_H41 | arnica\|11v1\|SRR099034X133722_P1 | 2606 | 7300 | 524 | 86.7 | globlastp |
| LAB669_H42 | prunus\|10v1\|CN496452 | 2607 | 7301 | 524 | 86.7 | globlastp |
| LAB669_H43 | thellungiella_halophilum\|11v1\|BY816163 | 2608 | 7302 | 524 | 86.7 | globlastp |
| LAB669_H98 | aquilegia\|10v2\|DR919918_P1 | 2609 | 7303 | 524 | 86.6 | globlastp |
| LAB669_H44 | arabidopsis\|10v1\|AT2G47250_P1 | 2610 | 7304 | 524 | 86.6 | globlastp |
| LAB669_H45 | b_rapa\|11v1\|CD824590_P1 | 2611 | 7305 | 524 | 86.6 | globlastp |
| LAB669_H46 | sunflower\|12v1\|CX944665 | 2612 | 7306 | 524 | 86.6 | globlastp |
| LAB669_H47 | vinca\|11v1\|SRR098690X101911 | 2613 | 7307 | 524 | 86.59 | glotblastn |
| LAB669_H99 | aquilegia\|10v2\|DR919468_P1 | 2614 | 7308 | 524 | 86.5 | globlastp |
| LAB669_H48 | apple\|11v1\|MDCRP102529_P1 | 2615 | 7309 | 524 | 86.4 | globlastp |
| LAB669_H49 | euonymus\|11v1\|SRR070038X102350_P1 | 2616 | 7310 | 524 | 86.4 | globlastp |
| LAB669_H50 | poplar\|10v1\|BI123886 | 2617 | 7311 | 524 | 86.4 | globlastp |
| LAB669_H51 | ambrosia\|11v1\|SRR346935.107427_T1 | 2618 | 7312 | 524 | 86.26 | glotblastn |
| LAB669_H100 | pepper\|12v1\|CA513944_P1 | 2619 | 7313 | 524 | 86.2 | globlastp |
| LAB669_H52 | arabidopsis\|10v1\|AT3G62310_P1 | 2620 | 7314 | 524 | 86.2 | globlastp |
| LAB669_H53 | canola\|11v1\|CN737393_P1 | 2621 | 7315 | 524 | 86.2 | globlastp |
| LAB669_H54 | canola\|11v1\|DY002306_P1 | 2622 | 7316 | 524 | 86.2 | globlastp |
| LAB669_H56 | cassava\|09v1\|DB920266_P1 | 2623 | 7317 | 524 | 86.1 | globlastp |
| LAB669_H57 | chelidonium\|11v1\|SRR084752X109346_T1 | 2624 | 7318 | 524 | 86.03 | glotblastn |
| LAB669_H58 | strawberry\|11v1\|DY671908 | 2625 | 7319 | 524 | 86 | globlastp |
| LAB669_H59 | silene\|11v1\|SRR096785X101082 | 2626 | 7320 | 524 | 85.9 | globlastp |
| LAB669_H60 | valeriana\|11v1\|SRR099039X102700 | 2627 | 7321 | 524 | 85.8 | globlastp |
| LAB669_H61 | amorphophallus\|11v2\|SRR089351X130574_P1 | 2628 | 7322 | 524 | 85.7 | globlastp |
| LAB669_H62 | maritime_pine\|10v1\|BX255000_P1 | 2629 | 7323 | 524 | 85.7 | globlastp |
| LAB669_H63 | pine\|10v2\|BX255000_P1 | 2630 | 7324 | 524 | 85.6 | globlastp |
| LAB669_H64 | poplar\|10v1\|BI068513 | 2631 | 7325 | 524 | 85.6 | globlastp |
| LAB669_H65 | centaurea\|gb166\|EL932094_T1 | 2632 | 7326 | 524 | 85.56 | glotblastn |
| LAB669_H66 | b_rapa\|11v1\|CX193394_P1 | 2633 | 7327 | 524 | 85.4 | globlastp |
| LAB669_H67 | pseudotsuga\|10v1\|SRR065119S0006982 | 2634 | 7328 | 524 | 85.3 | globlastp |
| LAB669_H68 | canola\|11v1\|EE440040_P1 | 2635 | 7329 | 524 | 85.2 | globlastp |
| LAB669_H69 | monkeyflower\|10v1\|GO944851 | 2636 | 7330 | 524 | 85.1 | globlastp |
| LAB669_H69 | monkeyflower\|12v1\|GO944852_P1 | 2637 | 7330 | 524 | 85.1 | globlastp |
| LAB669_H70 | euphorbia\|11v1\|SRR098678X114200_P1 | 2638 | 7331 | 524 | 84.8 | globlastp |
| LAB669_H71 | physcomitrella\|10v1\|AW598857_P1 | 2639 | 7332 | 524 | 84.8 | globlastp |
| LAB669_H72 | physcomitrella\|10v1\|BJ172365_P1 | 2640 | 7332 | 524 | 84.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB669_H73 | plantago\|11v2\|SRR066373X122098_P1 | 2641 | 7333 | 524 | 84.8 | globlastp |
| LAB669_H74 | abies\|11v2\|SRR098676X104733_P1 | 2642 | 7334 | 524 | 84.7 | globlastp |
| LAB669_H75 | ceratodon\|10v1\|SRR074890S0001291_P1 | 2643 | 7335 | 524 | 84.7 | globlastp |
| LAB669_H76 | physcomitrella\|10v1\|BJ606158_P1 | 2644 | 7336 | 524 | 84.7 | globlastp |
| LAB669_H77 | flaveria\|11v1\|SRR149229.164120_P1 | 2645 | 7337 | 524 | 83.8 | globlastp |
| LAB669_H78 | aristolochia\|10v1\|FD749754_T1 | 2646 | 7338 | 524 | 83.62 | glotblastn |
| LAB669_H79 | lotus\|09v1\|AV424955_P1 | 2647 | 7339 | 524 | 83.2 | globlastp |
| LAB669_H80 | oak\|10v1\|DN949716_T1 | 2648 | 7340 | 524 | 83.09 | glotblastn |
| LAB669_H81 | solanum_phureja\|09v1\|SPHBG125221 | 2649 | 7341 | 524 | 82.79 | glotblastn |
| LAB669_H82 | tomato\|11v1\|BG125221 | 2650 | 7342 | 524 | 82.65 | glotblastn |
| LAB669_H83 | tabernaemontana\|11v1\|SRR098689X111497XX1 | 2651 | 7343 | 524 | 81.89 | glotblastn |
| LAB669_H101 | barley\|12v1\|BF625487_T1 | 2652 | 7344 | 524 | 81.68 | glotblastn |
| LAB669_H84 | pseudotsuga\|10v1\|SRR065119S0089962 | 2653 | 7345 | 524 | 81.63 | glotblastn |
| LAB669_H85 | radish\|gb164\|EV546238 | 2654 | 7346 | 524 | 81.32 | glotblastn |
| LAB669_H86 | podocarpus\|10v1\|SRR065014S0008929_T1 | 2655 | 7347 | 524 | 80.43 | glotblastn |
| LAB669_H87 | pine\|10v2\|CF668741_P1 | 2656 | 7348 | 524 | 80.2 | globlastp |
| LAB669_H88 | cichorium\|gb171\|DT212456_T1 | 2657 | 7349 | 524 | 80.08 | glotblastn |
| LAB670_H24 | switchgrass\|12v1\|FL727682_P1 | 2658 | 7350 | 525 | 97.9 | globlastp |
| LAB670_H1 | sugarcane\|10v1\|CA154508 | 2659 | 7350 | 525 | 97.9 | globlastp |
| LAB670_H2 | switchgrass\|12v1\|FE654834_P1 | 2660 | 7350 | 525 | 97.9 | globlastp |
| LAB670_H2 | switchgrass\|gb167\|FE654834 | 2661 | 7350 | 525 | 97.9 | globlastp |
| LAB670_H3 | millet\|10v1\|EVO454PM012640_P1 | 2662 | 7351 | 525 | 96.9 | globlastp |
| LAB670_H4 | sorghum\|12v1\|SB01G034530 | 2663 | 7352 | 525 | 96.9 | globlastp |
| LAB670_H5 | maize\|10v1\|AI738313_P1 | 2664 | 7353 | 525 | 94.8 | globlastp |
| LAB670_H6 | cynodon\|10v1\|ES306689_P1 | 2665 | 7354 | 525 | 89.7 | globlastp |
| LAB670_H7 | rice\|11v1\|AU092825 | 2666 | 7355 | 525 | 88.8 | globlastp |
| LAB670_H8 | oat\|11v1\|GO584324_P1 | 2667 | 7356 | 525 | 88.7 | globlastp |
| LAB670_H9 | lolium\|10v1\|AU245997_P1 | 2668 | 7357 | 525 | 86.6 | globlastp |
| LAB670_H10 | cenchrus\|gb166\|EB671644_P1 | 2669 | 7358 | 525 | 85.7 | globlastp |
| LAB670_H11 | cynodon\|10v1\|ES292573_P1 | 2670 | 7359 | 525 | 84.7 | globlastp |
| LAB670_H12 | foxtail_millet\|11v3\|PHY7SI031250M_P1 | 2671 | 7360 | 525 | 84.7 | globlastp |
| LAB670_H13 | rice\|11v1\|AF009413 | 2672 | 7361 | 525 | 84.7 | globlastp |
| LAB670_H14 | switchgrass\|gb167\|FL698409 | 2673 | 7362 | 525 | 84.7 | globlastp |
| LAB670_H15 | switchgrass\|gb167\|FL701923 | 2674 | 7363 | 525 | 84.7 | globlastp |
| LAB670_H14, LAB670_H15 | switchgrass\|12v1\|FL698408_P1 | 2675 | 7362 | 525 | 84.7 | globlastp |
| LAB670_H16 | millet\|10v1\|CD725161_T1 | 2676 | 7364 | 525 | 84.69 | glotblastn |
| LAB670_H17 | lovegrass\|gb167\|EH192478_P1 | 2677 | 7365 | 525 | 83.7 | globlastp |
| LAB670_H18 | maize\|10v1\|W21683_P1 | 2678 | 7366 | 525 | 83.7 | globlastp |
| LAB670_H19 | sorghum\|12v1\|SB02G040870 | 2679 | 7366 | 525 | 83.7 | globlastp |
| LAB670_H20 | sugarcane\|10v1\|CA071951 | 2680 | 7366 | 525 | 83.7 | globlastp |
| LAB670_H21 | brachypodium\|12v1\|BRADI1G19860_P1 | 2681 | 7367 | 525 | 82 | globlastp |
| LAB670_H22 | maize\|10v1\|AI901988_P1 | 2682 | 7368 | 525 | 81.6 | globlastp |
| LAB670_H23 | maize\|10v1\|BI361016_P1 | 2683 | 7368 | 525 | 81.6 | globlastp |
| LAB671_H1 | switchgrass\|gb167\|FL721656 | 2684 | 7369 | 526 | 86.51 | glotblastn |
| LAB671_H1 | switchgrass\|12v1\|FL721656_P1 | 2685 | 7370 | 526 | 85.9 | globlastp |
| LAB671_H2 | sorghum\|12v1\|SB01G021260 | 2686 | 7371 | 526 | 84.8 | globlastp |
| LAB671_H3 | maize\|10v1\|AI600834_T1 | 2687 | 7372 | 526 | 81.13 | glotblastn |
| LAB672_H1 | cotton\|11v1\|CO122741_T1 | 2688 | 7373 | 527 | 98.63 | glotblastn |
| LAB673_H1 | sorghum\|12v1\|SB06G022000 | 2689 | 7374 | 528 | 95.5 | globlastp |
| LAB673_H2 | foxtail_millet\|11v3\|PHY7SI011035M_P1 | 2690 | 7375 | 528 | 90.7 | globlastp |
| LAB673_H3 | rice\|11v1\|AU166606 | 2691 | 7376 | 528 | 85.8 | globlastp |
| LAB673_H4 | brachypodium\|12v1\|BRADI5G15167_P1 | 2692 | 7377 | 528 | 85.4 | globlastp |
| LAB673_H5 | barley\|10v2\|BF255786 | 2693 | 7378 | 528 | 85.3 | globlastp |
| LAB673_H6 | wheat\|12v3\|BE490542_P1 | 2694 | 7379 | 528 | 85.2 | globlastp |
| LAB673_H6 | wheat\|10v2\|BE490542 | 2695 | 7380 | 528 | 84.5 | globlastp |
| LAB673_H8 | switchgrass\|12v1\|FL789100_T1 | 2696 | 7381 | 528 | 81.78 | glotblastn |
| LAB673_H7 | switchgrass\|gb167\|FL789100 | 2697 | 7382 | 528 | 81.78 | glotblastn |
| LAB675_H66 | switchgrass\|12v1\|FL870695_P1 | 2698 | 7383 | 529 | 97.6 | globlastp |
| LAB675_H1 | switchgrass\|gb167\|DN151324 | 2699 | 7383 | 529 | 97.6 | globlastp |
| LAB675_H1 | switchgrass\|12v1\|DN151324_P1 | 2700 | 7384 | 529 | 97.1 | globlastp |
| LAB675_H2 | foxtail_millet\|11v3\|PHY7SI013034M_P1 | 2701 | 7385 | 529 | 96.6 | globlastp |
| LAB675_H3 | sorghum\|12v1\|SB06G020680 | 2702 | 7386 | 529 | 96.6 | globlastp |
| LAB675_H4 | rice\|11v1\|AU032090 | 2703 | 7387 | 529 | 89.9 | globlastp |
| LAB675_H5 | aristolochia\|10v1\|SRR039082S0029633_P1 | 2704 | 7388 | 529 | 88.5 | globlastp |
| LAB675_H6 | brachypodium\|12v1\|BRADI5G13910_P1 | 2705 | 7389 | 529 | 88 | globlastp |
| LAB675_H67 | banana\|12v1\|FL666095_P1 | 2706 | 7390 | 529 | 87.5 | globlastp |
| LAB675_H7 | rose\|12v1\|BQ104338 | 2707 | 7391 | 529 | 87.1 | globlastp |
| LAB675_H8 | amorphophallus\|11v2\|SRR346502.1025374_T1 | 2708 | 7392 | 529 | 87.02 | glotblastn |
| LAB675_H68 | onion\|12v1\|CF434926_P1 | 2709 | 7393 | 529 | 86.5 | globlastp |
| LAB675_H69 | poplar\|13v1\|AI167041_P1 | 2710 | 7394 | 529 | 86.5 | globlastp |
| LAB675_H9 | poplar\|10v1\|AI167041 | 2711 | 7395 | 529 | 86.12 | glotblastn |
| LAB675_H70 | bean\|12v2\|CA916584_P1 | 2712 | 7396 | 529 | 86.1 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB675_H11 | grape\|11v1\|GSVIVT01010325001_P1 | 2713 | 7397 | 529 | 86.1 | globlastp |
| LAB675_H12 | soybean\|11v1\|GLYMA11G37380 | 2714 | 7398 | 529 | 86.1 | globlastp |
| LAB675_H12 | soybean\|12v1\|GLYMA11G37380_P1 | 2715 | 7398 | 529 | 86.1 | globlastp |
| LAB675_H13 | soybean\|11v1\|GLYMA18G01350 | 2716 | 7399 | 529 | 86.1 | globlastp |
| LAB675_H13 | soybean\|12v1\|GLYMA18G01350_P1 | 2717 | 7399 | 529 | 86.1 | globlastp |
| LAB675_H21 | chickpea\|13v2\|SRR133517.12982_P1 | 2718 | 7400 | 529 | 86.1 | globlastp |
| LAB675_H14 | cacao\|10v1\|CU591694_P1 | 2719 | 7401 | 529 | 85.6 | globlastp |
| LAB675_H15 | cassava\|09v1\|JGICASSAVA11842VALIDM1_P1 | 2720 | 7402 | 529 | 85.6 | globlastp |
| LAB675_H16 | clementine\|11v1\|CV718826_P1 | 2721 | 7403 | 529 | 85.6 | globlastp |
| LAB675_H17 | cotton\|11v1\|BF270786XX1_P1 | 2722 | 7404 | 529 | 85.6 | globlastp |
| LAB675_H18 | gossypium_raimondii\|12v1\|BF270786_P1 | 2723 | 7404 | 529 | 85.6 | globlastp |
| LAB675_H19 | orange\|11v1\|CV718826_P1 | 2724 | 7403 | 529 | 85.6 | globlastp |
| LAB675_H20 | pigeonpea\|11v1\|SRR054580X104885_P1 | 2725 | 7405 | 529 | 85.6 | globlastp |
| LAB675_H21 | chickpea\|11v1\|SRR133520.191624 | 2726 | 7406 | 529 | 85.58 | globtblastn |
| LAB675_H22 | b_rapa\|11v1\|CX189658_P1 | 2727 | 7407 | 529 | 85.2 | globlastp |
| LAB675_H23 | canola\|11v1\|EE453892_P1 | 2728 | 7408 | 529 | 85.2 | globlastp |
| LAB675_H24 | canola\|11v1\|EE465570_P1 | 2729 | 7407 | 529 | 85.2 | globlastp |
| LAB675_H25 | ipomoea_nil\|10v1\|CJ737822_P1 | 2730 | 7409 | 529 | 85.2 | globlastp |
| LAB675_H71 | olea\|13v1\|SRR596247X173472D1_T1 | 2731 | 7410 | 529 | 85.1 | globtblastn |
| LAB675_H72 | sesame\|12v1\|SESI12V1397381_P1 | 2732 | 7411 | 529 | 85.1 | globlastp |
| LAB675_H26 | barley\|10v2\|BG365552 | 2733 | 7412 | 529 | 85.1 | globlastp |
| LAB675_H26 | barley\|12v1\|BG365552_P1 | 2734 | 7412 | 529 | 85.1 | globlastp |
| LAB675_H27 | centaurea\|gb166\|EH729047_P1 | 2735 | 7413 | 529 | 85.1 | globlastp |
| LAB675_H28 | cotton\|11v1\|DR463033_P1 | 2736 | 7414 | 529 | 85.1 | globlastp |
| LAB675_H29 | gossypium_raimondii\|12v1\|DR463033_P1 | 2737 | 7415 | 529 | 85.1 | globlastp |
| LAB675_H30 | medicago\|12v1\|AL371889_P1 | 2738 | 7416 | 529 | 85.1 | globlastp |
| LAB675_H31 | oak\|10v1\|FN721100_P1 | 2739 | 7417 | 529 | 85.1 | globlastp |
| LAB675_H32 | ambrosia\|11v1\|SRR346935.340220_P1 | 2740 | 7418 | 529 | 84.6 | globlastp |
| LAB675_H33 | apple\|11v1\|MDP0000778575_P1 | 2741 | 7419 | 529 | 84.6 | globlastp |
| LAB675_H34 | castorbean\|12v1\|XM_002514921_P1 | 2742 | 7420 | 529 | 84.6 | globlastp |
| LAB675_H35 | cynara\|gb167\|GE599973_P1 | 2743 | 7421 | 529 | 84.6 | globlastp |
| LAB675_H36 | rye\|12v1\|DRR001012.207137 | 2744 | 7422 | 529 | 84.6 | globlastp |
| LAB675_H37 | sunflower\|12v1\|DY921749 | 2745 | 7423 | 529 | 84.6 | globlastp |
| LAB675_H38 | sunflower\|12v1\|EE627136 | 2746 | 7423 | 529 | 84.6 | globlastp |
| LAB675_H39 | trigonella\|11v1\|SRR066194X204719 | 2747 | 7424 | 529 | 84.6 | globlastp |
| LAB675_H40 | wheat\|10v2\|CA643743 | 2748 | 7425 | 529 | 84.6 | globlastp |
| LAB675_H73 | pepper\|12v1\|CA525786_P1 | 2749 | 7426 | 529 | 84.2 | globlastp |
| LAB675_H41 | sunflower\|12v1\|EL488921 | 2750 | 7427 | 529 | 84.13 | globtblastn |
| LAB675_H74 | blueberry\|12v1\|SRR353283X44451D1_P1 | 2751 | 7428 | 529 | 84.1 | globlastp |
| LAB675_H40 | wheat\|12v3\|BE404886_P1 | 2752 | 7429 | 529 | 84.1 | globlastp |
| LAB675_H42 | dandelion\|10v1\|DR402042_P1 | 2753 | 7430 | 529 | 84.1 | globlastp |
| LAB675_H43 | monkeyflower\|10v1\|DV206717 | 2754 | 7431 | 529 | 84.1 | globlastp |
| LAB675_H43 | monkeyflower\|12v1\|DV206717_P1 | 2755 | 7431 | 529 | 84.1 | globlastp |
| LAB675_H44 | poplar\|10v1\|BI135599 | 2756 | 7432 | 529 | 84.1 | globlastp |
| LAB675_H44 | poplar\|13v1\|BI135599_P1 | 2757 | 7432 | 529 | 84.1 | globlastp |
| LAB675_H45 | safflower\|gb162\|EL408381 | 2758 | 7433 | 529 | 84.1 | globlastp |
| LAB675_H75 | lettuce\|12v1\|DW061226_P1 | 2759 | 7434 | 529 | 83.7 | globlastp |
| LAB675_H46 | eucalyptus\|11v2\|SRR001658X12855_P1 | 2760 | 7435 | 529 | 83.7 | globlastp |
| LAB675_H47 | fagopyrum\|11v1\|SRR063689X117737_P1 | 2761 | 7436 | 529 | 83.7 | globlastp |
| LAB675_H48 | lettuce\|10v1\|DW061226 | 2762 | 7434 | 529 | 83.7 | globlastp |
| LAB675_H49 | radish\|gb164\|EV546146 | 2763 | 7437 | 529 | 83.7 | globlastp |
| LAB675_H50 | radish\|gb164\|EW731123 | 2764 | 7438 | 529 | 83.7 | globlastp |
| LAB675_H51 | solanum_phureja\|09v1\|SPHBG135787 | 2765 | 7439 | 529 | 83.7 | globlastp |
| LAB675_H52 | cotton\|11v1\|SRR032367.35220_T1 | 2766 | 7440 | 529 | 83.65 | globtblastn |
| LAB675_H53 | thellungiella_halophilum\|11v1\|EHJGI11019829 | 2767 | 7441 | 529 | 83.3 | globlastp |
| LAB675_H54 | tomato\|11v1\|BG135787 | 2768 | 7442 | 529 | 83.3 | globlastp |
| LAB675_H55 | prunus\|10v1\|CN878790 | 2769 | 7443 | 529 | 83.25 | globtblastn |
| LAB675_H56 | cucurbita\|11v1\|SRR091276X101901_P1 | 2770 | 7444 | 529 | 83.2 | globlastp |
| LAB675_H57 | amborella\|12v3\|SRR038637.355166_P1 | 2771 | 7445 | 529 | 82.7 | globlastp |
| LAB675_H58 | ambrosia\|11v1\|SRR346943.131332_T1 | 2772 | 7446 | 529 | 82.69 | globtblastn |
| LAB675_H59 | cassava\|09v1\|JGICASSAVA15133M1_P1 | 2773 | 7447 | 529 | 82.5 | globlastp |
| LAB675_H60 | arabidopsis\|10v1\|AT3G25980_P1 | 2774 | 7448 | 529 | 82.3 | globlastp |
| LAB675_H61 | beet\|12v1\|BV12V1534509_P1 | 2775 | 7449 | 529 | 82.3 | globlastp |
| LAB675_H62 | artemisia\|10v1\|SRR019254S0211742_P1 | 2776 | 7450 | 529 | 82.2 | globlastp |
| LAB675_H63 | tobacco\|gb162\|CV017227 | 2111 | 7451 | 529 | 81.25 | globtblastn |
| LAB675_H64 | cucurbita\|11v1\|SRR091276X146710_P1 | 2778 | 7452 | 529 | 81.2 | globlastp |
| LAB675_H65 | melon\|10v1\|AM722866_P1 | 2779 | 7453 | 529 | 80.8 | globlastp |
| LAB676_H5 | switchgrass\|12v1\|FE626861_P1 | 2780 | 7454 | 530 | 83.1 | globlastp |
| LAB676_H3 | switchgrass\|gb167\|FE626861 | 2781 | 7454 | 530 | 83.1 | globlastp |
| LAB677_H1 | sorghum\|12v1\|SB06G018390 | 2782 | 7455 | 531 | 82.8 | globlastp |
| LAB678_H1 | sorghum\|12v1\|SB03G010630 | 2783 | 7456 | 532 | 93.8 | globlastp |
| LAB678_H2 | foxtail_millet\|11v3\|PHY7SI000454M_P1 | 2784 | 7457 | 532 | 93.5 | globlastp |
| LAB678_H3 | switchgrass\|gb167\|FE616854 | 2785 | 7458 | 532 | 91.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB678_H4 | rice\|11v1\|AA752999 | 2786 | 7459 | 532 | 87.6 | globlastp |
| LAB678_H5 | brachypodium\|12v1\|BRADI2G10040_P1 | 2787 | 7460 | 532 | 87.2 | globlastp |
| LAB678_H6 | rye\|12v1\|DRR001012.168834 | 2788 | 7461 | 532 | 87.2 | globlastp |
| LAB678_H7 | wheat\|10v2\|BE637505 | 2789 | 7462 | 532 | 87.2 | globlastp |
| LAB678_H9 | wheat\|12v3\|CJ588987_P1 | 2790 | 7463 | 532 | 81.4 | globlastp |
| LAB678_H8 | millet\|10v1\|EVO454PM019163_T1 | 2791 | 7464 | 532 | 80.06 | glotblastn |
| LAB679_H1 | sugarcane\|10v1\|CA116003 | 2792 | 7465 | 533 | 94 | globlastp |
| LAB679_H2 | sorghum\|12v1\|SB05G006160 | 2793 | 7466 | 533 | 93 | globlastp |
| LAB679_H3 | foxtail_millet\|11v3\|PHY7SI026156M_P1 | 2794 | 7467 | 533 | 89.6 | globlastp |
| LAB679_H4 | millet\|10v1\|EVO454PM017929_P1 | 2795 | 7468 | 533 | 88.6 | globlastp |
| LAB679_H6 | switchgrass\|12v1\|FE621446_P1 | 2796 | 7469 | 533 | 88.3 | globlastp |
| LAB679_H5 | maize\|10v1\|BM080434_P1 | 2797 | 7470 | 533 | 88.1 | globlastp |
| LAB679_H11 | switchgrass\|12v1\|FE627552_P1 | 2798 | 7471 | 533 | 87.1 | globlastp |
| LAB679_H6 | switchgrass\|gb167\|FE621446 | 2799 | 7472 | 533 | 86.6 | globlastp |
| LAB679_H7 | barley\|10v2\|BG299288 | 2800 | 7473 | 533 | 81 | globlastp |
| LAB679_H8 | brachypodium\|12v1\|BRADI4G23190_P1 | 2801 | 7474 | 533 | 80.8 | globlastp |
| LAB679_H12 | wheat\|12v3\|BE400518_P1 | 2802 | 7475 | 533 | 80.6 | globlastp |
| LAB679_H9 | wheat\|10v2\|BE400518 | 2803 | 7476 | 533 | 80.6 | globlastp |
| LAB679_H10 | wheat\|10v2\|BE516031 | 2804 | 7477 | 533 | 80.4 | globlastp |
| LAB679_H9, LAB679_H10 | wheat\|12v3\|BE516031_P1 | 2805 | 7478 | 533 | 80.3 | globlastp |
| LAB680_H7 | rice\|11v1\|BE041040 | 2806 | 7479 | 534 | 92 | globlastp |
| LAB680_H14 | oil_palm\|11v1\|GH636163XX1_P1 | 2807 | 7480 | 534 | 83.1 | globlastp |
| LAB680_H18 | banana\|12v1\|FF562231_P1 | 2808 | 7481 | 534 | 80.6 | globlastp |
| LAB680_H16 | phalaenopsis\|11v1\|CB034153_P1 | 2809 | 7482 | 534 | 80.6 | globlastp |
| LAB680_H17 | poppy\|11v1\|SRR030259.105884_T1 | 2810 | 7483 | 534 | 80.43 | glotblastn |
| LAB681_H1 | maize\|10v1\|AY109311_P1 | 2811 | 7484 | 535 | 95.8 | globlastp |
| LAB681_H17 | switchgrass\|12v1\|FE607070_P1 | 2812 | 7485 | 535 | 94.2 | globlastp |
| LAB681_H2 | cynodon\|10v1\|ES300487_P1 | 2813 | 7486 | 535 | 94.2 | globlastp |
| LAB681_H3 | switchgrass\|gb167\|FE607070 | 2814 | 7485 | 535 | 94.2 | globlastp |
| LAB681_H4 | millet\|10v1\|CD725692_P1 | 2815 | 7487 | 535 | 93.3 | globlastp |
| LAB681_H5 | sugarcane\|10v1\|CA228389 | 2816 | 7488 | 535 | 93.3 | globlastp |
| LAB681_H6 | foxtail_millet\|11v3\|EC612789_P1 | 2817 | 7489 | 535 | 92.5 | globlastp |
| LAB681_H7 | rice\|11v1\|GFXAC084319X5 | 2818 | 7490 | 535 | 92.5 | globlastp |
| LAB681_H8 | sorghum\|12v1\|SB01G016440 | 2819 | 7491 | 535 | 92.5 | globlastp |
| LAB681_H9 | barley\|10v2\|BE422135 | 2820 | 7492 | 535 | 90.8 | globlastp |
| LAB681_H10 | wheat\|10v2\|BE604188 | 2821 | 7493 | 535 | 90 | globlastp |
| LAB681_H11 | brachypodium\|12v1\|BRADI1G15760_P1 | 2822 | 7494 | 535 | 89.2 | globlastp |
| LAB681_H12 | pseudoroegneria\|gb167\|FF363392 | 2823 | 7495 | 535 | 89.2 | globlastp |
| LAB681_H13 | rye\|12v1\|DRR001012.217860 | 2824 | 7496 | 535 | 89.2 | globlastp |
| LAB681_H14 | rye\|12v1\|DRR001012.272760 | 2825 | 7496 | 535 | 89.2 | globlastp |
| LAB681_H10, LAB681_H15 | wheat\|12v3\|BE604188_P1 | 2826 | 7497 | 535 | 89.2 | globlastp |
| LAB681_H15 | wheat\|10v2\|BF474954 | 2827 | — | 535 | 88.3 | globlastp |
| LAB681_H16 | oat\|11v1\|GR343370_P1 | 2828 | 7498 | 535 | 87.5 | globlastp |
| LAB682_H1 | sorghum\|12v1\|SB07G002540 | 2829 | 7499 | 536 | 87.6 | globlastp |
| LAB683_H1 | sorghum\|12v1\|SB07G022480 | 2830 | 7500 | 537 | 85.4 | globlastp |
| LAB684_H1 | sorghum\|12v1\|SB03G035190 | 2831 | 7501 | 538 | 97.1 | globlastp |
| LAB684_H2 | foxtail_millet\|11v3\|PHY7SI001007M_P1 | 2832 | 7502 | 538 | 95.4 | globlastp |
| LAB684_H3 | switchgrass\|gb167\|DN148777 | 2833 | 7503 | 538 | 94.8 | globlastp |
| LAB684_H4 | brachypodium\|12v1\|BRADI2G50460_P1 | 2834 | 7504 | 538 | 92.9 | globlastp |
| LAB684_H5 | rice\|11v1\|BI804968 | 2835 | 7505 | 538 | 92.9 | globlastp |
| LAB684_H6 | wheat\|10v2\|BE399172 | 2836 | 7506 | 538 | 92.7 | globlastp |
| LAB684_H6, LAB684_H8 | wheat\|12v3\|BE399172_P1 | 2837 | 7506 | 538 | 92.7 | globlastp |
| LAB684_H7 | rye\|12v1\|DRR001012.148862 | 2838 | 7507 | 538 | 92.6 | globlastp |
| LAB684_H8 | wheat\|10v2\|BE413970 | 2839 | 7508 | 538 | 92.6 | globlastp |
| LAB684_H9 | barley\|10v2\|BI949795 | 2840 | 7509 | 538 | 92.2 | globlastp |
| LAB684_H9 | barley\|12v1\|BI949795_P1 | 2841 | 7509 | 538 | 92.2 | globlastp |
| LAB684_H17 | switchgrass\|12v1\|FE630210_P1 | 2842 | 7510 | 538 | 83.4 | globlastp |
| LAB684_H18 | banana\|12v1\|MAGEN2012006904_P1 | 2843 | 7511 | 538 | 82.6 | globlastp |
| LAB684_H19 | banana\|12v1\|MAGEN2012011409_P1 | 2844 | 7512 | 538 | 82.1 | globlastp |
| LAB684_H10 | oil_palm\|11v1\|EL690470_T1 | 2845 | 7513 | 538 | 81.68 | glotblastn |
| LAB684_H11 | phalaenopsis\|11v1\|SRR125771.1004404_P1 | 2846 | 7514 | 538 | 81.3 | globlastp |
| LAB684_H20 | banana\|12v1\|MAGEN2012033981_P1 | 2847 | 7515 | 538 | 81 | globlastp |
| LAB684_H12 | aristolochia\|10v1\|FD763239_P1 | 2848 | 7516 | 538 | 80.9 | globlastp |
| LAB684_H21 | banana\|12v1\|FL658885_P1 | 2849 | 7517 | 538 | 80.6 | globlastp |
| LAB684_H13 | rice\|11v1\|CA999854 | 2850 | 7518 | 538 | 80.4 | globlastp |
| LAB684_H22 | sesame\|12v1\|SESI12V1372737_P1 | 2851 | 7519 | 538 | 80.3 | globlastp |
| LAB684_H14 | cucumber\|09v1\|DN910773_P1 | 2852 | 7520 | 538 | 80.2 | globlastp |
| LAB684_H15 | monkeyflower\|10v1\|SRR037227S0022628 | 2853 | 7521 | 538 | 80 | globlastp |
| LAB684_H15 | monkeyflower\|12v1\|SRR037227.112598_P1 | 2854 | 7521 | 538 | 80 | globlastp |
| LAB684_H16 | watermelon\|11v1\|VMEL06409116432216 | 2855 | 7522 | 538 | 80 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB685_H1 | sorghum\|12v1\|SB05G002630 | 2856 | 7523 | 539 | 94.2 | globlastp |
| LAB685_H2 | foxtail_millet\|11v3\|PHY7SI009692M_P1 | 2857 | 7524 | 539 | 92.5 | globlastp |
| LAB685_H3 | switchgrass\|gb167\|FL699752 | 2858 | 7525 | 539 | 92.32 | glotblastn |
| LAB685_H4 | foxtail_millet\|11v3\|PHY7SI026158M_P1 | 2859 | 7526 | 539 | 92 | globlastp |
| LAB685_H3 | switchgrass\|12v1\|FL699752_T1 | 2860 | 7527 | 539 | 91.81 | glotblastn |
| LAB685_H5 | rice\|11v1\|AA750137 | 2861 | 7528 | 539 | 86.9 | globlastp |
| LAB685_H6 | rice\|11v1\|CA760354 | 2862 | 7529 | 539 | 86.9 | globlastp |
| LAB685_H7 | brachypodium\|12v1\|BRADI4G43070_P1 | 2863 | 7530 | 539 | 86.6 | globlastp |
| LAB685_H10 | wheat\|12v3\|AL816971_P1 | 2864 | 7531 | 539 | 86.6 | globlastp |
| LAB685_H8 | barley\|10v2\|BG299773 | 2865 | 7532 | 539 | 86.2 | globlastp |
| LAB685_H8 | barley\|12v1\|BG299773_P1 | 2866 | 7532 | 539 | 86.2 | globlastp |
| LAB685_H9 | rye\|12v1\|DRR001012.133899 | 2867 | 7533 | 539 | 85.9 | globlastp |
| LAB685_H10 | wheat\|10v2\|AL816971 | 2868 | 7534 | 539 | 85.4 | globlastp |
| LAB685_H11 | switchgrass\|12v1\|FL968831_T1 | 2869 | 7535 | 539 | 81.39 | glotblastn |
| LAB686_H1 | foxtail_millet\|11v3\|EC613092_P1 | 2870 | 7536 | 540 | 84.2 | globlastp |
| LAB686_H2 | switchgrass\|12v1\|DN142530_P1 | 2871 | 7537 | 540 | 84.2 | globlastp |
| LAB686_H2 | switchgrass\|gb167\|DN142530 | 2872 | 7538 | 540 | 84.2 | globlastp |
| LAB686_H3 | sorghum\|12v1\|SB10G002370 | 2873 | 7539 | 540 | 83.9 | globlastp |
| LAB686_H4 | switchgrass\|12v1\|FE652809_P1 | 2874 | 7540 | 540 | 83.3 | globlastp |
| LAB686_H4 | switchgrass\|gb167\|FE652809 | 2875 | 7540 | 540 | 83.3 | globlastp |
| LAB686_H5 | millet\|10v1\|EVO454PM010164_P1 | 2876 | 7541 | 540 | 83 | globlastp |
| LAB687_H1 | foxtail_millet\|11v3\|SOLX00014586_P1 | 2877 | 7542 | 541 | 92.7 | globlastp |
| LAB687_H2 | sorghum\|12v1\|SB09G028160 | 2878 | 7543 | 541 | 92.7 | globlastp |
| LAB687_H3 | sugarcane\|10v1\|CA094332 | 2879 | 7544 | 541 | 92.59 | glotblastn |
| LAB687_H6 | switchgrass\|12v1\|FE600848_P1 | 2880 | 7545 | 541 | 91.5 | globlastp |
| LAB687_H37 | switchgrass\|12v1\|FL779738_P1 | 2881 | 7546 | 541 | 91.4 | globlastp |
| LAB687_H38 | switchgrass\|12v1\|FE600847_P1 | 2882 | 7547 | 541 | 90.2 | globlastp |
| LAB687_H4 | rice\|11v1\|BI811755 | 2883 | 7548 | 541 | 90.2 | globlastp |
| LAB687_H5 | rice\|11v1\|OSCRP063273 | 2884 | 7548 | 541 | 90.2 | globlastp |
| LAB687_H6 | switchgrass\|gb167\|FE600848 | 2885 | 7549 | 541 | 90.2 | globlastp |
| LAB687_H39 | switchgrass\|12v1\|PV12v1PRD029268_T1 | 2886 | — | 541 | 90.12 | glotblastn |
| LAB687_H40 | switchgrass\|12v1\|SRR408048.128884_P1 | 2887 | 7550 | 541 | 87.8 | globlastp |
| LAB687_H7 | rice\|11v1\|OSCRP038479 | 2888 | 7551 | 541 | 87.8 | globlastp |
| LAB687_H8 | oat\|11v1\|GR342437_P1 | 2889 | 7552 | 541 | 87.7 | globlastp |
| LAB687_H9 | brachypodium\|12v1\|BRADI4G19960T2_P1 | 2890 | 7553 | 541 | 84.1 | globlastp |
| LAB687_H10 | eucalyptus\|11v2\|CT986128_P1 | 2891 | 7554 | 541 | 84 | globlastp |
| LAB687_H11 | wheat\|10v2\|BE493166 | 2892 | 7555 | 541 | 84 | globlastp |
| LAB687_H11 | wheat\|12v3\|CA677345_P1 | 2893 | 7555 | 541 | 84 | globlastp |
| LAB687_H41 | barley\|12v1\|BQ460833_P1 | 2894 | 7556 | 541 | 82.9 | globlastp |
| LAB687_H12 | barley\|10v2\|BQ460833 | 2895 | 7556 | 541 | 82.9 | globlastp |
| LAB687_H13 | cynodon\|10v1\|ES306345_T1 | 2896 | 7557 | 541 | 82.72 | glotblastn |
| LAB687_H14 | sorghum\|12v1\|XM_002440685 | 2897 | 7558 | 541 | 82.72 | glotblastn |
| LAB687_H15 | bupleurum\|11v1\|SRR301254.113180_P1 | 2898 | 7559 | 541 | 82.7 | globlastp |
| LAB687_H16 | papaya\|gb165\|EX264968_P1 | 2899 | 7560 | 541 | 82.7 | globlastp |
| LAB687_H17 | watermelon\|11v1\|AM722624 | 2900 | 7561 | 541 | 82.7 | globlastp |
| LAB687_H18 | wheat\|10v2\|BQ162388 | 2901 | 7562 | 541 | 82.7 | globlastp |
| LAB687_H19 | rye\|12v1\|DRR001012.180020 | 2902 | 7563 | 541 | 81.7 | globlastp |
| LAB687_H42 | nicotiana_benthamiana\|12v1\|AM835788_P1 | 2903 | 7564 | 541 | 81.5 | globlastp |
| LAB687_H20 | beech\|11v1\|SRR364434.195583_P1 | 2904 | 7565 | 541 | 81.5 | globlastp |
| LAB687_H21 | bupleurum\|11v1\|SRR301254.132912_P1 | 2905 | 7566 | 541 | 81.5 | globlastp |
| LAB687_H22 | cowpea\|12v1\|FF385151_P1 | 2906 | 7567 | 541 | 81.5 | globlastp |
| LAB687_H23 | cowpea\|gb166\|FF400922 | 2907 | 7567 | 541 | 81.5 | globlastp |
| LAB687_H24 | cucurbita\|11v1\|SRR091276X125323_P1 | 2908 | 7568 | 541 | 81.5 | globlastp |
| LAB687_H25 | melon\|10v1\|AM721919_P1 | 2909 | 7569 | 541 | 81.5 | globlastp |
| LAB687_H26 | phyla\|11v2\|SRR099035X118819_P1 | 2910 | 7570 | 541 | 81.5 | globlastp |
| LAB687_H27 | poplar\|10v1\|BU871381 | 2911 | 7571 | 541 | 81.5 | globlastp |
| LAB687_H27 | poplar\|13v1\|BU871381_P1 | 2912 | 7571 | 541 | 81.5 | globlastp |
| LAB687_H28 | rye\|12v1\|DRR001012.277585 | 2913 | 7572 | 541 | 80.5 | globlastp |
| LAB687_H43 | nicotiana_benthamiana\|12v1\|EH370596_P1 | 2914 | 7573 | 541 | 80.2 | globlastp |
| LAB687_H29 | cucumber\|09v1\|AM721919_P1 | 2915 | 7574 | 541 | 80.2 | globlastp |
| LAB687_H30 | hornbeam\|12v1\|SRR364455.191699_P1 | 2916 | 7575 | 541 | 80.2 | globlastp |
| LAB687_H31 | peanut\|10v1\|GO259629_P1 | 2917 | 7576 | 541 | 80.2 | globlastp |
| LAB687_H32 | pigeonpea\|11v1\|SRR054580X190183_P1 | 2918 | 7577 | 541 | 80.2 | globlastp |
| LAB687_H33 | primula\|11v1\|SRR098679X103891_P1 | 2919 | 7578 | 541 | 80.2 | globlastp |
| LAB687_H34 | solanum_phureja\|09v1\|SPHES892312 | 2920 | 7579 | 541 | 80.2 | globlastp |
| LAB687_H35 | tea\|10v1\|GE651037 | 2921 | 7580 | 541 | 80.2 | globlastp |
| LAB687_H36 | tobacco\|gb162\|AM835788 | 2922 | 7573 | 541 | 80.2 | globlastp |
| LAB689_H1 | sorghum\|12v1\|SB02G029060 | 2923 | 7581 | 543 | 94.6 | globlastp |
| LAB689_H2 | sugarcane\|10v1\|CA108580 | 2924 | 7582 | 543 | 94.6 | globlastp |
| LAB689_H3 | switchgrass\|gb167\|FE600816 | 2925 | 7583 | 543 | 89.4 | globlastp |
| LAB689_H4 | switchgrass\|gb167\|FE607114 | 2926 | 7584 | 543 | 89.4 | globlastp |
| LAB689_H3, LAB689_H4 | switchgrass\|12v1\|FE600816_P1 | 2927 | 7583 | 543 | 89.4 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB689_H5 | wheat\|10v2\|CA625248 | 2928 | 7585 | 543 | 88.51 | glotblastn |
| LAB689_H6 | foxtail_millet\|11v3\|PHY7SI031396M_P1 | 2929 | 7586 | 543 | 88 | globlastp |
| LAB689_H7 | oat\|11v1\|CN816454_T1 | 2930 | 7587 | 543 | 87.16 | glotblastn |
| LAB689_H8 | millet\|10v1\|EVO454PM002062_P1 | 2931 | 7588 | 543 | 86.1 | globlastp |
| LAB689_H11 | wheat\|12v3\|BE415104_P1 | 2932 | 7589 | 543 | 84.9 | globlastp |
| LAB689_H9 | oat\|11v1\|GO589657_P1 | 2933 | 7590 | 543 | 84.4 | globlastp |
| LAB689_H10 | oat\|11v1\|GO592864_P1 | 2934 | 7591 | 543 | 84.4 | globlastp |
| LAB689_H11 | wheat\|10v2\|BE415104 | 2935 | 7592 | 543 | 84.2 | globlastp |
| LAB689_H12 | brachypodium\|12v1\|BRADI4G34370_P1 | 2936 | 7593 | 543 | 84.1 | globlastp |
| LAB689_H13 | barley\|10v2\|AJ228929 | 2937 | 7594 | 543 | 83.8 | globlastp |
| LAB689_H13 | barley\|12v1\|AJ228929_P1 | 2938 | 7594 | 543 | 83.8 | globlastp |
| LAB689_H14 | pseudoroegneria\|gb167\|FF341080 | 2939 | 7595 | 543 | 83.8 | globlastp |
| LAB689_H15 | rye\|12v1\|DRR001012.133105 | 2940 | 7596 | 543 | 83.8 | globlastp |
| LAB689_H16 | rye\|12v1\|DRR001012.159530 | 2941 | 7597 | 543 | 83.1 | globlastp |
| LAB689_H17 | rice\|11v1\|AA752467 | 2942 | 7598 | 543 | 82.5 | globlastp |
| LAB689_H18 | rye\|12v1\|BE495345 | 2943 | 7599 | 543 | 81.2 | globlastp |
| LAB690_H1 | sugarcane\|10v1\|CA072415 | 2944 | 7600 | 544 | 97.2 | globlastp |
| LAB690_H2 | sorghum\|12v1\|SB01G038560 | 2945 | 7601 | 544 | 96.5 | globlastp |
| LAB690_H3 | foxtail_millet\|11v3\|PHY7SI035270M_P1 | 2946 | 7602 | 544 | 94.5 | globlastp |
| LAB690_H12 | switchgrass\|12v1\|FL697833_P1 | 2947 | 7603 | 544 | 94.1 | globlastp |
| LAB690_H4 | millet\|10v1\|EVO454PM008872_P1 | 2948 | 7604 | 544 | 93.1 | globlastp |
| LAB690_H5 | switchgrass\|gb167\|FE633218 | 2949 | 7605 | 544 | 92.73 | glotblastn |
| LAB690_H5 | switchgrass\|12v1\|FE633218_P1 | 2950 | 7606 | 544 | 92.7 | globlastp |
| LAB690_H6 | rice\|11v1\|OSU55768 | 2951 | 7607 | 544 | 89 | globlastp |
| LAB690_H7 | oat\|11v1\|GO589427_P1 | 2952 | 7608 | 544 | 88.8 | globlastp |
| LAB690_H8 | brachypodium\|12v1\|BRADI1G65630_P1 | 2953 | 7609 | 544 | 88.6 | globlastp |
| LAB690_H9 | rice\|11v1\|D82035 | 2954 | 7610 | 544 | 88.6 | globlastp |
| LAB690_H13 | barley\|12v1\|AV836293_P1 | 2955 | 7611 | 544 | 88.4 | globlastp |
| LAB690_H14 | wheat\|12v3\|AL808704_P1 | 2956 | 7612 | 544 | 87.2 | globlastp |
| LAB690_H15 | wheat\|12v3\|BE592020_P1 | 2957 | 7612 | 544 | 87.2 | globlastp |
| LAB690_H10 | wheat\|10v2\|BE444447 | 2958 | 7612 | 544 | 87.2 | globlastp |
| LAB690_H16 | wheat\|12v3\|BG263813_P1 | 2959 | 7613 | 544 | 87 | globlastp |
| LAB690_H11 | rye\|12v1\|DRR001012.102457 | 2960 | 7614 | 544 | 87 | globlastp |
| LAB692_H1 | sorghum\|12v1\|SB03G043060 | 2961 | 7615 | 546 | 96.4 | globlastp |
| LAB692_H6 | switchgrass\|12v1\|FE657867_P1 | 2962 | 7616 | 546 | 93.1 | globlastp |
| LAB692_H7 | switchgrass\|12v1\|FL729331_T1 | 2963 | 7617 | 546 | 92.85 | glotblastn |
| LAB692_H2 | foxtail_millet\|11v3\|PHY7SI000101M_P1 | 2964 | 7618 | 546 | 92.8 | globlastp |
| LAB692_H3 | rice\|11v1\|C93430 | 2965 | 7619 | 546 | 88.9 | globlastp |
| LAB692_H4 | brachypodium\|12v1\|BRADI2G57967_P1 | 2966 | 7620 | 546 | 88.2 | globlastp |
| LAB692_H5 | barley\|12v1\|AV833881_P1 | 2967 | 7621 | 546 | 86.8 | globlastp |
| LAB692_H5 | barley\|10v2\|AV833881 | 2968 | 7622 | 546 | 86.7 | globlastp |
| LAB693_H1 | maize\|10v1\|AI372139_P1 | 2969 | 7623 | 547 | 95.6 | globlastp |
| LAB693_H2 | sugarcane\|10v1\|AA644745 | 2970 | 7624 | 547 | 91.2 | globlastp |
| LAB693_H3 | sorghum\|12v1\|SB04G000960 | 2971 | 7625 | 547 | 89.7 | globlastp |
| LAB693_H4 | sorghum\|12v1\|SB04G029240 | 2972 | 7626 | 547 | 88.4 | globlastp |
| LAB693_H5 | foxtail_millet\|11v3\|PHY7SI003313M_P1 | 2973 | 7627 | 547 | 88.2 | globlastp |
| LAB693_H6 | switchgrass\|gb167\|FL779138 | 2974 | 7628 | 547 | 87.5 | globlastp |
| LAB693_H6, LAB693_H10 | switchgrass\|12v1\|FE635175_P1 | 2975 | 7628 | 547 | 87.5 | globlastp |
| LAB693_H7 | millet\|10v1\|EVO454PM001550_P1 | 2976 | 7629 | 547 | 86.8 | globlastp |
| LAB693_H8 | cynodon\|10v1\|ES294205_P1 | 2977 | 7630 | 547 | 86 | globlastp |
| LAB693_H9 | lovegrass\|gb167\|EH185159_P1 | 2978 | 7631 | 547 | 86 | globlastp |
| LAB693_H10 | switchgrass\|gb167\|FE635175 | 2979 | 7632 | 547 | 86 | globlastp |
| LAB693_H11 | switchgrass\|gb167\|FE633314 | 2980 | 7633 | 547 | 85.9 | globlastp |
| LAB693_H11 | switchgrass\|12v1\|1FE633314_P1 | 2981 | 7634 | 547 | 84.6 | globlastp |
| LAB693_H12 | foxtail_millet\|11v3\|PHY7SI018665M_P1 | 2982 | 7635 | 547 | 84.4 | globlastp |
| LAB693_H13 | maize\|10v1\|BQ163241_P1 | 2983 | 7636 | 547 | 83.7 | globlastp |
| LAB693_H14 | lovegrass\|gb167\|DN480293_P1 | 2984 | 7637 | 547 | 81.6 | globlastp |
| LAB693_H15 | rice\|11v1\|AA754449 | 2985 | 7638 | 547 | 81.6 | globlastp |
| LAB693_H16 | rye\|12v1\|DRR001012.154309 | 2986 | 7639 | 547 | 80.9 | globlastp |
| LAB693_H17 | oat\|11v1\|GO589172_P1 | 2987 | 7640 | 547 | 80.7 | globlastp |
| LAB693_H18 | pseudoroegneria\|gb167\|FF359042 | 2988 | 7641 | 547 | 80.1 | globlastp |
| LAB693_H19 | wheat\|10v2\|BE424555 | 2989 | 7642 | 547 | 80.1 | globlastp |
| LAB693_H20 | wheat\|10v2\|BE428937 | 2990 | 7641 | 547 | 80.1 | globlastp |
| LAB693_H21 | wheat\|10v2\|SRR043334S0001266 | 2991 | 7643 | 547 | 80.1 | globlastp |
| LAB693_H19, LAB693_H20, LAB693_H21 | wheat\|12v3\|BE398538_P1 | 2992 | 7643 | 547 | 80.1 | globlastp |
| LAB693_H22 | oat\|11v1\|GO586361_P1 | 2993 | 7644 | 547 | 80 | globlastp |
| LAB694_H1 | foxtail_millet\|11v3\|PHY7SI026975M_P1 | 2994 | 548 | 548 | 100 | globlastp |
| LAB694_H2 | sorghum\|12v1\|SB05G007040 | 2995 | 548 | 548 | 100 | globlastp |
| LAB694_H3 | sugarcane\|10v1\|CA112859XX1 | 2996 | 548 | 548 | 100 | globlastp |
| LAB694_H195 | prunus_mume\|13v1\|CB821086_P1 | 2997 | 7645 | 548 | 99.3 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB694_H4 | apple\|11v1\|CN496750_T1 | 2998 | 7646 | 548 | 99.3 | glotblastn |
| LAB694_H5 | beech\|11v1\|FR606329_P1 | 2999 | 7645 | 548 | 99.3 | globlastp |
| LAB694_H6 | beet\|12v1\|BV12V1528255_P1 | 3000 | 7647 | 548 | 99.3 | globlastp |
| LAB694_H7 | cacao\|10v1\|CU472468_P1 | 3001 | 7645 | 548 | 99.3 | globlastp |
| LAB694_H8 | cassava\|09v1\|JGICASSAVA1526VALIDM1_T1 | 3002 | 7648 | 548 | 99.3 | glotblastn |
| LAB694_H9 | castorbean\|12v1\|EE255215_P1 | 3003 | 7645 | 548 | 99.3 | globlastp |
| LAB694_H10 | chestnut\|gb170\|SRR006295S0031341_P1 | 3004 | 7645 | 548 | 99.3 | globlastp |
| LAB694_H11 | euphorbia\|11v1\|DV122250XX1_P1 | 3005 | 7645 | 548 | 99.3 | globlastp |
| LAB694_H12 | heritiera\|10v1\|SRR005794S0002990_P1 | 3006 | 7645 | 548 | 99.3 | globlastp |
| LAB694_H13 | humulus\|11v1\|EX516771_P1 | 3007 | 7645 | 548 | 99.3 | globlastp |
| LAB694_H14 | oak\|10v1\|FP028821_P1 | 3008 | 7645 | 548 | 99.3 | globlastp |
| LAB694_H15 | papaya\|gb165\|EX259283_P1 | 3009 | 7645 | 548 | 99.3 | globlastp |
| LAB694_H16 | prunus\|10v1\|CB821086 | 3010 | 7645 | 548 | 99.3 | globlastp |
| LAB694_H17 | spurge\|gb161\|DV122250 | 3011 | 7645 | 548 | 99.3 | globlastp |
| LAB694_H18 | strawberry\|11v1\|DY672990 | 3012 | 7645 | 548 | 99.3 | globlastp |
| LAB694_H19 | switchgrass\|12v1\|DN141012_P1 | 3013 | 7649 | 548 | 99.3 | globlastp |
| LAB694_H19 | switchgrass\|gb167\|DN141012 | 3014 | 7649 | 548 | 99.3 | globlastp |
| LAB694_H20 | switchgrass\|gb167\|FL953740 | 3015 | 7649 | 548 | 99.3 | globlastp |
| LAB694_H196 | wheat\|12v3\|BE404291_P1 | 3016 | 7650 | 548 | 98.6 | globlastp |
| LAB694_H21 | barley\|10v2\|BE216724 | 3017 | 7650 | 548 | 98.6 | globlastp |
| LAB694_H22 | brachypodium\|12v1\|BRADI4G40287_P1 | 3018 | 7650 | 548 | 98.6 | globlastp |
| LAB694_H23 | cannabis\|12v1\|JK501983_P1 | 3019 | 7651 | 548 | 98.6 | globlastp |
| LAB694_H24 | chickpea\|11v1\|SRR133517.195513 | 3020 | 7652 | 548 | 98.6 | globlastp |
| LAB694_H24 | chickpea\|13v2\|SRR133517.103174_P1 | 3021 | 7652 | 548 | 98.6 | globlastp |
| LAB694_H25 | clementine\|11v1\|CF831846_P1 | 3022 | 7653 | 548 | 98.6 | globlastp |
| LAB694_H26 | cotton\|11v1\|AY273900XX1_P1 | 3023 | 7654 | 548 | 98.6 | globlastp |
| LAB694_H27 | cucumber\|09v1\|DV634835_P1 | 3024 | 7655 | 548 | 98.6 | globlastp |
| LAB694_H28 | cucurbita\|11v1\|FG227008_P1 | 3025 | 7655 | 548 | 98.6 | globlastp |
| LAB694_H29 | euonymus\|11v1\|SRR070038X168347_P1 | 3026 | 7656 | 548 | 98.6 | globlastp |
| LAB694_H30 | euonymus\|11v1\|SRR070038X317309_P1 | 3027 | 7651 | 548 | 98.6 | globlastp |
| LAB694_H31 | fescue\|gb161\|DT709312_P1 | 3028 | 7650 | 548 | 98.6 | globlastp |
| LAB694_H32 | gossypium_raimondii\|12v1\|AY273900_P1 | 3029 | 7654 | 548 | 98.6 | globlastp |
| LAB694_H33 | leymus\|gb166\|EG375011_P1 | 3030 | 7650 | 548 | 98.6 | globlastp |
| LAB694_H34 | lolium\|10v1\|AU249760_P1 | 3031 | 7650 | 548 | 98.6 | globlastp |
| LAB694_H35 | maize\|10v1\|CF040831_P1 | 3032 | 7657 | 548 | 98.6 | globlastp |
| LAB694_H36 | medicago\|12v1\|BF634954_P1 | 3033 | 7652 | 548 | 98.6 | globlastp |
| LAB694_H37 | medicago\|12v1\|GE352227_P1 | 3034 | 7652 | 548 | 98.6 | globlastp |
| LAB694_H38 | melon\|10v1\|DV634835_P1 | 3035 | 7655 | 548 | 98.6 | globlastp |
| LAB694_H39 | millet\|10v1\|EVO454PM027517_P1 | 3036 | 7658 | 548 | 98.6 | globlastp |
| LAB694_H40 | oat\|11v1\|GO595130_P1 | 3037 | 7650 | 548 | 98.6 | globlastp |
| LAB694_H41 | orange\|11v1\|CF831846_P1 | 3038 | 7653 | 548 | 98.6 | globlastp |
| LAB694_H42 | peanut\|10v1\|GO258592_P1 | 3039 | 7652 | 548 | 98.6 | globlastp |
| LAB694_H43 | rice\|11v1\|AF443601 | 3040 | 7659 | 548 | 98.6 | globlastp |
| LAB694_H44 | rye\|12v1\|DRR001012.134935 | 3041 | 7650 | 548 | 98.6 | globlastp |
| LAB694_H45 | silene\|11v1\|GH295102 | 3042 | 7660 | 548 | 98.6 | globlastp |
| LAB694_H46 | sorghum\|12v1\|SB08G006500 | 3043 | 7659 | 548 | 98.6 | globlastp |
| LAB694_H47 | soybean\|11v1\|GLYMA14G40430 | 3044 | 7661 | 548 | 98.6 | globlastp |
| LAB694_H47 | soybean\|12v1\|GLYMA14G40430T2_P1 | 3045 | 7661 | 548 | 98.6 | globlastp |
| LAB694_H48 | trigonella\|11v1\|SRR066194X112195 | 3046 | 7652 | 548 | 98.6 | globlastp |
| LAB694_H49 | watermelon\|11v1\|DV634835 | 3047 | 7655 | 548 | 98.6 | globlastp |
| LAB694_H50 | wheat\|10v2\|BE404291 | 3048 | 7650 | 548 | 98.6 | globlastp |
| LAB694_H51 | hevea\|10v1\|EC608004_T1 | 3049 | 7662 | 548 | 98.59 | glotblastn |
| LAB694_H197 | bean\|12v2\|CA907762_P1 | 3050 | 7663 | 548 | 97.9 | globlastp |
| LAB694_H52 | bean\|12v1\|CA907762 | 3051 | 7663 | 548 | 97.9 | globlastp |
| LAB694_H53 | brachypodium\|12v1\|BRADI4G21080_P1 | 3052 | 7664 | 548 | 97.9 | globlastp |
| LAB694_H54 | cleome_gynandra\|10v1\|SRR015532S0022054_P1 | 3053 | 7665 | 548 | 97.9 | globlastp |
| LAB694_H55 | cleome_spinosa\|10v1\|SRR015531S0047808_P1 | 3054 | 7665 | 548 | 97.9 | globlastp |
| LAB694_H56 | cowpea\|12v1\|FC460339_P1 | 3055 | 7663 | 548 | 97.9 | globlastp |
| LAB694_H56 | cowpea\|gb166\|FC460339 | 3056 | 7663 | 548 | 97.9 | globlastp |
| LAB694_H57 | cyamopsis\|10v1\|EG975466_P1 | 3057 | 7666 | 548 | 97.9 | globlastp |
| LAB694_H58 | cynodon\|10v1\|ES299836_P1 | 3058 | 7667 | 548 | 97.9 | globlastp |
| LAB694_H59 | foxtail_millet\|11v3\|PHY7SI023579M_P1 | 3059 | 7668 | 548 | 97.9 | globlastp |
| LAB694_H60 | lotus\|09v1\|LLAV778204_P1 | 3060 | 7663 | 548 | 97.9 | globlastp |
| LAB694_H61 | lovegrass\|gb167\|EH185358_P1 | 3061 | 7669 | 548 | 97.9 | globlastp |
| LAB694_H62 | nasturtium\|11v1\|SRR032558.109441_P1 | 3062 | 7670 | 548 | 97.9 | globlastp |
| LAB694_H63 | oat\|11v1\|CN814910_P1 | 3063 | 7671 | 548 | 97.9 | globlastp |
| LAB694_H64 | oil_palm\|11v1\|EL691369_P1 | 3064 | 7672 | 548 | 97.9 | globlastp |
| LAB694_H65 | oil_palm\|11v1\|SRR190698.155291_P1 | 3065 | 7672 | 548 | 97.9 | globlastp |
| LAB694_H66 | pigeonpea\|11v1\|SRR054580X111872_P1 | 3066 | 7663 | 548 | 97.9 | globlastp |
| LAB694_H67 | poplar\|10v1\|BI120072 | 3067 | 7673 | 548 | 97.9 | globlastp |
| LAB694_H67 | poplar\|13v1\|BI120072_P1 | 3068 | 7673 | 548 | 97.9 | globlastp |
| LAB694_H68 | poplar\|10v1\|BU881768 | 3069 | 7674 | 548 | 97.9 | globlastp |
| LAB694_H68 | poplar\|13v1\|BI129424_P1 | 3070 | 7674 | 548 | 97.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB694_H69 | poppy\|11v1\|SRR030259.121018_P1 | 3071 | 7675 | 548 | 97.9 | globlastp |
| LAB694_H70 | rhizophora\|10v1\|SRR005793S0006666 | 3072 | 7676 | 548 | 97.9 | globlastp |
| LAB694_H71 | soybean\|11v1\|GLYMA17G37730 | 3073 | 7663 | 548 | 97.9 | globlastp |
| LAB694_H71 | soybean\|12v1\|GLYMA17G37730_P1 | 3074 | 7663 | 548 | 97.9 | globlastp |
| LAB694_H72 | sugarcane\|10v1\|CA073458 | 3075 | 7677 | 548 | 97.9 | globlastp |
| LAB694_H73 | switchgrass\|gb167\|FL770052 | 3076 | 7678 | 548 | 97.9 | globlastp |
| LAB694_H74 | tripterygium\|11v1\|SRR098677X129706 | 3077 | 7679 | 548 | 97.9 | globlastp |
| LAB694_H198 | onion\|12v1\|SRR073446X114144D1_P1 | 3078 | 7680 | 548 | 97.2 | globlastp |
| LAB694_H199 | zostera\|12v1\|AM769512_P1 | 3079 | 7681 | 548 | 97.2 | globlastp |
| LAB694_H75 | acacia\|10v1\|FS587854_P1 | 3080 | 7682 | 548 | 97.2 | globlastp |
| LAB694_H76 | aristolochia\|10v1\|FD751198_P1 | 3081 | 7681 | 548 | 97.2 | globlastp |
| LAB694_H77 | coffea\|10v1\|EE196618_P1 | 3082 | 7683 | 548 | 97.2 | globlastp |
| LAB694_H78 | eschscholzia\|11v1\|CD478156_P1 | 3083 | 7684 | 548 | 97.2 | globlastp |
| LAB694_H79 | eucalyptus\|11v2\|CT985757_P1 | 3084 | 7685 | 548 | 97.2 | globlastp |
| LAB694_H80 | fagopyrum\|11v1\|SRR063689X146746_P1 | 3085 | 7686 | 548 | 97.2 | globlastp |
| LAB694_H81 | fagopyrum\|11v1\|SRR063703X148072_P1 | 3086 | 7686 | 548 | 97.2 | globlastp |
| LAB694_H82 | flax\|11v1\|GW867762_P1 | 3087 | 7687 | 548 | 97.2 | globlastp |
| LAB694_H83 | flax\|11v1\|JG021336_P1 | 3088 | 7687 | 548 | 97.2 | globlastp |
| LAB694_H84 | ginger\|gb164\|DY345753_P1 | 3089 | 7688 | 548 | 97.2 | globlastp |
| LAB694_H85 | ginseng\|10v1\|GR872664_P1 | 3090 | 7683 | 548 | 97.2 | globlastp |
| LAB694_H86 | monkeyflower\|10v1\|GO977963 | 3091 | 7689 | 548 | 97.2 | globlastp |
| LAB694_H86 | monkeyflower\|12v1\|GR107730_P1 | 3092 | 7689 | 548 | 97.2 | globlastp |
| LAB694_H87 | phalaenopsis\|11v1\|SRR125771.1298511_P1 | 3093 | 7690 | 548 | 97.2 | globlastp |
| LAB694_H88 | plantago\|11v2\|SRR066373X154054_P1 | 3094 | 7683 | 548 | 97.2 | globlastp |
| LAB694_H89 | tabernaemontana\|11v1\|SRR098689X119104 | 3095 | 7683 | 548 | 97.2 | globlastp |
| LAB694_H90 | valeriana\|11v1\|SRR099039X12880 | 3096 | 7691 | 548 | 97.2 | globlastp |
| LAB694_H91 | zostera\|10v1\|AM769512 | 3097 | 7681 | 548 | 97.2 | globlastp |
| LAB694_H200 | b_juncea\|12v1\|E6ANDIZ01CFKST_P1 | 3098 | 7692 | 548 | 96.5 | globlastp |
| LAB694_H201 | olea\|13v1\|SRR592583X120850D1_P1 | 3099 | 7693 | 548 | 96.5 | globlastp |
| LAB694_H92 | ambrosia\|11v1\|SRR346935.501299_P1 | 3100 | 7694 | 548 | 96.5 | globlastp |
| LAB694_H93 | amorphophallus\|11v2\|SRR089351X152278_P1 | 3101 | 7695 | 548 | 96.5 | globlastp |
| LAB694_H94 | amsonia\|11v1\|SRR098688X104811_P1 | 3102 | 7696 | 548 | 96.5 | globlastp |
| LAB694_H95 | b_juncea\|10v2\|E6ANDIZ01BSMB1 | 3103 | 7692 | 548 | 96.5 | globlastp |
| LAB694_H96 | b_juncea\|10v2\|E6ANDIZ02GYOM9 | 3104 | 7697 | 548 | 96.5 | globlastp |
| LAB694_H97 | b_oleracea\|gb161\|AM060664_P1 | 3105 | 7692 | 548 | 96.5 | globlastp |
| LAB694_H98 | b_rapa\|11v1\|CD812122_P1 | 3106 | 7692 | 548 | 96.5 | globlastp |
| LAB694_H99 | b_rapa\|11v1\|CX191685_P1 | 3107 | 7697 | 548 | 96.5 | globlastp |
| LAB694_H100 | banana\|10v1\|BBS858T3 | 3108 | 7698 | 548 | 96.5 | globlastp |
| LAB694_H101 | canola\|11v1\|CN731514_P1 | 3109 | 7692 | 548 | 96.5 | globlastp |
| LAB694_H102 | canola\|11v1\|DY024877_P1 | 3110 | 7692 | 548 | 96.5 | globlastp |
| LAB694_H103 | canola\|11v1\|EE456290_P1 | 3111 | 7697 | 548 | 96.5 | globlastp |
| LAB694_H104 | canola\|11v1\|EE475817_P1 | 3112 | 7697 | 548 | 96.5 | globlastp |
| LAB694_H105 | flaveria\|11v1\|SRR149229.204976_P1 | 3113 | 7694 | 548 | 96.5 | globlastp |
| LAB694_H106 | grape\|11v1\|GSVIVT01018785001_P1 | 3114 | 7699 | 548 | 96.5 | globlastp |
| LAB694_H107 | guizotia\|10v1\|GE558589_P1 | 3115 | 7694 | 548 | 96.5 | globlastp |
| LAB694_H108 | phyla\|11v2\|SRR099035X10510_P1 | 3116 | 7693 | 548 | 96.5 | globlastp |
| LAB694_H109 | phyla\|11v2\|SRR099037X116576_P1 | 3117 | 7700 | 548 | 96.5 | globlastp |
| LAB694_H110 | poppy\|11v1\|SRR030259.115119_P1 | 3118 | 7701 | 548 | 96.5 | globlastp |
| LAB694_H111 | poppy\|11v1\|SRR030259.117304_P1 | 3119 | 7701 | 548 | 96.5 | globlastp |
| LAB694_H112 | poppy\|11v1\|SRR030259.119827_P1 | 3120 | 7701 | 548 | 96.5 | globlastp |
| LAB694_H113 | radish\|gb164\|EV545467 | 3121 | 7697 | 548 | 96.5 | globlastp |
| LAB694_H114 | radish\|gb164\|EW726273 | 3122 | 7697 | 548 | 96.5 | globlastp |
| LAB694_H115 | salvia\|10v1\|SRR014553S0006774 | 3123 | 7700 | 548 | 96.5 | globlastp |
| LAB694_H116 | sarracenia\|11v1\|SRR192669.184054 | 3124 | 7702 | 548 | 96.5 | globlastp |
| LAB694_H117 | sunflower\|12v1\|DY905323 | 3125 | 7694 | 548 | 96.5 | globlastp |
| LAB694_H118 | utricularia\|11v1\|SRR094438.112373 | 3126 | 7693 | 548 | 96.5 | globlastp |
| LAB694_H119 | vinca\|11v1\|SRR098690X116075 | 3127 | 7703 | 548 | 96.5 | globlastp |
| LAB694_H152 | monkeyflower\|12v1\|SRR037227.142254_P1 | 3128 | 7704 | 548 | 96.5 | globlastp |
| LAB694_H202 | b_juncea\|12v1\|E6ANDIZ01BSMB1_P1 | 3129 | 7705 | 548 | 95.8 | globlastp |
| LAB694_H203 | lettuce\|12v1\|DW051620_P1 | 3130 | 7706 | 548 | 95.8 | globlastp |
| LAB694_H204 | nicotiana_benthamiana\|12v1\|EB678422_P1 | 3131 | 7707 | 548 | 95.8 | globlastp |
| LAB694_H205 | olea\|13v1\|SRR014463X14404D1_P1 | 3132 | 7708 | 548 | 95.8 | globlastp |
| LAB694_H120 | amborella\|12v2\|FD434153 | 3133 | 7709 | 548 | 95.8 | globlastp |
| LAB694_H120 | amborella\|12v3\|FD431880_P1 | 3134 | 7709 | 548 | 95.8 | globlastp |
| LAB694_H121 | artemisia\|10v1\|EY036010_P1 | 3135 | 7706 | 548 | 95.8 | globlastp |
| LAB694_H122 | centaurea\|gb166\|EH740157_P1 | 3136 | 7706 | 548 | 95.8 | globlastp |
| LAB694_H123 | centaurea\|gb166\|EH763796_P1 | 3137 | 7706 | 548 | 95.8 | globlastp |
| LAB694_H124 | ceratodon\|10v1\|SRR074890S0075823_P1 | 3138 | 7710 | 548 | 95.8 | globlastp |
| LAB694_H125 | ceratodon\|10v1\|SRR074890S0109969_P1 | 3139 | 7710 | 548 | 95.8 | globlastp |
| LAB694_H126 | cichorium\|gb171\|EH707098_P1 | 3140 | 7706 | 548 | 95.8 | globlastp |
| LAB694_H127 | cirsium\|11v1\|SRR346952.10989_P1 | 3141 | 7706 | 548 | 95.8 | globlastp |
| LAB694_H128 | cirsium\|11v1\|SRR346952.1140614_P1 | 3142 | 7706 | 548 | 95.8 | globlastp |
| LAB694_H129 | cynara\|gb167\|GE586596_P1 | 3143 | 7706 | 548 | 95.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB694_H130 | eggplant\|10v1\|FS007058_P1 | 3144 | 7707 | 548 | 95.8 | globlastp |
| LAB694_H131 | fraxinus\|11v1\|FR644488_P1 | 3145 | 7711 | 548 | 95.8 | globlastp |
| LAB694_H132 | gerbera\|09v1\|AJ750857_P1 | 3146 | 7712 | 548 | 95.8 | globlastp |
| LAB694_H133 | ipomoea_batatas\|10v1\|EE876602_P1 | 3147 | 7713 | 548 | 95.8 | globlastp |
| LAB694_H134 | ipomoea_nil\|10v1\|CJ737915_P1 | 3148 | 7713 | 548 | 95.8 | globlastp |
| LAB694_H135 | kiwi\|gb166\|FG409618_P1 | 3149 | 7714 | 548 | 95.8 | globlastp |
| LAB694_H136 | lettuce\|10v1\|DW051620 | 3150 | 7706 | 548 | 95.8 | globlastp |
| LAB694_H137 | marchantia\|gb166\|BJ847803_P1 | 3151 | 7715 | 548 | 95.8 | globlastp |
| LAB694_H138 | orobanche\|10v1\|SRR023189S0022046_P1 | 3152 | 7716 | 548 | 95.8 | globlastp |
| LAB694_H139 | pepper\|gb171\|CA526095 | 3153 | 7707 | 548 | 95.8 | globlastp |
| LAB694_H140 | physcomitrella\|10v1\|BI436677_P1 | 3154 | 7717 | 548 | 95.8 | globlastp |
| LAB694_H141 | radish\|gb164\|EV537666 | 3155 | 7718 | 548 | 95.8 | globlastp |
| LAB694_H142 | radish\|gb164\|EX894968 | 3156 | 7718 | 548 | 95.8 | globlastp |
| LAB694_H143 | radish\|gb164\|EX905361 | 3157 | 7718 | 548 | 95.8 | globlastp |
| LAB694_H144 | safflower\|gb162\|EL407116 | 3158 | 7706 | 548 | 95.8 | globlastp |
| LAB694_H145 | solanum_phureja\|09v1\|SPHAW035089 | 3159 | 7707 | 548 | 95.8 | globlastp |
| LAB694_H146 | tobacco\|gb162\|EB678422 | 3160 | 7707 | 548 | 95.8 | globlastp |
| LAB694_H147 | tomato\|11v1\|AW035089 | 3161 | 7707 | 548 | 95.8 | globlastp |
| LAB694_H148 | tragopogon\|10v1\|SRR020205S0010100 | 3162 | 7706 | 548 | 95.8 | globlastp |
| LAB694_H149 | triphysaria\|10v1\|EY009345 | 3163 | 7719 | 548 | 95.8 | globlastp |
| LAB694_H206 | onion\|12v1\|SRR073446X122006D1_T1 | 3164 | 7720 | 548 | 95.77 | glotblastn |
| LAB694_H150 | antirrhinum\|gb166\|AJ800387_T1 | 3165 | — | 548 | 95.77 | glotblastn |
| LAB694_H151 | bupleurum\|11v1\|SRR301254.101222_T1 | 3166 | — | 548 | 95.77 | glotblastn |
| LAB694_H152 | monkeyflower\|10v1\|SRR037227S0060648 | 3167 | — | 548 | 95.77 | glotblastn |
| LAB694_H152 | monkeyflower\|12v1\|SRR037227.142254_T1 | 3168 | — | 548 | 95.77 | glotblastn |
| LAB694_H153 | cassava\|09v1\|JGICASSAVA18156VALIDM1_P1 | 3169 | 7721 | 548 | 95.2 | globlastp |
| LAB694_H207 | banana\|12v1\|BBS858T3_P1 | 3170 | 7722 | 548 | 95.1 | globlastp |
| LAB694_H208 | nicotiana_benthamiana\|12v1\|AM810338_P1 | 3171 | 7723 | 548 | 95.1 | globlastp |
| LAB694_H154 | arabidopsis_lyrata\|09v1\|JGIAL004125_P1 | 3172 | 7724 | 548 | 95.1 | globlastp |
| LAB694_H155 | arabidopsis\|10v1\|AT1G47830_P1 | 3173 | 7724 | 548 | 95.1 | globlastp |
| LAB694_H156 | cryptomeria\|gb166\|BP175884_P1 | 3174 | 7725 | 548 | 95.1 | globlastp |
| LAB694_H157 | physcomitrella\|10v1\|BQ041834_P1 | 3175 | 7726 | 548 | 95.1 | globlastp |
| LAB694_H158 | radish\|gb164\|EY911232 | 3176 | 7727 | 548 | 95.1 | globlastp |
| LAB694_H159 | valeriana\|11v1\|SRR099039X102186 | 3177 | 7728 | 548 | 95.1 | globlastp |
| LAB694_H160 | primula\|11v1\|SRR098679X115451_T1 | 3178 | 7729 | 548 | 95.07 | glotblastn |
| LAB694_H161 | sarracenia\|11v1\|SRR192669.120878 | 3179 | 7730 | 548 | 95.07 | glotblastn |
| LAB694_H209 | blueberry\|12v1\|SRR353282X35870D1_T1 | 3180 | — | 548 | 95.07 | glotblastn |
| LAB694_H162 | bupleurum\|11v1\|SRR301254.134612_T1 | 3181 | — | 548 | 95.07 | glotblastn |
| LAB694_H163 | gnetum\|10v1\|SRR064399S0006898_P1 | 3182 | 7731 | 548 | 94.4 | globlastp |
| LAB694_H164 | maritime_pine\|10v1\|SRR073317S0017091_P1 | 3183 | 7732 | 548 | 94.4 | globlastp |
| LAB694_H165 | petunia\|gb171\|FN003954_P1 | 3184 | 7733 | 548 | 94.4 | globlastp |
| LAB694_H166 | pine\|10v2\|AI813210_P1 | 3185 | 7732 | 548 | 94.4 | globlastp |
| LAB694_H167 | pseudotsuga\|10v1\|SRR065119S0008047 | 3186 | 7732 | 548 | 94.4 | globlastp |
| LAB694_H168 | spikemoss\|gb165\|FE483659 | 3187 | 7734 | 548 | 94.4 | globlastp |
| LAB694_H169 | spruce\|11v1\|CO239102 | 3188 | 7732 | 548 | 94.4 | globlastp |
| LAB694_H170 | spruce\|11v1\|ES857773 | 3189 | 7732 | 548 | 94.4 | globlastp |
| LAB694_H210 | wheat\|12v3\|CA686278_P1 | 3190 | 7735 | 548 | 93.7 | globlastp |
| LAB694_H171 | abies\|11v2\|SRR098676X108535_P1 | 3191 | 7736 | 548 | 93.7 | globlastp |
| LAB694_H172 | podocarpus\|10v1\|SRR065014S0127784_P1 | 3192 | 7737 | 548 | 93.7 | globlastp |
| LAB694_H173 | pteridium\|11v1\|SRR043594X135194 | 3193 | 7738 | 548 | 93.7 | globlastp |
| LAB694_H174 | sarracenia\|11v1\|SRR192669.112327 | 3194 | 7739 | 548 | 93.7 | globlastp |
| LAB694_H175 | spikemoss\|gb165\|DN838907 | 3195 | 7740 | 548 | 93.7 | globlastp |
| LAB694_H176 | platanus\|11v1\|SRR096786X112983_T1 | 3196 | 7741 | 548 | 91.55 | glotblastn |
| LAB694_H211 | nicotiana_benthamiana\|12v1\|FS393800_P1 | 3197 | 7742 | 548 | 91.5 | globlastp |
| LAB694_H177 | arnica\|11v1\|SRR099034X10013_P1 | 3198 | 7743 | 548 | 91.5 | globlastp |
| LAB694_H178 | momordica\|10v1\|SRR071315S0031575_P1 | 3199 | 7744 | 548 | 91.2 | globlastp |
| LAB694_H179 | thellungiella_halophilum\|11v1\|BY815295 | 3200 | 7745 | 548 | 91.2 | globlastp |
| LAB694_H180 | thellungiella_halophilum\|11v1\|EHJGI11028290 | 3201 | 7746 | 548 | 90.6 | globlastp |
| LAB694_H181 | avocado\|10v1\|CO997229_P1 | 3202 | 7747 | 548 | 90.1 | globlastp |
| LAB694_H182 | peanut\|10v1\|ES720451_P1 | 3203 | 7748 | 548 | 90.1 | globlastp |
| LAB694_H183 | wheat\|10v2\|CA619060 | 3204 | 7749 | 548 | 88.89 | glotblastn |
| LAB694_H184 | sequoia\|10v1\|SRR065044S0010927 | 3205 | 7750 | 548 | 88.73 | glotblastn |
| LAB694_H185 | grape\|11v1\|EC946505_P1 | 3206 | 7751 | 548 | 88 | globlastp |
| LAB694_H186 | curcuma\|10v1\|DY384636_P1 | 3207 | 7752 | 548 | 87.3 | globlastp |
| LAB694_H187 | fern\|gb171\|DK954821_P1 | 3208 | 7753 | 548 | 87.3 | globlastp |
| LAB694_H188 | fescue\|gb161\|DT714279_P1 | 3209 | 7754 | 548 | 85.9 | globlastp |
| LAB694_H189 | cephalotaxus\|11v1\|SRR064395X245354_P1 | 3210 | 7755 | 548 | 84.8 | globlastp |
| LAB694_H190 | canola\|11v1\|EV010615_P1 | 3211 | 7756 | 548 | 84.5 | globlastp |
| LAB694_H191 | catharanthus\|11v1\|EG562525_P1 | 3212 | 7757 | 548 | 83.9 | globlastp |
| LAB694_H192 | cichorium\|gb171\|EH710523_T1 | 3213 | — | 548 | 83.8 | glotblastn |
| LAB694_H193 | phyla\|11v2\|SRR099037X132061_P1 | 3214 | 7758 | 548 | 82.4 | globlastp |
| LAB694_H194 | dandelion\|10v1\|DY827100_T1 | 3215 | — | 548 | 81.29 | glotblastn |
| LAB695_H1 | sorghum\|12v1\|SB04G006540 | 3216 | 7759 | 549 | 92.7 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB695_H2 | sugarcane\|10v1\|CA100382 | 3217 | 7760 | 549 | 91.6 | globlastp |
| LAB695_H3 | switchgrass\|gb167\|FL701429 | 3218 | 7761 | 549 | 90.1 | globlastp |
| LAB695_H4 | maize\|10v1\|CB924276_P1 | 3219 | 7762 | 549 | 89.3 | globlastp |
| LAB695_H3 | switchgrass\|12v1\|FL701429_P1 | 3220 | 7763 | 549 | 88.8 | globlastp |
| LAB695_H5 | foxtail_millet\|11v3\|PHY7SI017983M_P1 | 3221 | 7764 | 549 | 86.9 | globlastp |
| LAB695_H11 | switchgrass\|12v1\|FL924134_P1 | 3222 | 7765 | 549 | 86.3 | globlastp |
| LAB695_H6 | rice\|11v1\|AU166398 | 3223 | 7766 | 549 | 83.2 | globlastp |
| LAB695_H7 | brachypodium\|12v1\|BRADI3G07070_P1 | 3224 | 7767 | 549 | 82.2 | globlastp |
| LAB695_H8 | millet\|10v1\|EVO454PM127147_P1 | 3225 | 7768 | 549 | 81.7 | globlastp |
| LAB695_H9 | rye\|12v1\|DRR001012.111811 | 3226 | 7769 | 549 | 81.1 | globlastp |
| LAB695_H10 | wheat\|10v2\|BE423238 | 3227 | 7770 | 549 | 81 | globlastp |
| LAB695_H10 | wheat\|12v3\|BE423238_P1 | 3228 | 7771 | 549 | 80.6 | globlastp |
| LAB696_H1 | sorghum\|12v1\|SB06G017320 | 3229 | 7772 | 550 | 95.6 | globlastp |
| LAB696_H2 | foxtail_millet\|11v3\|PHY7SI010524M_P1 | 3230 | 7773 | 550 | 91.8 | globlastp |
| LAB696_H3 | millet\|10v1\|EVO454PM032452_P1 | 3231 | 7774 | 550 | 90.6 | globlastp |
| LAB696_H4 | leymus\|gb166\|EG381869_P1 | 3232 | 7775 | 550 | 84.1 | globlastp |
| LAB696_H5 | brachypodium\|12v1\|BRADI5G10730_P1 | 3233 | 7776 | 550 | 83.8 | globlastp |
| LAB696_H6 | rice\|11v1\|AU064635 | 3234 | 7777 | 550 | 83.5 | globlastp |
| LAB696_H7 | barley\|10v2\|BM817310 | 3235 | 7778 | 550 | 83.2 | globlastp |
| LAB696_H7 | barley\|12v1\|BM817310_P1 | 3236 | 7778 | 550 | 83.2 | globlastp |
| LAB696_H8, LAB696_H10 | wheat\|12v3\|AL821258_P1 | 3237 | 7779 | 550 | 83.2 | globlastp |
| LAB696_H11 | switchgrass\|12v1\|SRR187765.633226_T1 | 3238 | 7780 | 550 | 83.09 | glotblastn |
| LAB696_H8 | wheat\|10v2\|AL821258 | 3239 | 7781 | 550 | 82.9 | globlastp |
| LAB696_H9 | rye\|12v1\|BE494540 | 3240 | 7782 | 550 | 82.6 | globlastp |
| LAB696_H10 | wheat\|10v2\|CA619481 | 3241 | 7783 | 550 | 81.7 | globlastp |
| LAB697_H1 | wheat\|10v2\|CA617636 | 3242 | 7784 | 551 | 100 | glotblastn |
| LAB697_H2 | lovegrass\|gb167\|DN481243_P1 | 3243 | 7785 | 551 | 90.7 | globlastp |
| LAB697_H3 | lovegrass\|gb167\|DN481668_P1 | 3244 | 7786 | 551 | 87 | globlastp |
| LAB697_H4 | millet\|10v1\|EVO454PM007051_P1 | 3245 | 7787 | 551 | 86 | globlastp |
| LAB697_H5 | sorghum\|12v1\|SB04G029780_P1 | 3246 | 7788 | 551 | 86 | globlastp |
| LAB697_H6 | sugarcane\|10v1\|CA102094_P1 | 3247 | 7789 | 551 | 86 | globlastp |
| LAB697_H7 | switchgrass\|gb167\|DN143428 | 3248 | 7790 | 551 | 86 | globlastp |
| LAB697_H8 | switchgrass\|gb167\|FE637922 | 3249 | 7790 | 551 | 86 | globlastp |
| LAB697_H9 | foxtail_millet\|11v3\|EC613006_T1 | 3250 | 7791 | 551 | 85.96 | glotblastn |
| LAB698_H1 | maize\|10v1\|BM378106_P1 | 3251 | 7792 | 552 | 87.6 | globlastp |
| LAB698_H7 | switchgrass\|12v1\|DN142545_P1 | 3252 | 7793 | 552 | 86.6 | globlastp |
| LAB698_H2 | foxtail_millet\|11v3\|PHY7SI002106M_P1 | 3253 | 7794 | 552 | 85.8 | globlastp |
| LAB698_H3 | switchgrass\|12v1\|DN149952_P1 | 3254 | 7795 | 552 | 85.2 | globlastp |
| LAB698_H3 | switchgrass\|gb167\|DN142545 | 3255 | 7796 | 552 | 85.2 | globlastp |
| LAB698_H4 | foxtail_millet\|11v3\|PHY7SI002078M_P1 | 3256 | 7797 | 552 | 83.5 | globlastp |
| LAB698_H5 | brachypodium\|12v1\|BRADI2G53050_P1 | 3257 | 7798 | 552 | 80.7 | globlastp |
| LAB698_H6 | brachypodium\|12v1\|SRR031796.16539_P1 | 3258 | 7798 | 552 | 80.7 | globlastp |
| LAB700_H1 | sugarcane\|10v1\|CA066187 | 3259 | 7799 | 553 | 91.9 | globlastp |
| LAB700_H2 | sorghum\|12v1\|SB03G006150 | 3260 | 7800 | 553 | 91.6 | globlastp |
| LAB700_H3 | maize\|10v1\|BG354490_P1 | 3261 | 7801 | 553 | 89.7 | globlastp |
| LAB700_H4 | foxtail_millet\|11v3\|PHY7SI000510M_P1 | 3262 | 7802 | 553 | 83.9 | globlastp |
| LAB701_H1 | sorghum\|12v1\|SB06G023830 | 3263 | 7803 | 554 | 95.5 | globlastp |
| LAB701_H2 | foxtail_millet\|11v3\|PHY7SI009698M_P1 | 3264 | 7804 | 554 | 91.6 | globlastp |
| LAB701_H12 | switchgrass\|12v1\|FL718964_T1 | 3265 | 7805 | 554 | 90 | glotblastn |
| LAB701_H3 | rice\|11v1\|BI802373 | 3266 | 7806 | 554 | 83.7 | globlastp |
| LAB701_H4 | wheat\|10v2\|BE604112 | 3267 | 7807 | 554 | 82.7 | globlastp |
| LAB701_H5 | brachypodium\|12v1\|BRADI5G16970_P1 | 3268 | 7808 | 554 | 82.2 | globlastp |
| LAB701_H6 | rye\|12v1\|BE586784 | 3269 | 7809 | 554 | 82.2 | globlastp |
| LAB701_H7 | switchgrass\|12v1\|DN149962_P1 | 3270 | 7810 | 554 | 81.9 | globlastp |
| LAB701_H7 | switchgrass\|gb167\|DN149962 | 3271 | 7811 | 554 | 81.9 | globlastp |
| LAB701_H8 | barley\|10v2\|BI948007 | 3272 | 7812 | 554 | 81.6 | globlastp |
| LAB701_H9 | switchgrass\|gb167\|FE613267 | 3273 | 7813 | 554 | 81.2 | globlastp |
| LAB701_H10 | rice\|11v1\|U40143 | 3274 | 7814 | 554 | 81.1 | globlastp |
| LAB701_H11 | foxtail_millet\|11v3\|PHY7SI016749M_P1 | 3275 | 7815 | 554 | 80.9 | globlastp |
| LAB702_H1 | sugarcane\|10v1\|BQ534855 | 3276 | 7816 | 555 | 94 | globlastp |
| LAB702_H2 | sorghum\|12v1\|SB05G009740 | 3277 | 7817 | 555 | 92.3 | globlastp |
| LAB702_H3 | switchgrass\|gb167\|DN145709 | 3278 | 7818 | 555 | 86.4 | globlastp |
| LAB702_H4 | foxtail_millet\|11v3\|PHY7SI026693M_P1 | 3279 | 7819 | 555 | 85.3 | globlastp |
| LAB702_H5 | millet\|10v1\|EVO454PM002209_P1 | 3280 | 7820 | 555 | 84.9 | globlastp |
| LAB703_H1 | sorghum\|12v1\|SB07G028890 | 3281 | 7821 | 556 | 95.2 | globlastp |
| LAB703_H2 | switchgrass\|gb167\|FL757721 | 3282 | 7822 | 556 | 89.5 | globlastp |
| LAB703_H2 | switchgrass\|12v1\|FE639357_P1 | 3283 | 7823 | 556 | 88.9 | globlastp |
| LAB703_H3 | switchgrass\|gb167\|DN144427 | 3284 | 7824 | 556 | 88.9 | globlastp |
| LAB703_H7 | switchgrass\|12v1\|DN144427_P1 | 3285 | 7825 | 556 | 88.6 | globlastp |
| LAB703_H4 | millet\|10v1\|PMSLX0036944D1_P1 | 3286 | 7826 | 556 | 88.3 | globlastp |
| LAB703_H5 | lovegrass\|gb167\|DN480383_P1 | 3287 | 7827 | 556 | 87.1 | globlastp |
| LAB703_H6 | rice\|11v1\|AU031650 | 3288 | 7828 | 556 | 83.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB704_H1 | sorghum\|12v1\|SB0012S006000 | 3289 | 7829 | 557 | 85.7 | globlastp |
| LAB705_H1 | sorghum\|12v1\|CF760129 | 3290 | 7830 | 558 | 94.8 | globlastp |
| LAB705_H2 | maize\|10v1\|CD963129_P1 | 3291 | 7831 | 558 | 84.5 | globlastp |
| LAB705_H3 | cynodon\|10v1\|ES299804_T1 | 3292 | 7832 | 558 | 81.03 | glotblastn |
| LAB706_H1 | sorghum\|12v1\|SB03G035650 | 3293 | 7833 | 559 | 93.1 | globlastp |
| LAB706_H3 | switchgrass\|12v1\|SRR187765.191507_P1 | 3294 | 7834 | 559 | 91.1 | globlastp |
| LAB706_H2 | foxtail_millet\|11v3\|PHY7SI003462M_P1 | 3295 | 7835 | 559 | 91.1 | globlastp |
| LAB707_H6 | switchgrass\|12v1\|FL815132_P1 | 3296 | 7836 | 560 | 88.2 | globlastp |
| LAB707_H3 | brachypodium\|12v1\|BRADI2G44900_P1 | 3297 | 7837 | 560 | 84 | globlastp |
| LAB707_H5 | rye\|12v1\|DRR001012.123408 | 3298 | 7838 | 560 | 82.9 | globlastp |
| LAB707_H7 | wheat\|12v3\|SRR073321X191628D1_P1 | 3299 | 7839 | 560 | 82.3 | globlastp |
| LAB707_H6 | switchgrass\|gb167\|FL815132 | 3300 | 7840 | 560 | 81.9 | glotblastn |
| LAB708_H1 | sorghum\|12v1\|SB03G040270 | 3301 | 7841 | 561 | 90.7 | globlastp |
| LAB708_H2 | maize\|10v1\|CF244321_P1 | 3302 | 7842 | 561 | 88.6 | globlastp |
| LAB708_H3 | foxtail_millet\|11v3\|PHY7SI001075M_P1 | 3303 | 7843 | 561 | 88 | globlastp |
| LAB709_H1 | sugarcane\|10v1\|CA273032 | 3304 | 7844 | 562 | 90.9 | globlastp |
| LAB709_H2 | sorghum\|12v1\|SB02G022990T2 | 3305 | 7845 | 562 | 87.1 | globlastp |
| LAB709_H3 | sorghum\|12v1\|SB02G022990 | 3306 | 7845 | 562 | 87.1 | globlastp |
| LAB709_H4 | foxtail_millet\|11v3\|PHY7SI031494M_P1 | 3307 | 7846 | 562 | 86.4 | globlastp |
| LAB709_H5 | millet\|10v1\|EVO454PM029318_P1 | 3308 | 7847 | 562 | 84.8 | globlastp |
| LAB709_H6 | switchgrass\|gb167\|DN147166 | 3309 | 7848 | 562 | 84.1 | globlastp |
| LAB711_H2 | sorghum\|12v1\|SB06G019730 | 3310 | 7849 | 564 | 91.7 | globlastp |
| LAB711_H3 | foxtail_millet\|11v3\|PHY7SI009453M_P1 | 3311 | 7850 | 564 | 83.3 | globlastp |
| LAB712_H1 | sorghum\|12v1\|SB03G004180 | 3312 | 7851 | 565 | 92.8 | globlastp |
| LAB712_H9 | switchgrass\|12v1\|FL747718_P1 | 3313 | 7852 | 565 | 89.6 | globlastp |
| LAB712_H10 | switchgrass\|12v1\|JG812654_P1 | 3314 | 7853 | 565 | 89.3 | globlastp |
| LAB712_H2 | foxtail_millet\|11v3\|PHY7SI000570M_P1 | 3315 | 7854 | 565 | 88.7 | globlastp |
| LAB712_H11 | switchgrass\|12v1\|FL754616_P1 | 3316 | 7855 | 565 | 88.5 | globlastp |
| LAB712_H3 | brachypodium\|12v1\|BRADI2G04690_P1 | 3317 | 7856 | 565 | 82.9 | globlastp |
| LAB712_H4 | rice\|11v1\|CB621206 | 3318 | 7857 | 565 | 81.6 | globlastp |
| LAB712_H5 | wheat\|10v2\|BQ620782 | 3319 | 7858 | 565 | 81.1 | globlastp |
| LAB712_H6 | barley\|10v2\|BG365756 | 3320 | 7859 | 565 | 81 | globlastp |
| LAB712_H6 | barley\|12v1\|BJ468992_P1 | 3321 | 7859 | 565 | 81 | globlastp |
| LAB712_H7 | rice\|11v1\|AU225333 | 3322 | 7860 | 565 | 81 | globlastp |
| LAB712_H8 | rye\|12v1\|DRR001012.106807 | 3323 | 7861 | 565 | 80.8 | globlastp |
| LAB712_H12 | barley\|12v1\|AV909159_P1 | 3324 | 7862 | 565 | 80.7 | globlastp |
| LAB712_H5 | wheat\|12v3\|CA498610_P1 | 3325 | 7863 | 565 | 80.7 | globlastp |
| LAB712_H13 | wheat\|12v3\|BQ903871_P1 | 3326 | 7864 | 565 | 80.3 | globlastp |
| LAB712_H14 | wheat\|12v3\|SRR073321X235771D1_T1 | 3327 | 7865 | 565 | 80.09 | glotblastn |
| LAB713_H1 | foxtail_millet\|11v3\|PHY7SI030717M_P1 | 3328 | 7866 | 566 | 84.9 | globlastp |
| LAB714_H1 | sorghum\|12v1\|SB02G011890 | 3329 | 7867 | 567 | 98.4 | globlastp |
| LAB714_H2 | sugarcane\|10v1\|BQ534031 | 3330 | 7868 | 567 | 98.4 | globlastp |
| LAB714_H3 | cenchrus\|gb166\|BM084717_P1 | 3331 | 7869 | 567 | 95.9 | globlastp |
| LAB714_H4 | millet\|10v1\|CD724639_P1 | 3332 | 7870 | 567 | 95.9 | globlastp |
| LAB714_H5 | switchgrass\|gb167\|DN143551 | 3333 | 7871 | 567 | 95.9 | globlastp |
| LAB714_H6 | foxtail_millet\|11v3\|GT091003_P1 | 3334 | 7872 | 567 | 95.6 | globlastp |
| LAB714_H7 | switchgrass\|gb167\|FE609866 | 3335 | 7873 | 567 | 95.2 | globlastp |
| LAB714_H5, LAB714_H7 | switchgrass\|12v1\|FE609866_P1 | 3336 | 7874 | 567 | 94.5 | globlastp |
| LAB714_H8 | rice\|11v1\|U38088 | 3337 | 7875 | 567 | 93.6 | globlastp |
| LAB714_H9 | brachypodium\|12v1\|BRADI4G38430_P1 | 3338 | 7876 | 567 | 89.9 | globlastp |
| LAB714_H10 | oat\|11v1\|GR323343_P1 | 3339 | 7877 | 567 | 88 | globlastp |
| LAB714_H11 | wheat\|10v2\|BE402383 | 3340 | 7878 | 567 | 87.6 | globlastp |
| LAB714_H11 | wheat\|12v3\|BE402383_P1 | 3341 | 7879 | 567 | 87.6 | globlastp |
| LAB714_H12 | leymus\|gb166\|EG374984_P1 | 3342 | 7880 | 567 | 87.4 | globlastp |
| LAB714_H13 | oat\|11v1\|GR325623_P1 | 3343 | 7881 | 567 | 87.4 | globlastp |
| LAB714_H15 | wheat\|12v3\|BE398504_P1 | 3344 | 7882 | 567 | 87.4 | globlastp |
| LAB714_H14 | rye\|12v1\|DRR001012.42071 | 3345 | 7883 | 567 | 87.2 | globlastp |
| LAB714_H60 | wheat\|12v3\|BE400715_P1 | 3346 | 7884 | 567 | 86.9 | globlastp |
| LAB714_H15 | wheat\|10v2\|BE398504 | 3347 | 7885 | 567 | 86.9 | globlastp |
| LAB714_H16 | rye\|12v1\|BE495078 | 3348 | 7886 | 567 | 86.24 | glotblastn |
| LAB714_H17 | barley\|12v1\|AJ228944_P1 | 3349 | 7887 | 567 | 85.8 | globlastp |
| LAB714_H17 | barley\|10v2\|AJ228944 | 3350 | 7888 | 567 | 85.6 | globlastp |
| LAB714_H61 | switchgrass\|12v1\|DN149887_P1 | 3351 | 7889 | 567 | 84.4 | globlastp |
| LAB714_H18 | rye\|12v1\|BE494878 | 3352 | 7890 | 567 | 84.4 | globlastp |
| LAB714_H19 | foxtail_millet\|11v3\|EC611969_P1 | 3353 | 7891 | 567 | 84.2 | globlastp |
| LAB714_H20 | millet\|10v1\|EVO454PM007722_P1 | 3354 | 7892 | 567 | 84.2 | globlastp |
| LAB714_H21 | barley\|10v2\|BE412785 | 3355 | 7893 | 567 | 84.1 | globlastp |
| LAB714_H21 | barley\|12v1\|BE412785_P1 | 3356 | 7893 | 567 | 84.1 | globlastp |
| LAB714_H22 | rye\|12v1\|BE636848 | 3357 | 7894 | 567 | 84.1 | globlastp |
| LAB714_H23 | wheat\|10v2\|BF483187 | 3358 | 7895 | 567 | 84.1 | globlastp |
| LAB714_H24 | sorghum\|12v1\|SB07G024320 | 3359 | 7896 | 567 | 83.9 | globlastp |
| LAB714_H25 | wheat\|10v2\|BE404185 | 3360 | 7897 | 567 | 83.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB714_H62 | switchgrass\|12v1\|DN143551_T1 | 3361 | 7898 | 567 | 83.88 | glotblastn |
| LAB714_H26 | rice\|11v1\|BE228256 | 3362 | 7899 | 567 | 83.7 | globlastp |
| LAB714_H27 | switchgrass\|gb167\|DN142429 | 3363 | 7900 | 567 | 83.7 | globlastp |
| LAB714_H28 | wheat\|10v2\|BE404223 | 3364 | 7901 | 567 | 83.7 | globlastp |
| LAB714_H23, LAB714_H25, LAB714_H28 | wheat\|12v3\|BE404185_P1 | 3365 | 7901 | 567 | 83.7 | globlastp |
| LAB714_H29 | maize\|10v1\|AI649518_P1 | 3366 | 7902 | 567 | 83.4 | globlastp |
| LAB714_H27 | switchgrass\|12v1\|DN142429_P1 | 3367 | 7903 | 567 | 83 | globlastp |
| LAB714_H30 | sugarcane\|10v1\|CA069340 | 3368 | 7904 | 567 | 82.8 | globlastp |
| LAB714_H63 | banana\|12v1\|BBS72T3_P1 | 3369 | 7905 | 567 | 82.3 | globlastp |
| LAB714_H31 | cassava\|09v1\|CK645547_P1 | 3370 | 7906 | 567 | 81.8 | globlastp |
| LAB714_H32 | curcuma\|10v1\|DY391188_P1 | 3371 | 7907 | 567 | 81.8 | globlastp |
| LAB714_H33 | oat\|11v1\|GO583345_T1 | 3372 | 7908 | 567 | 81.61 | glotblastn |
| LAB714_H64 | banana\|12v1\|FL648823_P1 | 3373 | 7909 | 567 | 81.6 | globlastp |
| LAB714_H34 | humulus\|11v1\|EX516702_P1 | 3374 | 7910 | 567 | 81.6 | globlastp |
| LAB714_H35 | cotton\|11v1\|AI726365_P1 | 3375 | 7911 | 567 | 81.4 | globlastp |
| LAB714_H36 | oil_palm\|11v1\|EL563741_P1 | 3376 | 7912 | 567 | 81.4 | globlastp |
| LAB714_H37 | brachypodium\|12v1\|BRADI3G42760_P1 | 3377 | 7913 | 567 | 81.1 | globlastp |
| LAB714_H38 | cotton\|11v1\|BE053857_P1 | 3378 | 7914 | 567 | 81.1 | globlastp |
| LAB714_H39 | gossypium_raimondii\|12v1\|AI726365_P1 | 3379 | 7915 | 567 | 81.1 | globlastp |
| LAB714_H40 | cannabis\|12v1\|EW700796_P1 | 3380 | 7916 | 567 | 80.9 | globlastp |
| LAB714_H41 | gossypium_raimondii\|12v1\|AI054614_P1 | 3381 | 7917 | 567 | 80.9 | globlastp |
| LAB714_H42 | poplar\|10v1\|BI122179 | 3382 | 7918 | 567 | 80.9 | globlastp |
| LAB714_H42 | poplar\|13v1\|BI071680_P1 | 3383 | 7918 | 567 | 80.9 | globlastp |
| LAB714_H43 | cotton\|11v1\|AI726597_P1 | 3384 | 7919 | 567 | 80.7 | globlastp |
| LAB714_H44 | fraxinus\|11v1\|SRR058827.100723_T1 | 3385 | 7920 | 567 | 80.69 | glotblastn |
| LAB714_H45 | eschscholzia\|11v1\|CD476791_P1 | 3386 | 7921 | 567 | 80.5 | globlastp |
| LAB714_H46 | liquorice\|gb171\|FS268815_P1 | 3387 | 7922 | 567 | 80.5 | globlastp |
| LAB714_H47 | tabernaemontana\|11v1\|SRR098689X107321 | 3388 | 7923 | 567 | 80.5 | globlastp |
| LAB714_H48 | cacao\|10v1\|CF972720_P1 | 3389 | 7924 | 567 | 80.2 | globlastp |
| LAB714_H49 | cotton\|11v1\|CO074090_P1 | 3390 | 7925 | 567 | 80.2 | globlastp |
| LAB714_H50 | grape\|11v1\|GSVIVT01033815001_P1 | 3391 | 7926 | 567 | 80.2 | globlastp |
| LAB714_H51 | oak\|10v1\|CU656124_P1 | 3392 | 7927 | 567 | 80.2 | globlastp |
| LAB714_H52 | olea\|11v1\|SRR014463.12170 | 3393 | 7928 | 567 | 80.2 | globlastp |
| LAB714_H52 | olea\|13v1\|SRR014463X12170D1_P1 | 3394 | 7928 | 567 | 80.2 | globlastp |
| LAB714_H53 | platanus\|11v1\|SRR096786X100025_P1 | 3395 | 7929 | 567 | 80.2 | globlastp |
| LAB714_H54 | amsonia\|11v1\|SRR098688X100870_P1 | 3396 | 7930 | 567 | 80 | globlastp |
| LAB714_H55 | cassava\|09v1\|DV441055_P1 | 3397 | 7931 | 567 | 80 | globlastp |
| LAB714_H56 | chestnut\|gb170\|SRR006295S0005317_P1 | 3398 | 7932 | 567 | 80 | globlastp |
| LAB714_H57 | euonymus\|11v1\|SRR070038X115555_P1 | 3399 | 7933 | 567 | 80 | globlastp |
| LAB714_H58 | utricularia\|11v1\|SRR094438.100060 | 3400 | 7934 | 567 | 80 | globlastp |
| LAB714_H59 | valeriana\|11v1\|SRR099039X113898 | 3401 | 7935 | 567 | 80 | globlastp |
| LAB716_H1 | poplar\|10v1\|BU884744 | 3402 | 7936 | 568 | 82.5 | globlastp |
| LAB716_H1 | poplar\|13v1\|BU884744_P1 | 3403 | 7937 | 568 | 82.2 | globlastp |
| LAB717_H1 | cacao\|10v1\|CU532745_P1 | 3404 | 7938 | 569 | 84.3 | globlastp |
| LAB717_H2 | cassava\|09v1\|DB922354_T1 | 3405 | 7939 | 569 | 84.16 | glotblastn |
| LAB717_H3 | clementine\|11v1\|CB292561_T1 | 3406 | 7940 | 569 | 84.02 | glotblastn |
| LAB717_H4 | eucalyptus\|11v2\|SRR001658X126_P1 | 3407 | 7941 | 569 | 82 | globlastp |
| LAB717_H5 | orange\|11v1\|CB292561_P1 | 3408 | 7942 | 569 | 82 | globlastp |
| LAB717_H6 | tabernaemontana\|11v1\|SRR098689X104386 | 3409 | 7943 | 569 | 81.8 | globlastp |
| LAB717_H7 | grape\|11v1\|GSVIVT01036477001_P1 | 3410 | 7944 | 569 | 81.7 | globlastp |
| LAB717_H8 | cotton\|11v1\|CO086111_P1 | 3411 | 7945 | 569 | 81.6 | globlastp |
| LAB717_H9 | gossypium_raimondii\|12v1\|DR460390_P1 | 3412 | 7946 | 569 | 81.6 | globlastp |
| LAB717_H10 | prunus\|10v1\|DT003514 | 3413 | 7947 | 569 | 81.19 | glotblastn |
| LAB717_H15 | prunus_mume\|13v1\|SRR345675.22354_T1 | 3414 | 7948 | 569 | 80.99 | glotblastn |
| LAB717_H11 | amsonia\|11v1\|SRR098688X132103_P1 | 3415 | 7949 | 569 | 80.8 | globlastp |
| LAB717_H12 | catharanthus\|11v1\|SRR098691X102623_T1 | 3416 | 7950 | 569 | 80.4 | glotblastn |
| LAB717_H13 | strawberry\|11v1\|SRR034865S0023400 | 3417 | 7951 | 569 | 80.2 | globlastp |
| LAB717_H14 | watermelon\|11v1\|AM720745 | 3418 | 7952 | 569 | 80.04 | glotblastn |
| LAB718_H1 | poplar\|10v1\|CA927391 | 3419 | 7953 | 570 | 86.7 | globlastp |
| LAB718_H1 | poplar\|13v1\|CA927391_P1 | 3420 | 7954 | 570 | 86.7 | globlastp |
| LAB720_H1 | rice\|11v1\|AA749572 | 3421 | 7955 | 572 | 84.8 | globlastp |
| LAB720_H2 | barley\|10v2\|BE195688 | 3422 | 7956 | 572 | 83.3 | globlastp |
| LAB720_H3 | pseudoroegneria\|gb167\|FF340188 | 3423 | 7957 | 572 | 83.1 | globlastp |
| LAB720_H4 | wheat\|10v2\|BE490629 | 3424 | 7958 | 572 | 83.1 | globlastp |
| LAB720_H5 | wheat\|10v2\|BE399464 | 3425 | 7959 | 572 | 82.7 | globlastp |
| LAB720_H6 | rye\|12v1\|BE494380 | 3426 | 7960 | 572 | 81.8 | globlastp |
| LAB720_H7 | rye\|12v1\|DRR001012.114722 | 3427 | 7961 | 572 | 81.8 | globlastp |
| LAB723_H1 | sugarcane\|10v1\|CA148016 | 3428 | 7962 | 575 | 90.5 | globlastp |
| LAB723_H2 | foxtail_millet\|11v3\|PHY7SI025301M_T1 | 3429 | 7963 | 575 | 90.48 | glotblastn |
| LAB723_H3 | switchgrass\|12v1\|FE647037_P1 | 3430 | 7964 | 575 | 90.2 | globlastp |
| LAB723_H3 | switchgrass\|gb167\|FE647037 | 3431 | 7964 | 575 | 90.2 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB723_H13 | switchgrass\|12v1\|HO264921_P1 | 3432 | 7965 | 575 | 89.6 | globlastp |
| LAB723_H4 | sorghum\|12v1\|SB09G004990 | 3433 | 7966 | 575 | 89.4 | globlastp |
| LAB723_H14 | wheat\|12v3\|BE412047_P1 | 3434 | 7967 | 575 | 88.8 | globlastp |
| LAB723_H5 | pseudoroegneria\|gb167\|FF343540 | 3435 | 7968 | 575 | 88.5 | globlastp |
| LAB723_H7 | wheat\|12v3\|BG906361_P1 | 3436 | 7969 | 575 | 88.5 | globlastp |
| LAB723_H6 | rye\|12v1\|DRR001012.121959 | 3437 | 7970 | 575 | 88.2 | glotblastn |
| LAB723_H7 | wheat\|10v2\|BE412047 | 3438 | 7971 | 575 | 88.2 | globlastp |
| LAB723_H15 | barley\|12v1\|BI952425_P1 | 3439 | 7972 | 575 | 88 | globlastp |
| LAB723_H16 | wheat\|12v3\|CA731684_P1 | 3440 | 7973 | 575 | 88 | globlastp |
| LAB723_H8 | barley\|10v2\|BI952425 | 3441 | 7972 | 575 | 88 | globlastp |
| LAB723_H9 | oat\|11v1\|GO594497_P1 | 3442 | 7974 | 575 | 87.7 | globlastp |
| LAB723_H10 | brachypodium\|12v1\|BRADI2G34490_P1 | 3443 | 7975 | 575 | 87.4 | globlastp |
| LAB723_H11 | fescue\|gb161\|DT681092_P1 | 3444 | 7976 | 575 | 83.6 | globlastp |
| LAB723_H12 | maize\|10v1\|AW129873_T1 | 3445 | 7977 | 575 | 82.08 | glotblastn |
| LAB726_H372 | switchgrass\|12v1\|DN146436_P1 | 3446 | 7978 | 578 | 94.8 | globlastp |
| LAB726_H1 | foxtail_millet\|11v3\|PHY7SI022299M_P1 | 3447 | 7979 | 578 | 94.8 | globlastp |
| LAB726_H2 | lovegrass\|gb167\|EH185063_P1 | 3448 | 7980 | 578 | 94.8 | globlastp |
| LAB726_H3 | switchgrass\|gb167\|DN146436 | 3449 | 7978 | 578 | 94.8 | globlastp |
| LAB726_H4 | sorghum\|12v1\|SB09G030530 | 3450 | 7981 | 578 | 94.4 | globlastp |
| LAB726_H5 | cenchrus\|gb166\|EB655327_P1 | 3451 | 7982 | 578 | 94.1 | globlastp |
| LAB726_H6 | sugarcane\|10v1\|BQ530112 | 3452 | 7983 | 578 | 94.1 | globlastp |
| LAB726_H7 | maize\|10v1\|BG354255_P1 | 3453 | 7984 | 578 | 93.4 | globlastp |
| LAB726_H8 | brachypodium\|12v1\|BRADI4G31150T2_P1 | 3454 | 7985 | 578 | 93.1 | globlastp |
| LAB726_H9 | cucumber\|09v1\|DV634738_P1 | 3455 | 7986 | 578 | 93.1 | globlastp |
| LAB726_H10 | switchgrass\|gb167\|FE600087 | 3456 | 7987 | 578 | 93.1 | globlastp |
| LAB726_H3, LAB726_H10 | switchgrass\|12v1\|FE600087_P1 | 3457 | 7987 | 578 | 93.1 | globlastp |
| LAB726_H11 | millet\|10v1\|EVO454PM023806_T1 | 3458 | 7988 | 578 | 92.71 | glotblastn |
| LAB726_H12 | melon\|10v1\|DV634738_P1 | 3459 | 7989 | 578 | 92.7 | globlastp |
| LAB726_H13 | watermelon\|11v1\|DV634738 | 3460 | 7990 | 578 | 92.4 | globlastp |
| LAB726_H373 | wheat\|12v3\|BI750581_P1 | 3461 | 7991 | 578 | 91.7 | globlastp |
| LAB726_H374 | wheat\|12v3\|BM135383_P1 | 3462 | 7991 | 578 | 91.7 | globlastp |
| LAB726_H375 | wheat\|12v3\|CJ963454_P1 | 3463 | 7991 | 578 | 91.7 | globlastp |
| LAB726_H14 | wheat\|10v2\|BE402061 | 3464 | 7991 | 578 | 91.7 | globlastp |
| LAB726_H15 | cucurbita\|11v1\|SRR091276X101454_T1 | 3465 | 7992 | 578 | 91.67 | glotblastn |
| LAB726_H16 | rye\|12v1\|DRR001012.100493 | 3466 | 7993 | 578 | 91.32 | glotblastn |
| LAB726_H17 | rye\|12v1\|DRR001012.163270 | 3467 | 7994 | 578 | 91.32 | glotblastn |
| LAB726_H18 | leymus\|gb166\|EG377183_P1 | 3468 | 7995 | 578 | 91.3 | globlastp |
| LAB726_H19 | rye\|12v1\|DRR001012.105610 | 3469 | 7996 | 578 | 91.3 | globlastp |
| LAB726_H20 | rye\|12v1\|DRR001012.119697 | 3470 | 7996 | 578 | 91.3 | globlastp |
| LAB726_H376 | barley\|12v1\|BI946680_P1 | 3471 | 7997 | 578 | 91 | globlastp |
| LAB726_H21 | barley\|10v2\|BI946680 | 3472 | 7997 | 578 | 91 | globlastp |
| LAB726_H21 | barley\|12v1\|BQ458873_P1 | 3473 | 7997 | 578 | 91 | globlastp |
| LAB726_H22 | oat\|11v1\|GO587381_P1 | 3474 | 7998 | 578 | 91 | globlastp |
| LAB726_H23 | oil_palm\|11v1\|EL688560_P1 | 3475 | 7999 | 578 | 91 | globlastp |
| LAB726_H24 | papaya\|gb165\|EF512303_P1 | 3476 | 8000 | 578 | 91 | globlastp |
| LAB726_H28, LAB726_H29 | wheat\|12v3\|BF473864_P1 | 3477 | 8001 | 578 | 91 | globlastp |
| LAB726_H25 | rye\|12v1\|DRR001012.157345 | 3478 | 8002 | 578 | 90.97 | glotblastn |
| LAB726_H26 | catharanthus\|11v1\|EG557587_P1 | 3479 | 8003 | 578 | 90.7 | globlastp |
| LAB726_H27 | tripterygium\|11v1\|SRR098677X109403 | 3480 | 8004 | 578 | 90.62 | glotblastn |
| LAB726_H28 | wheat\|10v2\|BF473864 | 3481 | 8005 | 578 | 90.6 | globlastp |
| LAB726_H29 | wheat\|10v2\|BQ171535 | 3482 | 8006 | 578 | 90.6 | globlastp |
| LAB726_H30 | tabernaemontana\|11v1\|SRR098689X127031 | 3483 | 8007 | 578 | 90.3 | globlastp |
| LAB726_H31 | cannabis\|12v1\|GR220740_P1 | 3484 | 8008 | 578 | 90.1 | globlastp |
| LAB726_H32 | cannabis\|12v1\|SOLX00012902_P1 | 3485 | 8008 | 578 | 90.1 | globlastp |
| LAB726_H33 | humulus\|11v1\|EX516029_P1 | 3486 | 8008 | 578 | 90.1 | globlastp |
| LAB726_H377 | olea\|13v1\|JK749148_P1 | 3487 | 8009 | 578 | 90 | globlastp |
| LAB726_H34 | cotton\|11v1\|BF270336_P1 | 3488 | 8010 | 578 | 90 | globlastp |
| LAB726_H35 | gossypium_raimondii\|12v1\|BF270336_P1 | 3489 | 8010 | 578 | 90 | globlastp |
| LAB726_H36 | rye\|12v1\|DRR001015.101690 | 3490 | 8011 | 578 | 89.93 | glotblastn |
| LAB726_H37 | antirrhinum\|gb166\|AJ568109_P1 | 3491 | 8012 | 578 | 89.7 | globlastp |
| LAB726_H38 | oat\|11v1\|GR315380_P1 | 3492 | 8013 | 578 | 89.7 | globlastp |
| LAB726_H39 | amsonia\|11v1\|SRR098688X111782_P1 | 3493 | 8014 | 578 | 89.6 | globlastp |
| LAB726_H40 | liriodendron\|gb166\|CK743362_P1 | 3494 | 8015 | 578 | 89.6 | globlastp |
| LAB726_H41 | rye\|12v1\|DRR001012.118302 | 3495 | 8016 | 578 | 89.58 | glotblastn |
| LAB726_H42 | grape\|11v1\|GSVIVT01008060001_P1 | 3496 | 8017 | 578 | 89.3 | globlastp |
| LAB726_H378 | b_juncea\|12v1\|E6ANDIZ01CONDG_P1 | 3497 | 8018 | 578 | 89.2 | globlastp |
| LAB726_H379 | lettuce\|12v1\|DW045312_P1 | 3498 | 8019 | 578 | 89.2 | globlastp |
| LAB726_H43 | b_rapa\|11v1\|CD813356_P1 | 3499 | 8018 | 578 | 89.2 | globlastp |
| LAB726_H44 | b_rapa\|11v1\|CD815135_P1 | 3500 | 8020 | 578 | 89.2 | globlastp |
| LAB726_H45 | b_rapa\|11v1\|CD815732_P1 | 3501 | 8018 | 578 | 89.2 | globlastp |
| LAB726_H46 | canola\|11v1\|DY005251_P1 | 3502 | 8020 | 578 | 89.2 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB726_H47 | canola\|11v1\|EE456687_P1 | 3503 | 8018 | 578 | 89.2 | globlastp |
| LAB726_H48 | euonymus\|11v1\|SRR070038X1252_P1 | 3504 | 8021 | 578 | 89.2 | globlastp |
| LAB726_H49 | euonymus\|11v1\|SRR070038X175591_P1 | 3505 | 8022 | 578 | 89.2 | globlastp |
| LAB726_H50 | lettuce\|10v1\|DW045312 | 3506 | 8019 | 578 | 89.2 | globlastp |
| LAB726_H51 | olea\|11v1\|SRR014463.15174 | 3507 | 8023 | 578 | 89.2 | globlastp |
| LAB726_H52 | phalaenopsis\|11v1\|CB032195_P1 | 3508 | 8024 | 578 | 89.2 | globlastp |
| LAB726_H53 | rose\|12v1\|BQ104032 | 3509 | 8025 | 578 | 89.2 | globlastp |
| LAB726_H54 | strawberry\|11v1\|EX658465 | 3510 | 8026 | 578 | 89.2 | globlastp |
| LAB726_H55 | thellungiella_parvulum\|11v1\|DN772889 | 3511 | 8027 | 578 | 89.2 | globlastp |
| LAB726_H56 | tragopogon\|10v1\|SRR020205S0024830 | 3512 | 8028 | 578 | 89.2 | globlastp |
| LAB726_H380 | olea\|13v1\|SRR014463X14498D1_P1 | 3513 | 8029 | 578 | 89 | globlastp |
| LAB726_H57 | cacao\|10v1\|CGD0019194_P1 | 3514 | 8030 | 578 | 89 | globlastp |
| LAB726_H58 | rye\|12v1\|DRR001012.175646 | 3515 | 8031 | 578 | 88.93 | glotblastn |
| LAB726_H381 | b_juncea\|12v1\|E6ANDIZ01AZ57D_P1 | 3516 | 8032 | 578 | 88.9 | globlastp |
| LAB726_H59 | canola\|11v1\|EG020885_P1 | 3517 | 8033 | 578 | 88.9 | globlastp |
| LAB726_H60 | chestnut\|gb170\|SRR006295S0058525_P1 | 3518 | 8034 | 578 | 88.9 | globlastp |
| LAB726_H61 | cynara\|gb167\|GE586766_P1 | 3519 | 8035 | 578 | 88.9 | globlastp |
| LAB726_H62 | phalaenopsis\|11v1\|SRR125771.1014877_P1 | 3520 | 8036 | 578 | 88.9 | globlastp |
| LAB726_H63 | prunus\|10v1\|CN494116 | 3521 | 8037 | 578 | 88.9 | globlastp |
| LAB726_H64 | radish\|gb1641\|EV535720 | 3522 | 8038 | 578 | 88.9 | globlastp |
| LAB726_H65 | radish\|gb164\|EV544540 | 3523 | 8038 | 578 | 88.9 | globlastp |
| LAB726_H66 | safflower\|gb162\|EL404368 | 3524 | 8039 | 578 | 88.9 | globlastp |
| LAB726_H67 | sunflower\|12v1\|DY916997 | 3525 | 8040 | 578 | 88.9 | globlastp |
| LAB726_H68 | coffea\|10v1\|CF588907_P1 | 3526 | 8041 | 578 | 88.6 | globlastp |
| LAB726_H69 | solanum_phureja\|09v1\|SPHBG600514 | 3527 | 8042 | 578 | 88.6 | globlastp |
| LAB726_H70 | walnuts\|gb166\|CV198105 | 3528 | 8043 | 578 | 88.6 | globlastp |
| LAB726_H382 | aquilegia\|10v2\|DR914566_P1 | 3529 | 8044 | 578 | 88.5 | globlastp |
| LAB726_H383 | prunus_mume\|13v1\|DT455430_P1 | 3530 | 8045 | 578 | 88.5 | globlastp |
| LAB726_H71 | aquilegia\|10v1\|DR914566 | 3531 | 8044 | 578 | 88.5 | globlastp |
| LAB726_H72 | b_oleracea\|gb161\|DY029722_P1 | 3532 | 8046 | 578 | 88.5 | globlastp |
| LAB726_H73 | cacao\|10v1\|CU485077_P1 | 3533 | 8047 | 578 | 88.5 | globlastp |
| LAB726_H74 | cassava\|09v1\|CK645417_P1 | 3534 | 8048 | 578 | 88.5 | globlastp |
| LAB726_H75 | cichorium\|gb171\|EH685765_P1 | 3535 | 8049 | 578 | 88.5 | globlastp |
| LAB726_H76 | euonymus\|11v1\|SRR070038X4790038_P1 | 3536 | 8050 | 578 | 88.5 | globlastp |
| LAB726_H77 | orange\|11v1\|CV716284_P1 | 3537 | 8051 | 578 | 88.5 | globlastp |
| LAB726_H78 | sunflower\|12v1\|EE633258 | 3538 | 8052 | 578 | 88.5 | globlastp |
| LAB726_H79 | poppy\|11v1\|SRR030259.322279_P1 | 3539 | 8053 | 578 | 88.3 | globlastp |
| LAB726_H384 | blueberry\|12v1\|SRR353282X100556D1_P1 | 3540 | 8054 | 578 | 88.2 | globlastp |
| LAB726_H80 | artemisia\|10v1\|EY037814_P1 | 3541 | 8055 | 578 | 88.2 | globlastp |
| LAB726_H81 | cotton\|11v1\|BF279079_P1 | 3542 | 8056 | 578 | 88.2 | globlastp |
| LAB726_H82 | flaveria\|11v1\|SRR149229.101075_P1 | 3543 | 8057 | 578 | 88.2 | globlastp |
| LAB726_H83 | flaveria\|11v1\|SRR149229.259124_P1 | 3544 | 8058 | 578 | 88.2 | globlastp |
| LAB726_H84 | flaveria\|11v1\|SRR149229.320303_P1 | 3545 | 8058 | 578 | 88.2 | globlastp |
| LAB726_H85 | gossypium_raimondii\|12v1\|BF279079_P1 | 3546 | 8056 | 578 | 88.2 | globlastp |
| LAB726_H86 | radish\|gb164\|EX777452 | 3547 | 8059 | 578 | 88.2 | globlastp |
| LAB726_H87 | triphysaria\|10v1\|BM357487 | 3548 | 8060 | 578 | 88.2 | globlastp |
| LAB726_H88 | flaveria\|11v1\|SRR149229.104464_T1 | 3549 | 8061 | 578 | 88.19 | glotblastn |
| LAB726_H89 | gossypium_raimondii\|12v1\|SRR032881.551349_T1 | 3550 | 8062 | 578 | 88.19 | glotblastn |
| LAB726_H385 | pepper\|12v1\|AA840647_P1 | 3551 | 8063 | 578 | 87.9 | globlastp |
| LAB726_H90 | aristolochia\|10v1\|FD762042_P1 | 3552 | 8064 | 578 | 87.9 | globlastp |
| LAB726_H91 | pepper\|gb171\|AA840647 | 3553 | 8063 | 578 | 87.9 | globlastp |
| LAB726_H92 | tripterygium\|11v1\|SRR098677X105253 | 3554 | 8065 | 578 | 87.9 | globlastp |
| LAB726_H386 | nicotiana_benthamiana\|12v1\|EG650260_P1 | 3555 | 8066 | 578 | 87.8 | globlastp |
| LAB726_H93 | arabidopsis_lyrata\|09v1\|JGIAL030925_P1 | 3556 | 8067 | 578 | 87.8 | globlastp |
| LAB726_H94 | arnica\|11v1\|SRR099034X102462_P1 | 3557 | 8068 | 578 | 87.8 | globlastp |
| LAB726_H95 | clementine\|11v1\|CO913282_P1 | 3558 | 8069 | 578 | 87.8 | globlastp |
| LAB726_H96 | clementine\|11v1\|CV716284_P1 | 3559 | 8070 | 578 | 87.8 | globlastp |
| LAB726_H97 | flaveria\|11v1\|SRR149229.102383_P1 | 3560 | 8071 | 578 | 87.8 | globlastp |
| LAB726_H98 | flaveria\|11v1\|SRR149229.237964_P1 | 3561 | 8072 | 578 | 87.8 | globlastp |
| LAB726_H99 | flaveria\|11v1\|SRR149232.131224_P1 | 3562 | 8073 | 578 | 87.8 | globlastp |
| LAB726_H100 | flaveria\|11v1\|SRR149232.168973_P1 | 3563 | 8074 | 578 | 87.8 | globlastp |
| LAB726_H101 | ipomoea_nil\|10v1\|BJ560716_P1 | 3564 | 8075 | 578 | 87.8 | globlastp |
| LAB726_H102 | oak\|10v1\|FP054742_P1 | 3565 | 8076 | 578 | 87.8 | globlastp |
| LAB726_H103 | orange\|11v1\|CO913282_P1 | 3566 | 8069 | 578 | 87.8 | globlastp |
| LAB726_H104 | sunflower\|12v1\|DY914832 | 3567 | 8077 | 578 | 87.8 | globlastp |
| LAB726_H105 | thellungiella_halophilum\|11v1\|DN772889 | 3568 | 8078 | 578 | 87.8 | globlastp |
| LAB726_H131 | chickpea\|13v2\|SRR133517.167801_P1 | 3569 | 8079 | 578 | 87.8 | globlastp |
| LAB726_H106 | tomato\|11v1\|AA840647 | 3570 | 8080 | 578 | 87.6 | globlastp |
| LAB726_H387 | onion\|12v1\|CF441482_P1 | 3571 | 8081 | 578 | 87.5 | globlastp |
| LAB726_H107 | flaveria\|11v1\|SRR149229.117438_P1 | 3572 | 8082 | 578 | 87.5 | globlastp |
| LAB726_H108 | flaveria\|11v1\|SRR149229.141013_P1 | 3573 | 8083 | 578 | 87.5 | globlastp |
| LAB726_H109 | flax\|11v1\|JG086905_P1 | 3574 | 8084 | 578 | 87.5 | globlastp |
| LAB726_H110 | orobanche\|10v1\|SRR023189S004745_P1 | 3575 | 8085 | 578 | 87.5 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
| --- | --- | --- | --- | --- | --- | --- |
| LAB726_H111 | peanut\|10v1\|CX128243_P1 | 3576 | 8086 | 578 | 87.5 | globlastp |
| LAB726_H112 | pigeonpea\|11v1\|SRR054580X113696_P1 | 3577 | 8087 | 578 | 87.5 | globlastp |
| LAB726_H113 | potato\|10v1\|BG351119_P1 | 3578 | 8088 | 578 | 87.5 | globlastp |
| LAB726_H114 | rye\|12v1\|DRR001012.117176 | 3579 | 8089 | 578 | 87.5 | glotblastn |
| LAB726_H115 | solanum_phureja\|09v1\|SPHBG128123 | 3580 | 8088 | 578 | 87.5 | globlastp |
| LAB726_H116 | triphysaria\|10v1\|EY134479 | 3581 | 8090 | 578 | 87.5 | globlastp |
| LAB726_H123 | poplar\|13v1\|BI128207_P1 | 3582 | 8091 | 578 | 87.5 | globlastp |
| LAB726_H159 | nicotiana_benthamiana\|12v1\|BP749565_P1 | 3583 | 8092 | 578 | 87.5 | globlastp |
| LAB726_H117 | eschscholzia\|11v1\|CK746554_P1 | 3584 | 8093 | 578 | 87.3 | globlastp |
| LAB726_H388 | banana\|12v1\|MAGEN2012031235_P1 | 3585 | 8094 | 578 | 87.2 | globlastp |
| LAB726_H389 | nicotiana_benthamiana\|12v1\|CN498792_P1 | 3586 | 8095 | 578 | 87.2 | globlastp |
| LAB726_H390 | pepper\|12v1\|BM064710_P1 | 3587 | 8096 | 578 | 87.2 | globlastp |
| LAB726_H118 | arabidopsis\|10v1\|AT5G62740_P1 | 3588 | 8097 | 578 | 87.2 | globlastp |
| LAB726_H119 | banana\|10v1\|FF557992 | 3589 | 8098 | 578 | 87.2 | globlastp |
| LAB726_H120 | eucalyptus\|11v2\|ES589326_P1 | 3590 | 8099 | 578 | 87.2 | globlastp |
| LAB726_H121 | oak\|10v1\|FP053562_P1 | 3591 | 8100 | 578 | 87.2 | globlastp |
| LAB726_H122 | pepper\|gb171\|BM064710 | 3592 | 8096 | 578 | 87.2 | globlastp |
| LAB726_H123 | poplar\|10v1\|CX182839 | 3593 | 8101 | 578 | 87.2 | globlastp |
| LAB726_H124 | potato\|10v1\|BG590188_P1 | 3594 | 8102 | 578 | 87.2 | globlastp |
| LAB726_H125 | solanum_phureja\|09v1\|SPHBG128859 | 3595 | 8102 | 578 | 87.2 | globlastp |
| LAB726_H126 | soybean\|11v1\|GLYMA17G10520 | 3596 | 8103 | 578 | 87.2 | globlastp |
| LAB726_H126 | soybean\|12v1\|GLYMA17G10520T3_P1 | 3597 | 8103 | 578 | 87.2 | globlastp |
| LAB726_H127 | sunflower\|12v1\|DY906726 | 3598 | 8104 | 578 | 87.2 | globlastp |
| LAB726_H128 | sunflower\|12v1\|DY938575 | 3599 | 8105 | 578 | 87.2 | globlastp |
| LAB726_H129 | tomato\|11v1\|BG128859 | 3600 | 8106 | 578 | 87.2 | globlastp |
| LAB726_H130 | tomato\|11v1\|NTU66271 | 3601 | 8107 | 578 | 87.2 | globlastp |
| LAB726_H131 | chickpea\|11v1\|SRR133517.167801 | 3602 | 8108 | 578 | 87.15 | glotblastn |
| LAB726_H132 | euphorbia\|11v1\|BP962714_P1 | 3603 | 8109 | 578 | 86.9 | globlastp |
| LAB726_H133 | guizotia\|10v1\|GE555049_T1 | 3604 | 8110 | 578 | 86.9 | glotblastn |
| LAB726_H134 | platanus\|11v1\|SRR096786X109212_P1 | 3605 | 8111 | 578 | 86.9 | globlastp |
| LAB726_H391 | aquilegia\|10v2\|DR936172_P1 | 3606 | 8112 | 578 | 86.8 | globlastp |
| LAB726_H392 | banana\|12v1\|FF557992_P1 | 3607 | 8113 | 578 | 86.8 | globlastp |
| LAB726_H393 | pepper\|12v1\|CA514695_P1 | 3608 | 8114 | 578 | 86.8 | globlastp |
| LAB726_H135 | ambrosia\|11v1\|SRR346935.104157_P1 | 3609 | 8115 | 578 | 86.8 | globlastp |
| LAB726_H136 | aquilegia\|10v1\|DR936172 | 3610 | 8112 | 578 | 86.8 | globlastp |
| LAB726_H137 | cirsium\|11v1\|SRR346952.1001426_P1 | 3611 | 8116 | 578 | 86.8 | globlastp |
| LAB726_H138 | cirsium\|11v1\|SRR346952.1036905_P1 | 3612 | 8117 | 578 | 86.8 | globlastp |
| LAB726_H139 | kiwi\|gb166\|FG406996_P1 | 3613 | 8118 | 578 | 86.8 | globlastp |
| LAB726_H140 | oak\|10v1\|SRR006307S0005597_P1 | 3614 | 8119 | 578 | 86.8 | globlastp |
| LAB726_H141 | pepper\|gb171\|CA514695 | 3615 | 8114 | 578 | 86.8 | globlastp |
| LAB726_H142 | tobacco\|gb162\|EB444324 | 3616 | 8120 | 578 | 86.8 | globlastp |
| LAB726_H143 | valeriana\|11v1\|SRR099039X101065 | 3617 | 8121 | 578 | 86.8 | globlastp |
| LAB726_H394 | lettuce\|12v1\|DW055218_P1 | 3618 | 8122 | 578 | 86.5 | globlastp |
| LAB726_H395 | nicotiana_benthamiana\|12v1\|CK294708_P1 | 3619 | 8123 | 578 | 86.5 | globlastp |
| LAB726_H144 | ambrosia\|11v1\|SRR346935.181380_P1 | 3620 | 8124 | 578 | 86.5 | globlastp |
| LAB726_H145 | amorphophallus\|11v2\|SRR089351X258636_P1 | 3621 | 8125 | 578 | 86.5 | globlastp |
| LAB726_H146 | artemisia\|10v1\|EY039911_P1 | 3622 | 8126 | 578 | 86.5 | globlastp |
| LAB726_H147 | cichorium\|gb171\|EH688063_P1 | 3623 | 8127 | 578 | 86.5 | globlastp |
| LAB726_H148 | lettuce\|10v1\|DW055218 | 3624 | 8128 | 578 | 86.5 | globlastp |
| LAB726_H149 | oil_palm\|11v1\|EY405316_P1 | 3625 | 8129 | 578 | 86.5 | globlastp |
| LAB726_H396 | bean\|12v2\|SRR001334.196998_P1 | 3626 | 8130 | 578 | 86.2 | globlastp |
| LAB726_H151 | medicago\|12v1\|AL367969_P1 | 3627 | 8131 | 578 | 86.2 | globlastp |
| LAB726_H152 | medicago\|12v1\|AW776032_P1 | 3628 | 8131 | 578 | 86.2 | globlastp |
| LAB726_H153 | tobacco\|gb162\|EB677602 | 3629 | 8132 | 578 | 86.2 | globlastp |
| LAB726_H154 | trigonella\|11v1\|SRR066194X138067 | 3630 | 8133 | 578 | 86.2 | globlastp |
| LAB726_H155 | trigonella\|11v1\|SRR066194X169402 | 3631 | 8134 | 578 | 86.2 | globlastp |
| LAB726_H156 | cotton\|11v1\|DT550327_P1 | 3632 | 8135 | 578 | 86.1 | globlastp |
| LAB726_H157 | ginger\|gb164\|DY364165_P1 | 3633 | 8136 | 578 | 86.1 | globlastp |
| LAB726_H158 | gossypium_raimondii\|12v1\|DT550327_P1 | 3634 | 8135 | 578 | 86.1 | globlastp |
| LAB726_H159 | nicotiana_benthamiana\|gb162\|CK287433 | 3635 | 8137 | 578 | 86.1 | globlastp |
| LAB726_H160 | oil_palm\|11v1\|ES414433_P1 | 3636 | 8138 | 578 | 86.1 | globlastp |
| LAB726_H161 | platanus\|11v1\|SRR096786X104589_P1 | 3637 | 8139 | 578 | 86.1 | globlastp |
| LAB726_H397 | nicotiana_benthamiana\|12v1\|EB677602_P1 | 3638 | 8140 | 578 | 85.9 | globlastp |
| LAB726_H162 | castorbean\|11v1\|EG657011_P1 | 3639 | 8141 | 578 | 85.8 | globlastp |
| LAB726_H162 | castorbean\|12v1\|EG657011_P1 | 3640 | 8141 | 578 | 85.8 | globlastp |
| LAB726_H163 | chestnut\|gb170\|SRR006295S0004975_P1 | 3641 | 8142 | 578 | 85.8 | globlastp |
| LAB726_H164 | dandelion\|10v1\|DR402791_P1 | 3642 | 8143 | 578 | 85.8 | globlastp |
| LAB726_H165 | medicago\|12v1\|AL384603_P1 | 3643 | 8144 | 578 | 85.8 | globlastp |
| LAB726_H166 | oil_palm\|11v1\|EL694397_P1 | 3644 | 8145 | 578 | 85.8 | globlastp |
| LAB726_H167 | poplar\|10v1\|BI124137 | 3645 | 8146 | 578 | 85.8 | globlastp |
| LAB726_H167 | poplar\|13v1\|BI124137_P1 | 3646 | 8146 | 578 | 85.8 | globlastp |
| LAB726_H168 | scabiosa\|11v1\|SRR063723X120961 | 3647 | 8147 | 578 | 85.8 | globlastp |
| LAB726_H169 | trigonella\|11v1\|SRR066194X238507 | 3648 | 8148 | 578 | 85.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB726_H398 | onion\|12v1\|FS209770_T1 | 3649 | 8149 | 578 | 85.76 | glotblastn |
| LAB726_H170 | medicago\|12v1\|AW685772_T1 | 3650 | 8150 | 578 | 85.76 | glotblastn |
| LAB726_H171 | amborella\|12v3\|CK744765_P1 | 3651 | 8151 | 578 | 85.5 | globlastp |
| LAB726_H172 | catharanthus\|11v1\|EG559311_T1 | 3652 | 8152 | 578 | 85.42 | glotblastn |
| LAB726_H399 | lettuce\|12v1\|DW051519_P1 | 3653 | 8153 | 578 | 85.4 | globlastp |
| LAB726_H173 | cassava\|09v1\|BM260131_P1 | 3654 | 8154 | 578 | 85.4 | globlastp |
| LAB726_H174 | cirsium\|11v1\|SRR346952.135170_P1 | 3655 | 8155 | 578 | 85.4 | globlastp |
| LAB726_H175 | lettuce\|10v1\|DW051519 | 3656 | 8153 | 578 | 85.4 | globlastp |
| LAB726_H176 | melon\|10v1\|AM723504_P1 | 3657 | 8156 | 578 | 85.4 | globlastp |
| LAB726_H177 | monkeyflower\|10v1\|GO966365 | 3658 | 8157 | 578 | 85.4 | globlastp |
| LAB726_H177 | monkeyflower\|12v1\|GR002759_P1 | 3659 | 8157 | 578 | 85.4 | globlastp |
| LAB726_H178 | oak\|10v1\|CU657562_P1 | 3660 | 8158 | 578 | 85.4 | globlastp |
| LAB726_H179 | silene\|11v1\|GH293451 | 3661 | 8159 | 578 | 85.4 | globlastp |
| LAB726_H180 | strawberry\|11v1\|CO379965 | 3662 | 8160 | 578 | 85.4 | globlastp |
| LAB726_H181 | tripterygium\|11v1\|SRR098677X130177 | 3663 | 8161 | 578 | 85.4 | globlastp |
| LAB726_H400 | prunus_mume\|13v1\|BF717130_P1 | 3664 | 8162 | 578 | 85.1 | globlastp |
| LAB726_H182 | cacao\|10v1\|CA797754_P1 | 3665 | 8163 | 578 | 85.1 | globlastp |
| LAB726_H183 | cucumber\|09v1\|CK085635_P1 | 3666 | 8164 | 578 | 85.1 | globlastp |
| LAB726_H184 | dandelion\|10v1\|DY830349_P1 | 3667 | 8165 | 578 | 85.1 | globlastp |
| LAB726_H185 | euphorbia\|11v1\|SRR098678X10570_P1 | 3668 | 8166 | 578 | 85.1 | globlastp |
| LAB726_H186 | euphorbia\|11v1\|SRR098678X116144_P1 | 3669 | 8167 | 578 | 85.1 | globlastp |
| LAB726_H187 | flaveria\|11v1\|SRR149232.24744_P1 | 3670 | 8168 | 578 | 85.1 | globlastp |
| LAB726_H188 | prunus\|10v1\|BF717130 | 3671 | 8162 | 578 | 85.1 | globlastp |
| LAB726_H189 | watermelon\|11v1\|AY365247 | 3672 | 8169 | 578 | 85.1 | globlastp |
| LAB726_H190 | beech\|11v1\|SRR006293.16872_T1 | 3673 | 8170 | 578 | 84.72 | glotblastn |
| LAB726_H401 | zostera\|12v1\|AM767854_P1 | 3674 | 8171 | 578 | 84.7 | globlastp |
| LAB726_H191 | beech\|11v1\|AM062955XX2_P1 | 3675 | 8172 | 578 | 84.7 | globlastp |
| LAB726_H192 | clementine\|11v1\|BQ623057_P1 | 3676 | 8173 | 578 | 84.7 | globlastp |
| LAB726_H193 | eucalyptus\|11v2\|CD669443_P1 | 3677 | 8174 | 578 | 84.7 | globlastp |
| LAB726_H194 | kiwi\|gb166\|FG397185_P1 | 3678 | 8175 | 578 | 84.7 | globlastp |
| LAB726_H195 | orange\|11v1\|BQ623057_P1 | 3679 | 8176 | 578 | 84.7 | globlastp |
| LAB726_H196 | phalaenopsis\|11v1\|SRR125771.1537798_P1 | 3680 | 8177 | 578 | 84.7 | globlastp |
| LAB726_H197 | poplar\|10v1\|AI162733 | 3681 | 8178 | 578 | 84.7 | globlastp |
| LAB726_H197 | poplar\|13v1\|AI162232_P1 | 3682 | 8178 | 578 | 84.7 | globlastp |
| LAB726_H198 | silene\|11v1\|GH292050 | 3683 | 8179 | 578 | 84.7 | globlastp |
| LAB726_H199 | soybean\|11v1\|GLYMA05G01360 | 3684 | 8180 | 578 | 84.7 | globlastp |
| LAB726_H199 | soybean\|12v1\|GLYMA05G01360_P1 | 3685 | 8180 | 578 | 84.7 | globlastp |
| LAB726_H200 | zostera\|10v1\|AM767854 | 3686 | 8171 | 578 | 84.7 | globlastp |
| LAB726_H402 | nicotiana_benthamiana\|12v1\|FS398095_P1 | 3687 | 8181 | 578 | 84.5 | globlastp |
| LAB726_H201 | poppy\|11v1\|SRR030259.15174_P1 | 3688 | 8182 | 578 | 84.5 | globlastp |
| LAB726_H403 | nicotiana_benthamiana\|12v1\|EH616463_P1 | 3689 | 8183 | 578 | 84.4 | globlastp |
| LAB726_H202 | amborella\|12v2\|CK760197 | 3690 | 8184 | 578 | 84.4 | globlastp |
| LAB726_H202 | amborella\|12v3\|CK760197_P1 | 3691 | 8184 | 578 | 84.4 | globlastp |
| LAB726_H203 | aquilegia\|10v1\|DR916092 | 3692 | 8185 | 578 | 84.4 | globlastp |
| LAB726_H204 | beet\|12v1\|BQ585853_P1 | 3693 | 8186 | 578 | 84.4 | globlastp |
| LAB726_H205 | cucurbita\|11v1\|SRR091276X100558_P1 | 3694 | 8187 | 578 | 84.4 | globlastp |
| LAB726_H206 | ginger\|gb164\|DY345315_P1 | 3695 | 8188 | 578 | 84.4 | globlastp |
| LAB726_H207 | grape\|11v1\|GSVIVT01020071001_P1 | 3696 | 8189 | 578 | 84.4 | globlastp |
| LAB726_H208 | pseudoroegneria\|gb167\|FF353788 | 3697 | 8190 | 578 | 84.4 | globlastp |
| LAB726_H209 | rice\|11v1\|BE040344 | 3698 | 8191 | 578 | 84.4 | globlastp |
| LAB726_H210 | trigonella\|11v1\|SRR066197X134539 | 3699 | 8192 | 578 | 84.4 | globlastp |
| LAB726_H211 | vinca\|11v1\|SRR098690X138394 | 3700 | 8193 | 578 | 84.4 | globlastp |
| LAB726_H212 | beech\|11v1\|SRR364508.21091_T1 | 3701 | 8194 | 578 | 84.38 | glotblastn |
| LAB726_H213 | oil_palm\|11v1\|SRR190698.105728_P1 | 3702 | 8195 | 578 | 84.2 | globlastp |
| LNU449_H18 | apple\|11v1\|CN492377_T1 | 3703 | 8196 | 578 | 84.14 | glotblastn |
| LAB726_H404 | aquilegia\|10v2\|DR916092_P1 | 3704 | 8197 | 578 | 84.1 | globlastp |
| LAB726_H214 | rye\|12v1\|DRR001012.157522 | 3705 | 8198 | 578 | 84.1 | globlastp |
| LAB726_H215 | rye\|12v1\|DRR001012.255806 | 3706 | 8198 | 578 | 84.1 | globlastp |
| LAB726_H216 | beech\|11v1\|SRR364434.106934_T1 | 3707 | 8199 | 578 | 84.03 | glotblastn |
| LAB726_H405 | banana\|12v1\|FF557627_P1 | 3708 | 8200 | 578 | 84 | globlastp |
| LAB726_H217 | b_juncea\|10v2\|E6ANDIZ01AZ57D | 3709 | 8201 | 578 | 84 | globlastp |
| LAB726_H218 | clementine\|11v1\|CF828859_P1 | 3710 | 8202 | 578 | 84 | globlastp |
| LAB726_H219 | fagopyrum\|11v1\|SRR063703X101349_P1 | 3711 | 8203 | 578 | 84 | globlastp |
| LAB726_H220 | orange\|11v1\|CF828859_P1 | 3712 | 8202 | 578 | 84 | globlastp |
| LAB726_H406 | banana\|12v1\|BBS2437T3_T1 | 3713 | 8204 | 578 | 83.78 | glotblastn |
| LAB726_H407 | blueberry\|12v1\|SRR353283X47351D1_P1 | 3714 | 8205 | 578 | 83.7 | globlastp |
| LAB726_H408 | onion\|12v1\|CF443554_P1 | 3715 | 8206 | 578 | 83.7 | globlastp |
| LAB726_H221 | apple\|11v1\|CN489572_P1 | 3716 | 8207 | 578 | 83.7 | globlastp |
| LAB726_H222 | avocado\|10v1\|CO997738_P1 | 3717 | 8208 | 578 | 83.7 | globlastp |
| LAB726_H223 | fagopyrum\|11v1\|SRR063689X113457_P1 | 3718 | 8209 | 578 | 83.7 | globlastp |
| LAB726_H224 | lettuce\|10v1\|DW088506 | 3719 | 8210 | 578 | 83.7 | globlastp |
| LAB726_H225 | lotus\|09v1\|BW600147_P1 | 3720 | 8211 | 578 | 83.7 | globlastp |
| LAB726_H226 | onion\|gb162\|CF443554 | 3721 | 8206 | 578 | 83.7 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB726_H227 | papaya\|gb165\|EX231164_P1 | 3722 | 8212 | 578 | 83.7 | globlastp |
| LAB726_H228 | phalaenopsis\|11v1\|SRR125771.101540_P1 | 3723 | 8213 | 578 | 83.7 | globlastp |
| LAB726_H229 | phyla\|11v2\|SRR099037X102964_P1 | 3724 | 8214 | 578 | 83.7 | globlastp |
| LAB726_H230 | rose\|12v1\|BI978292 | 3725 | 8215 | 578 | 83.7 | globlastp |
| LAB726_H231 | sorghum\|12v1\|SB07G019760 | 3726 | 8216 | 578 | 83.7 | globlastp |
| LAB726_H232 | flaveria\|11v1\|SRR149241.369236_T1 | 3727 | 8217 | 578 | 83.68 | glotblastn |
| LAB726_H233 | antirrhinum\|gb166\|AJ795647_P1 | 3728 | 8218 | 578 | 83.3 | globlastp |
| LAB726_H234 | beech\|11v1\|SRR006293.11831_P1 | 3729 | 8219 | 578 | 83.3 | globlastp |
| LAB726_H235 | chelidonium\|11v1\|SRR084752X105402_P1 | 3730 | 8220 | 578 | 83.3 | globlastp |
| LAB726_H236 | curcuma\|10v1\|DY387908_P1 | 3731 | 8221 | 578 | 83.3 | globlastp |
| LAB726_H237 | eschscholzia\|11v1\|CD478579_P1 | 3732 | 8222 | 578 | 83.3 | globlastp |
| LAB726_H238 | eucalyptus\|11v2\|CB967735_P1 | 3733 | 8223 | 578 | 83.3 | globlastp |
| LAB726_H239 | lotus\|09v1\|CRPLJ030056_P1 | 3734 | 8224 | 578 | 83.3 | globlastp |
| LAB726_H240 | maize\|10v1\|AI372347_P1 | 3735 | 8225 | 578 | 83.3 | globlastp |
| LAB726_H241 | soybean\|11v1\|GLYMA13G05120 | 3736 | 8226 | 578 | 83.3 | globlastp |
| LAB726_H241 | soybean\|12v1\|GLYMA13G05120T3_P1 | 3737 | 8226 | 578 | 83.3 | globlastp |
| LAB726_H242 | sugarcane\|10v1\|BQ536230 | 3738 | 8227 | 578 | 83.3 | globlastp |
| LAB726_H243 | triphysaria\|10v1\|EX995758 | 3739 | 8228 | 578 | 83.3 | globlastp |
| LAB726_H244 | cowpea\|12v1\|AM748429_P1 | 3740 | 8229 | 578 | 83.3 | globlastp |
| LAB726_H409 | blueberry\|12v1\|CV189924_P1 | 3741 | 8230 | 578 | 83 | globlastp |
| LAB726_H410 | switchgrass\|12v1\|FL772727_P1 | 3742 | 8231 | 578 | 83 | globlastp |
| LAB726_H244 | cowpea\|gb166\|AM748429 | 3743 | 8232 | 578 | 83 | globlastp |
| LAB726_H245 | fagopyrum\|11v1\|SRR063689X14225_P1 | 3744 | 8233 | 578 | 83 | globlastp |
| LAB726_H246 | peanut\|10v1\|EE124298_P1 | 3745 | 8234 | 578 | 83 | globlastp |
| LAB726_H247 | plantago\|11v2\|SRR066373X115177_P1 | 3746 | 8235 | 578 | 83 | globlastp |
| LAB726_H248 | fagopyrum\|11v1\|SRR063703X105112_T1 | 3747 | 8236 | 578 | 82.99 | glotblastn |
| LAB726_H249 | fagopyrum\|11v1\|SRR063689X114976_T1 | 3748 | 8237 | 578 | 82.64 | glotblastn |
| LAB726_H411 | bean\|12v2\|CB541531_P1 | 3749 | 8238 | 578 | 82.6 | globlastp |
| LAB726_H412 | nicotiana_benthamiana\|12v1\|AJ608729_P1 | 3750 | 8239 | 578 | 82.6 | globlastp |
| LAB726_H413 | switchgrass\|12v1\|FE603314_P1 | 3751 | 8240 | 578 | 82.6 | globlastp |
| LAB726_H250 | bean\|12v1\|CB541531 | 3752 | 8238 | 578 | 82.6 | globlastp |
| LAB726_H251 | chestnut\|gb170\|FK868407_P1 | 3753 | 8241 | 578 | 82.6 | globlastp |
| LAB726_H252 | cotton\|11v1\|CD485760_P1 | 3754 | 8242 | 578 | 82.6 | globlastp |
| LAB726_H253 | eucalyptus\|11v2\|DRR000893X1127112_P1 | 3755 | 8243 | 578 | 82.6 | globlastp |
| LAB726_H254 | foxtail_millet\|11v3\|PHY7SI014209M_P1 | 3756 | 8244 | 578 | 82.6 | globlastp |
| LAB726_H255 | gossypium_raimondii\|12v1\|DT461613_P1 | 3757 | 8242 | 578 | 82.6 | globlastp |
| LAB726_H256 | ipomoea_nil\|10v1\|CJ739745_P1 | 3758 | 8245 | 578 | 82.6 | globlastp |
| LAB726_H257 | medicago\|12v1\|AW683995_P1 | 3759 | 8246 | 578 | 82.6 | globlastp |
| LAB726_H258 | millet\|10v1\|CD724348_P1 | 3760 | 8247 | 578 | 82.6 | globlastp |
| LAB726_H259 | pigeonpea\|11v1\|SRR054580X109882_P1 | 3761 | 8248 | 578 | 82.6 | globlastp |
| LAB726_H260 | rice\|11v1\|CA759391 | 3762 | 8249 | 578 | 82.6 | globlastp |
| LAB726_H261 | soybean\|11v1\|GLYMA19G02370 | 3763 | 8250 | 578 | 82.6 | globlastp |
| LAB726_H261 | soybean\|12v1\|GLYMA19G02370_P1 | 3764 | 8250 | 578 | 82.6 | globlastp |
| LAB726_H262 | switchgrass\|gb167\|FE603314 | 3765 | 8240 | 578 | 82.6 | globlastp |
| LAB726_H263 | tobacco\|gb162\|EB425808 | 3766 | 8251 | 578 | 82.6 | globlastp |
| LAB726_H264 | trigonella\|11v1\|SRR066194X123567 | 3767 | 8246 | 578 | 82.6 | globlastp |
| LAB726_H265 | walnuts\|gb166\|CB303515 | 3768 | 8252 | 578 | 82.6 | globlastp |
| LAB726_H266 | b_rapa\|11v1\|CD816120_P1 | 3769 | 8253 | 578 | 82.3 | globlastp |
| LAB726_H267 | canola\|11v1\|CN732109_P1 | 3770 | 8253 | 578 | 82.3 | globlastp |
| LAB726_H268 | canola\|11v1\|DY006893_P1 | 3771 | 8253 | 578 | 82.3 | globlastp |
| LAB726_H269 | canola\|11v1\|SRR019556.35583_P1 | 3772 | 8253 | 578 | 82.3 | globlastp |
| LAB726_H270 | eucalyptus\|11v2\|SRR001659X118178_P1 | 3773 | 8254 | 578 | 82.3 | globlastp |
| LAB726_H271 | oak\|10v1\|CU656743_P1 | 3774 | 8255 | 578 | 82.3 | globlastp |
| LAB726_H272 | oak\|10v1\|FN724764_P1 | 3775 | 8255 | 578 | 82.3 | globlastp |
| LAB726_H273 | oak\|10v1\|FP038640_P1 | 3776 | 8256 | 578 | 82.3 | globlastp |
| LAB726_H274 | platanus\|11v1\|SRR096786X100632_P1 | 3777 | 8257 | 578 | 82.3 | globlastp |
| LAB726_H275 | poppy\|11v1\|FE964336_P1 | 3778 | 8258 | 578 | 82.3 | globlastp |
| LAB726_H276 | primula\|11v1\|SRR098679X110745_P1 | 3779 | 8259 | 578 | 82.3 | globlastp |
| LAB726_H277 | thellungiella_parvulum\|11v1\|DN774558 | 3780 | 8260 | 578 | 82.3 | globlastp |
| LAB726_H278 | triphysaria\|10v1\|EY131978 | 3781 | 8261 | 578 | 82.3 | globlastp |
| LAB726_H279 | vinca\|11v1\|SRR098690X105550 | 3782 | 8262 | 578 | 82.3 | globlastp |
| LAB726_H280 | humulus\|11v1\|GD252421_T1 | 3783 | 8263 | 578 | 82.29 | glotblastn |
| LAB726_H281 | olea\|11v1\|SRR014463.24300 | 3784 | 8264 | 578 | 82.29 | glotblastn |
| LAB726_H282 | sarracenia\|11v1\|SRR192669.122477 | 3785 | 8265 | 578 | 82.29 | glotblastn |
| LAB726_H283 | lotus\|09v1\|AW719394_P1 | 3786 | 8266 | 578 | 82 | globlastp |
| LAB726_H414 | switchgrass\|12v1\|FL881186_T1 | 3787 | 8267 | 578 | 81.94 | glotblastn |
| LAB726_H284 | ipomoea_batatas\|10v1\|EE879156_T1 | 3788 | 8268 | 578 | 81.94 | glotblastn |
| LAB726_H285 | radish\|gb164\|EW738149 | 3789 | 8269 | 578 | 81.94 | glotblastn |
| LAB726_H286 | sarracenia\|11v1\|SRR192669.134548 | 3790 | 8270 | 578 | 81.94 | glotblastn |
| LAB726_H287 | artemisia\|10v1\|EY080949_P1 | 3791 | 8271 | 578 | 81.9 | globlastp |
| LAB726_H288 | b_oleracea\|gb161\|DY027613_P1 | 3792 | 8272 | 578 | 81.9 | globlastp |
| LAB726_H289 | brachypodium\|12v1\|BRADI3G35370_P1 | 3793 | 8273 | 578 | 81.9 | globlastp |
| LAB726_H290 | chickpea\|11v1\|AJ131049 | 3794 | 8274 | 578 | 81.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB726_H290 | chickpea\|13v2\|AJ131049_P1 | 3795 | 8274 | 578 | 81.9 | globlastp |
| LAB726_H291 | cirsium\|11v1\|SRR346952.1015181_P1 | 3796 | 8275 | 578 | 81.9 | globlastp |
| LAB726_H292 | fraxinus\|11v1\|SRR058827.102459_P1 | 3797 | 8276 | 578 | 81.9 | globlastp |
| LAB726_H293 | nasturtium\|11v1\|GH163445_P1 | 3798 | 8277 | 578 | 81.9 | globlastp |
| LAB726_H294 | potato\|10v1\|BG590845_P1 | 3799 | 8278 | 578 | 81.9 | globlastp |
| LAB726_H295 | primula\|11v1\|SRR098679X221763_P1 | 3800 | 8279 | 578 | 81.9 | globlastp |
| LAB726_H296 | solanum_phureja\|09v1\|SPHBG590845 | 3801 | 8278 | 578 | 81.9 | globlastp |
| LAB726_H297 | thellungiella_halophilum\|11v1\|DN774558 | 3802 | 8280 | 578 | 81.9 | globlastp |
| LAB726_H298 | valeriana\|11v1\|SRR099039X103719 | 3803 | 8281 | 578 | 81.9 | globlastp |
| LAB726_H299 | cephalotaxus\|11v1\|SRR064395X100524_P1 | 3804 | 8282 | 578 | 81.7 | globlastp |
| LAB726_H300 | gossypium_raimondii\|12v1\|SRR032881.204042_T1 | 3805 | 8283 | 578 | 81.66 | glotblastn |
| LAB726_H415 | switchgrass\|12v1\|FE635964_P1 | 3806 | 8284 | 578 | 81.6 | globlastp |
| LAB726_H416 | switchgrass\|12v1\|GD018323_P1 | 3807 | 8284 | 578 | 81.6 | globlastp |
| LAB726_H301 | amorphophallus\|11v2\|SRR089351X300449_T1 | 3808 | 8285 | 578 | 81.6 | glotblastn |
| LAB726_H302 | cassava\|09v1\|JGICASSAVA43762VALIDM1_T1 | 3809 | 8286 | 578 | 81.6 | glotblastn |
| LAB726_H303 | foxtail_millet\|11v3\|PHY7SI036858M_T1 | 3810 | 8287 | 578 | 81.6 | glotblastn |
| LAB726_H304 | monkeyflower\|12v1\|GR153958_P1 | 3811 | 8288 | 578 | 81.6 | globlastp |
| LAB726_H305 | peanut\|10v1\|ES711659_P1 | 3812 | 8289 | 578 | 81.6 | globlastp |
| LAB726_H306 | radish\|gb164\|EW732570 | 3813 | 8290 | 578 | 81.6 | globlastp |
| LAB726_H307 | scabiosa\|11v1\|SRR063723X101769 | 3814 | 8291 | 578 | 81.6 | globlastp |
| LAB726_H308 | soybean\|11v1\|GLYMA02G02540 | 3815 | 8292 | 578 | 81.6 | globlastp |
| LAB726_H308 | soybean\|12v1\|GLYMA02G02530_P1 | 3816 | 8292 | 578 | 81.6 | globlastp |
| LAB726_H309 | switchgrass\|gb167\|FE635964 | 3817 | 8284 | 578 | 81.6 | globlastp |
| LAB726_H310 | fagopyrum\|11v1\|SRR063703X106005_T1 | 3818 | 8293 | 578 | 81.31 | glotblastn |
| LAB726_H311 | sequoia\|10v1\|SRR065044S0006791 | 3819 | 8294 | 578 | 81.3 | globlastp |
| LAB726_H312 | rye\|12v1\|DRR001012.205262 | 3820 | 8295 | 578 | 81.25 | glotblastn |
| LAB726_H313 | sarracenia\|11v1\|SRR192669.12655 | 3821 | 8296 | 578 | 81.25 | glotblastn |
| LAB726_H314 | wheat\|10v2\|BE405232 | 3822 | 8295 | 578 | 81.25 | glotblastn |
| LAB726_H314 | wheat\|12v3\|BE405232_T1 | 3823 | 8295 | 578 | 81.25 | glotblastn |
| LAB726_H341 | switchgrass\|12v1\|FL995735_T1 | 3824 | 8297 | 578 | 81.25 | glotblastn |
| LAB726_H315 | sarracenia\|11v1\|SRR192669.104561 | 3825 | 8298 | 578 | 81.23 | glotblastn |
| LAB726_H417 | wheat\|12v3\|BG274974_P1 | 3826 | 8299 | 578 | 81.2 | globlastp |
| LAB726_H418 | wheat\|12v3\|CA606376_P1 | 3827 | 8299 | 578 | 81.2 | globlastp |
| LAB726_H419 | wheat\|12v3\|CA656686_P1 | 3828 | 8299 | 578 | 81.2 | globlastp |
| LAB726_H420 | wheat\|12v3\|CA670179_P1 | 3829 | 8299 | 578 | 81.2 | globlastp |
| LAB726_H421 | zostera\|12v1\|SRR057351X11838D1_P1 | 3830 | 8300 | 578 | 81.2 | globlastp |
| LAB726_H316 | arabidopsis\|10v1\|AT1G69840_P1 | 3831 | 8301 | 578 | 81.2 | globlastp |
| LAB726_H317 | brachypodium\|12v1\|BRADI4G28640_P1 | 3832 | 8302 | 578 | 81.2 | globlastp |
| LAB726_H318 | cannabis\|12v1\|GR221241_P1 | 3833 | 8303 | 578 | 81.2 | globlastp |
| LAB726_H319 | cenchrus\|gb166\|AF325721_P1 | 3834 | 8304 | 578 | 81.2 | globlastp |
| LAB726_H320 | leymus\|gb166\|EG384892_P1 | 3835 | 8305 | 578 | 81.2 | globlastp |
| LAB726_H321 | petunia\|gb171\|CV293421_P1 | 3836 | 8306 | 578 | 81.2 | globlastp |
| LAB726_H322 | radish\|gb164\|EV525651 | 3837 | 8307 | 578 | 81.2 | globlastp |
| LAB726_H323 | sorghum\|12v1\|SB02G022890 | 3838 | 8308 | 578 | 81.2 | globlastp |
| LAB726_H324 | wheat\|10v2\|BE416273 | 3839 | 8299 | 578 | 81.2 | globlastp |
| LAB726_H324 | wheat\|12v3\|BE416273_P1 | 3840 | 8299 | 578 | 81.2 | globlastp |
| LAB726_H325 | zostera\|10v1\|SRR057351S0011839 | 3841 | 8300 | 578 | 81.2 | globlastp |
| LAB726_H326 | centaurea\|gb166\|EL934388_T1 | 3842 | 8309 | 578 | 81.08 | glotblastn |
| LAB726_H327 | distylium\|11v1\|SRR065077X100271_P1 | 3843 | 8310 | 578 | 81 | globlastp |
| LAB726_H422 | wheat\|12v3\|BE417232_P1 | 3844 | 8311 | 578 | 80.9 | globlastp |
| LAB726_H328 | arabidopsis_lyrata\|09v1\|JGIAL007199_P1 | 3845 | 8312 | 578 | 80.9 | globlastp |
| LAB726_H329 | barley\|10v2\|AK248988 | 3846 | 8313 | 578 | 80.9 | glotblastn |
| LAB726_H329 | barley\|12v1\|AK248988_T1 | 3847 | 8313 | 578 | 80.9 | glotblastn |
| LAB726_H330 | fraxinus\|11v1\|SRR058827.108481_T1 | 3848 | 8314 | 578 | 80.9 | glotblastn |
| LAB726_H331 | millet\|10v1\|EVO454PM015846_P1 | 3849 | 8315 | 578 | 80.9 | globlastp |
| LAB726_H332 | oak\|10v1\|FN732281_P1 | 3850 | 8316 | 578 | 80.9 | globlastp |
| LAB726_H333 | oat\|11v1\|CN814781_P1 | 3851 | 8317 | 578 | 80.9 | globlastp |
| LAB726_H334 | pseudoroegneria\|gb167\|FF340799 | 3852 | 8318 | 578 | 80.9 | globlastp |
| LAB726_H335 | rye\|12v1\|BE587309 | 3853 | 8318 | 578 | 80.9 | globlastp |
| LAB726_H336 | rye\|12v1\|DRR001012.100122 | 3854 | 8318 | 578 | 80.9 | globlastp |
| LAB726_H337 | rye\|12v1\|DRR001012.102416 | 3855 | 8318 | 578 | 80.9 | globlastp |
| LAB726_H338 | rye\|12v1\|DRR001012.197214 | 3856 | 8318 | 578 | 80.9 | globlastp |
| LAB726_H339 | rye\|12v1\|DRR001015.137689 | 3857 | 8319 | 578 | 80.9 | globlastp |
| LAB726_H340 | spruce\|11v1\|ES853572 | 3858 | 8320 | 578 | 80.9 | globlastp |
| LAB726_H341 | switchgrass\|gb167\|FL881186 | 3859 | 8321 | 578 | 80.9 | glotblastn |
| LAB726_H342 | maritime_pine\|10v1\|BX680559_T1 | 3860 | 8322 | 578 | 80.69 | glotblastn |
| LAB726_H423 | olea\|13v1\|SRR014463X41682D1_P1 | 3861 | 8323 | 578 | 80.6 | globlastp |
| LAB726_H424 | prunus_mume\|13v1\|DRR001905.20720_P1 | 3862 | 8324 | 578 | 80.6 | globlastp |
| LAB726_H343 | b_rapa\|11v1\|CX192388_P1 | 3863 | 8325 | 578 | 80.6 | globlastp |
| LAB726_H344 | barley\|10v2\|BE413353 | 3864 | 8326 | 578 | 80.6 | globlastp |
| LAB726_H344 | barley\|12v1\|BE413353_P1 | 3865 | 8326 | 578 | 80.6 | globlastp |
| LAB726_H345 | cirsium\|11v1\|SRR346952.101596_P1 | 3866 | 8327 | 578 | 80.6 | globlastp |
| LAB726_H346 | foxtail_millet\|11v3\|PHY7SI030729M_P1 | 3867 | 8328 | 578 | 80.6 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB726_H347 | oat\|11v1\|GO589928_P1 | 3868 | 8329 | 578 | 80.6 | globlastp |
| LAB726_H348 | peanut\|10v1\|EG028649_P1 | 3869 | 8330 | 578 | 80.6 | globlastp |
| LAB726_H349 | prunus\|10v1\|PPA020997M | 3870 | 8331 | 578 | 80.6 | globlastp |
| LAB726_H350 | rye\|12v1\|DRR001012.205576 | 3871 | 8332 | 578 | 80.6 | globlastp |
| LAB726_H351 | pseudoroegneria\|gb167\|FF345177 | 3872 | 8333 | 578 | 80.56 | glotblastn |
| LAB726_H352 | rice\|11v1\|GFXAC027038X15 | 3873 | 8334 | 578 | 80.56 | glotblastn |
| LAB726_H353 | spruce\|11v1\|ES868640 | 3874 | 8335 | 578 | 80.56 | glotblastn |
| LAB726_H354 | cannabis\|12v1\|JK501803_P1 | 3875 | 8336 | 578 | 80.4 | globlastp |
| LAB726_H425 | cowpea\|12v1\|FF383069_T1 | 3876 | 8337 | 578 | 80.28 | glotblastn |
| LAB726_H355 | podocarpus\|10v1\|SRR065014S0000335_T1 | 3877 | 8338 | 578 | 80.28 | glotblastn |
| LAB726_H356 | barley\|10v2\|CA027627 | 3878 | 8339 | 578 | 80.21 | glotblastn |
| LAB726_H356 | barley\|12v1\|BE413100_T1 | 3879 | 8339 | 578 | 80.21 | glotblastn |
| LAB726_H357 | cirsium\|11v1\|SRR346952.125051_T1 | 3880 | 8340 | 578 | 80.21 | glotblastn |
| LAB726_H358 | cleome_spinosa\|10v1\|GR933611_T1 | 3881 | 8341 | 578 | 80.21 | glotblastn |
| LAB726_H359 | gerbera\|09v1\|AJ754218_T1 | 3882 | 8342 | 578 | 80.21 | glotblastn |
| LAB726_H360 | maize\|10v1\|AF236374_T1 | 3883 | 8343 | 578 | 80.21 | glotblastn |
| LAB726_H361 | oil_palm\|11v1\|GH636081_T1 | 3884 | 8344 | 578 | 80.21 | glotblastn |
| LAB726_H362 | rye\|12v1\|DRR001012.140984 | 3885 | 8345 | 578 | 80.21 | glotblastn |
| LAB726_H363 | rye\|12v1\|DRR001012.312907 | 3886 | 8346 | 578 | 80.21 | glotblastn |
| LAB726_H426 | bean\|12v2\|SRR001334.300295_P1 | 3887 | 8347 | 578 | 80.2 | globlastp |
| LAB726_H364 | amsonia\|11v1\|SRR098688X111084_P1 | 3888 | 8348 | 578 | 80.2 | globlastp |
| LAB726_H365 | canola\|11v1\|EV171301_P1 | 3889 | 8349 | 578 | 80.2 | globlastp |
| LAB726_H366 | fescue\|gb161\|DT689570_P1 | 3890 | 8350 | 578 | 80.2 | globlastp |
| LAB726_H367 | pigeonpea\|11v1\|SRR054580X134167_P1 | 3891 | 8351 | 578 | 80.2 | globlastp |
| LAB726_H368 | pseudotsuga\|10v1\|SRR065119S0005689 | 3892 | 8352 | 578 | 80.2 | globlastp |
| LAB726_H369 | rye\|12v1\|BE493928 | 3893 | 8353 | 578 | 80.2 | globlastp |
| LAB726_H370 | rye\|12v1\|DRR001012.163121 | 3894 | 8353 | 578 | 80.2 | globlastp |
| LAB726_H371 | abies\|11v2\|SRR098676X121416_T1 | 3895 | 8354 | 578 | 80 | glotblastn |
| LAB727_H1 | foxtail_millet\|11v3\|PHY7SI001678M_P1 | 3896 | 8355 | 579 | 87.8 | globlastp |
| LAB727_H2 | maize\|10v1\|BG319933_P1 | 3897 | 8356 | 579 | 86.1 | globlastp |
| LAB727_H3 | wheat\|12v3\|AL823037_T1 | 3898 | 8357 | 579 | 84.47 | glotblastn |
| LAB728_H1 | brachypodium_12v1_BRADI3G45600_P1 | 3899 | 8358 | 580 | 93.4 | globlastp |
| LAB728_H2 | foxtail_millet\|11v3\|PHY7SI016733M_P1 | 3900 | 8359 | 580 | 92.4 | globlastp |
| LAB728_H3 | sorghum\|12v1\|SB04G022500 | 3901 | 8360 | 580 | 92 | globlastp |
| LAB728_H140 | switchgrass\|12v1\|FL904190_P1 | 3902 | 8361 | 580 | 90.8 | globlastp |
| LAB728_H4 | maize\|10v1\|AW126454_P1 | 3903 | 8362 | 580 | 90.7 | globlastp |
| LAB728_H141 | switchgrass\|12v1\|FL762967_P1 | 3904 | 8363 | 580 | 88.4 | globlastp |
| LAB728_H142 | switchgrass\|12v1\|FL690101_P1 | 3905 | 8364 | 580 | 85.6 | globlastp |
| LAB728_H5 | foxtail_millet\|11v3\|PHY7SI026154M_P1 | 3906 | 8365 | 580 | 85.6 | globlastp |
| LAB728_H6 | sorghum\|12v1\|SB05G005240 | 3907 | 8366 | 580 | 85.6 | globlastp |
| LAB728_H7 | switchgrass\|gb167\|FE606045 | 3908 | 8367 | 580 | 85.4 | globlastp |
| LAB728_H143 | banana\|12v1\|BBS3230T3_P1 | 3909 | 8368 | 580 | 85.3 | globlastp |
| LAB728_H144 | banana\|12v1\|MAGEN2012031954_P1 | 3910 | 8369 | 580 | 85.3 | globlastp |
| LAB728_H8 | oil_palm\|11v1\|EL685212_P1 | 3911 | 8370 | 580 | 85.3 | globlastp |
| LAB728_H9 | rice\|11v1\|AA231730 | 3912 | 8371 | 580 | 85.3 | globlastp |
| LAB728_H145 | banana\|12v1\|MAGEN2012006094_P1 | 3913 | 8372 | 580 | 84.7 | globlastp |
| LAB728_H10 | cotton\|11v1\|BG443576_P1 | 3914 | 8373 | 580 | 84.7 | globlastp |
| LAB728_H11 | maize\|10v1\|AW355852_P1 | 3915 | 8374 | 580 | 84.7 | globlastp |
| LAB728_H12 | oil_palm\|11v1\|GH637480_P1 | 3916 | 8375 | 580 | 84.7 | globlastp |
| LAB728_H13 | brachypodium\|12v1\|BRADI4G23990_P1 | 3917 | 8376 | 580 | 84.6 | globlastp |
| LAB728_H14 | grape\|11v1\|GSVIVT01023343001_P1 | 3918 | 8377 | 580 | 84.1 | globlastp |
| LAB728_H15 | prunus\|10v1\|BU048263 | 3919 | 8378 | 580 | 84 | globlastp |
| LAB728_H146 | prunus_mume\|13v1\|BU048263_P1 | 3920 | 8379 | 580 | 83.7 | globlastp |
| LAB728_H16 | strawberry\|11v1\|DV438068 | 3921 | 8380 | 580 | 83.7 | globlastp |
| LAB728_H17 | wheat\|10v2\|BE400578 | 3922 | 8381 | 580 | 83.7 | globlastp |
| LAB728_H147 | barley\|12v1\|AV916799_P1 | 3923 | 8382 | 580 | 83.6 | globlastp |
| LAB728_H148 | switchgrass\|12v1\|FE608007_P1 | 3924 | 8383 | 580 | 83.6 | globlastp |
| LAB728_H18 | aristolochia\|10v1\|SRR039082S0017898_P1 | 3925 | 8384 | 580 | 83.6 | globlastp |
| LAB728_H19 | solanum_phureja\|09v1\|SPHAW218930 | 3926 | 8385 | 580 | 83.6 | globlastp |
| LAB728_H20 | rye\|12v1\|DRR001012.117287 | 3927 | 8386 | 580 | 83.58 | glotblastn |
| LAB728_H21 | rye\|12v1\|DRR001012.101144 | 3928 | 8387 | 580 | 83.4 | globlastp |
| LAB728_H22 | orange\|11v1\|CF505289_T1 | 3929 | 8388 | 580 | 83.31 | glotblastn |
| LAB728_H149 | aquilegia\|10v2\|DR916618_P1 | 3930 | 8389 | 580 | 83.3 | globlastp |
| LAB728_H23 | aquilegia\|10v1\|DR916618 | 3931 | 8389 | 580 | 83.3 | globlastp |
| LAB728_H24 | clementine\|11v1\|CF505289_P1 | 3932 | 8390 | 580 | 83.3 | globlastp |
| LAB728_H25 | eucalyptus\|11v2\|CD669654_P1 | 3933 | 8391 | 580 | 83.3 | globlastp |
| LAB728_H26 | sorghum\|12v1\|SB08G004730 | 3934 | 8392 | 580 | 83.2 | globlastp |
| LAB728_H27 | sugarcane\|10v1\|BQ533242 | 3935 | 8393 | 580 | 83.2 | globlastp |
| LAB728_H28 | tomato\|11v1\|AW218930 | 3936 | 8394 | 580 | 83.2 | globlastp |
| LAB728_H35 | wheat\|12v3\|BE401438_P1 | 3937 | 8395 | 580 | 83.2 | globlastp |
| LAB728_H29 | foxtail_millet\|11v3\|PHY7SI009738M_P1 | 3938 | 8396 | 580 | 83.1 | globlastp |
| LAB728_H30 | rice\|11v1\|AU091909 | 3939 | 8397 | 580 | 83.1 | globlastp |
| LAB728_H31 | apple\|11v1\|CN488913_P1 | 3940 | 8398 | 580 | 83 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB728_H32 | maize|10v1|AI600968_P1 | 3941 | 8399 | 580 | 83 | globlastp |
| LAB728_H33 | maize|10v1|AI612399_P1 | 3942 | 8400 | 580 | 83 | globlastp |
| LAB728_H34 | monkeyflower|12v1|DV208419_P1 | 3943 | 8401 | 580 | 83 | globlastp |
| LAB728_H35 | wheat|10v2|BE400911 | 3944 | 8402 | 580 | 83 | globlastp |
| LAB728_H36 | potato|10v1|BG095839_P1 | 3945 | 8403 | 580 | 82.9 | globlastp |
| LAB728_H37 | rye|12v1|BE588002 | 3946 | 8404 | 580 | 82.9 | globlastp |
| LAB728_H38 | solanum_phureja|09v1|SPHBG130883 | 3947 | 8403 | 580 | 82.9 | globlastp |
| LAB728_H150 | nicotiana_benthamiana|12v1|BP746865_P1 | 3948 | 8405 | 580 | 82.8 | globlastp |
| LAB728_H39 | cotton|11v1|BQ401499_P1 | 3949 | 8406 | 580 | 82.8 | globlastp |
| LAB728_H40 | cotton|11v1|BQ411048XX1_T1 | 3950 | 8407 | 580 | 82.8 | glotblastn |
| LAB728_H151 | wheat|12v3|BE499310_P1 | 3951 | 8408 | 580 | 82.7 | globlastp |
| LAB728_H152 | wheat|12v3|BG263848_P1 | 3952 | 8409 | 580 | 82.7 | globlastp |
| LAB728_H41 | apple|11v1|CN444346_P1 | 3953 | 8410 | 580 | 82.7 | globlastp |
| LAB728_H42 | tomato|11v1|BG130883 | 3954 | 8411 | 580 | 82.6 | globlastp |
| LAB728_H153 | banana|12v1|ES432280_P1 | 3955 | 8412 | 580 | 82.5 | globlastp |
| LAB728_H154 | wheat|12v3|BE499606_P1 | 3956 | 8413 | 580 | 82.5 | globlastp |
| LAB728_H43 | brachypodium|12v1|BRADI4G41270_P1 | 3957 | 8414 | 580 | 82.5 | globlastp |
| LAB728_H44 | cotton|11v1|AI725838_P1 | 3958 | 8415 | 580 | 82.5 | globlastp |
| LAB728_H68 | poplar|13v1|BU834302_P1 | 3959 | 8416 | 580 | 82.5 | globlastp |
| LAB728_H155 | zostera|12v1|SRR057351X100431D1_P1 | 3960 | 8417 | 580 | 82.4 | globlastp |
| LAB728_H156 | soybean|12v1|GLYMA08G20100_P1 | 3961 | 8418 | 580 | 82.3 | globlastp |
| LAB728_H45 | chestnut|gb170|SRR006295S0007143_P1 | 3962 | 8419 | 580 | 82.3 | globlastp |
| LAB728_H46 | euonymus|11v1|SRR070038X161748_P1 | 3963 | 8420 | 580 | 82.3 | globlastp |
| LAB728_H47 | pigeonpea|11v1|GR466200_P1 | 3964 | 8421 | 580 | 82.3 | globlastp |
| LAB728_H48 | ambrosia|11v1|SRR346935.10455_T1 | 3965 | 8422 | 580 | 82.27 | glotblastn |
| LAB728_H157 | bean|12v2|SRR001334.108110_T1 | 3966 | 8423 | 580 | 82.24 | glotblastn |
| LAB728_H50 | barley|10v2|BG299366 | 3967 | 8424 | 580 | 82.2 | globlastp |
| LAB728_H51 | humulus|11v1|EX516617XX1_P1 | 3968 | 8425 | 580 | 82.2 | globlastp |
| LAB728_H52 | oak|10v1|CU656922_P1 | 3969 | 8426 | 580 | 82.2 | globlastp |
| LAB728_H53 | chelidonium|11v1|SRR084752X101408_T1 | 3970 | 8427 | 580 | 82.12 | glotblastn |
| LAB728_H54 | euonymus|11v1|SRR070038X167447_P1 | 3971 | 8428 | 580 | 82.1 | globlastp |
| LAB728_H55 | poppy|11v1|FE964330XX1_P1 | 3972 | 8429 | 580 | 82.1 | globlastp |
| LAB728_H56 | poppy|11v1|SRR030259.106114_P1 | 3973 | 8430 | 580 | 82.1 | globlastp |
| LAB728_H57 | soybean|11v1|GLYMA12G29120 | 3974 | 8431 | 580 | 82.1 | globlastp |
| LAB728_H57 | soybean|12v1|GLYMA12G29120_P1 | 3975 | 8431 | 580 | 82.1 | globlastp |
| LAB728_H158 | switchgrass|12v1|FL704878_P1 | 3976 | 8432 | 580 | 82 | globlastp |
| LAB728_H58 | watermelon|11v1|CO995207 | 3977 | 8433 | 580 | 82 | globlastp |
| LAB728_H59 | eschscholzia|11v1|SRR014116.117210_T1 | 3978 | 8434 | 580 | 81.96 | glotblastn |
| LAB728_H60 | cassava|09v1|DR085771_P1 | 3979 | 8435 | 580 | 81.9 | globlastp |
| LAB728_H61 | valeriana|11v1|SRR099039X102448 | 3980 | 8436 | 580 | 81.9 | globlastp |
| LAB728_H62 | amorphophallus|11v2|SRR089351X204773_T1 | 3981 | 8437 | 580 | 81.8 | glotblastn |
| LAB728_H63 | gossypium_raimondii|12v1|BQ401499_P1 | 3982 | 8438 | 580 | 81.8 | globlastp |
| LAB728_H64 | sunflower|12v1|AJ828364 | 3983 | 8439 | 580 | 81.8 | globlastp |
| LAB728_H65 | cassava|09v1|CK645768_T1 | 3984 | 8440 | 580 | 81.79 | glotblastn |
| LAB728_H159 | switchgrass|12v1|DN152589_P1 | 3985 | 8441 | 580 | 81.7 | globlastp |
| LAB728_H66 | amsonia|11v1|SRR098688X101148_P1 | 3986 | 8442 | 580 | 81.7 | globlastp |
| LAB728_H67 | flaveria|11v1|SRR149229.121129_P1 | 3987 | 8443 | 580 | 81.7 | globlastp |
| LAB728_H68 | poplar|10v1|BU834302 | 3988 | 8444 | 580 | 81.7 | globlastp |
| LAB728_H69 | melon|10v1|AM725980_P1 | 3989 | 8445 | 580 | 81.6 | globlastp |
| LAB728_H70 | flaveria|11v1|SRR149229.248624_T1 | 3990 | 8446 | 580 | 81.59 | glotblastn |
| LAB728_H71 | ambrosia|11v1|SRR346943.179042_T1 | 3991 | 8447 | 580 | 81.51 | glotblastn |
| LAB728_H160 | wheat|12v3|BE400578_P1 | 3992 | 8448 | 580 | 81.5 | globlastp |
| LAB728_H50 | barley|12v1|BG299366_P1 | 3993 | 8449 | 580 | 81.5 | globlastp |
| LAB728_H72 | arabidopsis_lyrata|09v1|JGIAL001111_P1 | 3994 | 8450 | 580 | 81.5 | globlastp |
| LAB728_H73 | arabidopsis|10v1|AT1G10950_P1 | 3995 | 8451 | 580 | 81.5 | globlastp |
| LAB728_H74 | cucumber|09v1|CO995207_P1 | 3996 | 8452 | 580 | 81.5 | globlastp |
| LAB728_H75 | tripterygium|11v1|SRR098677X101310 | 3997 | 8453 | 580 | 81.45 | glotblastn |
| LAB728_H76 | castorbean|12v1|EG668282_P1 | 3998 | 8454 | 580 | 81.4 | globlastp |
| LAB728_H77 | phalaenopsis|11v1|SRR125771.102425_P1 | 3999 | 8455 | 580 | 81.4 | globlastp |
| LAB728_H161 | olea|13v1|SRR014463X15625D1_P1 | 4000 | 8456 | 580 | 81.3 | globlastp |
| LAB728_H78 | distylium|11v1|SRR065077X102421_T1 | 4001 | 8457 | 580 | 81.3 | glotblastn |
| LAB728_H79 | gossypium_raimondii|12v1|AI725838_P1 | 4002 | 8458 | 580 | 81.3 | globlastp |
| LAB728_H80 | sequoia|10v1|SRR065044S0008008 | 4003 | 8459 | 580 | 81.3 | globlastp |
| LAB728_H81 | soybean|11v1|GLYMA08G20100 | 4004 | 8460 | 580 | 81.3 | globlastp |
| LAB728_H82 | sunflower|12v1|EE634605 | 4005 | 8461 | 580 | 81.3 | globlastp |
| LAB728_H83 | thellungiella_halophilum|11v1|DN776428 | 4006 | 8462 | 580 | 81.3 | globlastp |
| LAB728_H97 | poplar|13v1|AI161458_P1 | 4007 | 8463 | 580 | 81.3 | globlastp |
| LAB728_H84 | canola|11v1|EE438738XX1_T1 | 4008 | 8464 | 580 | 81.28 | glotblastn |
| LAB728_H85 | amborella|12v3|SRR038634.23347_P1 | 4009 | 8465 | 580 | 81.2 | globlastp |
| LAB728_H86 | phalaenopsis|11v1|SRR125771.1045236_P1 | 4010 | 8466 | 580 | 81.2 | globlastp |
| LAB728_H87 | b_rapa|11v1|DY029522_T1 | 4011 | 8467 | 580 | 81.11 | glotblastn |
| LAB728_H88 | canola|11v1|EE482164_T1 | 4012 | 8468 | 580 | 81.11 | glotblastn |
| LAB728_H162 | chickpea|13v2|SRR133517.124960_P1 | 4013 | 8469 | 580 | 81.1 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB728_H89 | flaveria\|11v1\|SRR149232.235751_P1 | 4014 | 8470 | 580 | 81.1 | globlastp |
| LAB728_H90 | plantago\|11v2\|SRR066373X123829_P1 | 4015 | 8471 | 580 | 81.1 | globlastp |
| LAB728_H91 | tomato\|11v1\|AW980045 | 4016 | 8472 | 580 | 81.1 | globlastp |
| LAB728_H163 | zostera\|12v1\|SRR057351X104986D1_T1 | 4017 | 8473 | 580 | 81.08 | glotblastn |
| LAB728_H92 | ambrosia\|11v1\|SRR346935.173589_T1 | 4018 | 8474 | 580 | 81.08 | glotblastn |
| LAB728_H93 | zostera\|10v1\|SRR057351S0003050 | 4019 | 8475 | 580 | 81.08 | glotblastn |
| LAB728_H94 | abies\|11v2\|SRR098676X108300_P1 | 4020 | 8476 | 580 | 81 | globlastp |
| LAB728_H95 | flaveria\|11v1\|SRR149229.177296_T1 | 4021 | 8477 | 580 | 81 | glotblastn |
| LAB728_H96 | phalaenopsis\|11v1\|CB035062_P1 | 4022 | 8478 | 580 | 81 | globlastp |
| LAB728_H97 | poplar\|10v1\|BI129900 | 4023 | 8479 | 580 | 81 | globlastp |
| LAB728_H98 | soybean\|11v1\|GLYMA05G30210 | 4024 | 8480 | 580 | 81 | globlastp |
| LAB728_H98 | soybean\|12v1\|GLYMA05G30210_P1 | 4025 | 8480 | 580 | 81 | globlastp |
| LAB728_H99 | thellungiella_parvulum\|11v1\|BY802665 | 4026 | 8481 | 580 | 80.94 | glotblastn |
| LAB728_H100 | vinca\|11v1\|SRR098690X207017 | 4027 | 8482 | 580 | 80.91 | glotblastn |
| LAB728_H101 | arnica\|11v1\|SRR099034X103714_P1 | 4028 | 8483 | 580 | 80.9 | globlastp |
| LAB728_H102 | artemisia\|10v1\|SRR019254S0005312_P1 | 4029 | 8484 | 580 | 80.9 | globlastp |
| LAB728_H103 | canola\|11v1\|EE536558_P1 | 4030 | 8485 | 580 | 80.9 | globlastp |
| LAB728_H104 | thellungiella_halophilum\|11v1\|EC599452 | 4031 | 8486 | 580 | 80.9 | globlastp |
| LAB728_H164 | bean\|12v2\|CB540471_P1 | 4032 | 8487 | 580 | 80.8 | globlastp |
| LAB728_H165 | zostera\|12v1\|SRR057351X108977D1_P1 | 4033 | 8488 | 580 | 80.8 | globlastp |
| LAB728_H105 | b_rapa\|11v1\|CD814617_P1 | 4034 | 8489 | 580 | 80.8 | globlastp |
| LAB728_H106 | bean\|12v1\|CB540471 | 4035 | 8487 | 580 | 80.8 | globlastp |
| LAB728_H107 | canola\|11v1\|EE482091_P1 | 4036 | 8490 | 580 | 80.8 | globlastp |
| LAB728_H108 | grape\|11v1\|GSVIVT01026057001_P1 | 4037 | 8491 | 580 | 80.8 | globlastp |
| LAB728_H109 | medicago\|12v1\|AA660311_P1 | 4038 | 8492 | 580 | 80.8 | globlastp |
| LAB728_H110 | pigeonpea\|11v1\|GW355237_P1 | 4039 | 8493 | 580 | 80.8 | globlastp |
| LAB728_H111 | solanum_phureja\|09v1\|SPHAW980045 | 4040 | 8494 | 580 | 80.8 | globlastp |
| LAB728_H112 | soybean\|11v1\|GLYMA08G13370 | 4041 | 8495 | 580 | 80.8 | globlastp |
| LAB728_H112 | soybean\|12v1\|GLYMA08G13370_P1 | 4042 | 8495 | 580 | 80.8 | globlastp |
| LAB728_H113 | tabernaemontana\|11v1\|SRR098689X121083 | 4043 | 8496 | 580 | 80.8 | globlastp |
| LAB728_H114 | sciadopitys\|10v1\|SRR065035S0101685 | 4044 | 8497 | 580 | 80.74 | glotblastn |
| LAB728_H115 | cedrus\|11v1\|SRR065007X11559_P1 | 4045 | 8498 | 580 | 80.7 | globlastp |
| LAB728_H116 | orobanche\|10v1\|SRR023189S0001474_P1 | 4046 | 8499 | 580 | 80.7 | globlastp |
| LAB728_H117 | peanut\|10v1\|EG029513_P1 | 4047 | 8500 | 580 | 80.7 | globlastp |
| LAB728_H118 | ambrosia\|11v1\|SRR346935.108182JT1 | 4048 | 8501 | 580 | 80.64 | glotblastn |
| LAB728_H119 | cannabis\|12v1\|GR221358_T1 | 4049 | 8502 | 580 | 80.64 | glotblastn |
| LAB728_H120 | zostera\|10v1\|SRR057351S0007836 | 4050 | 8503 | 580 | 80.61 | glotblastn |
| LAB728_H121 | pine\|10v2\|AW290741_P1 | 4051 | 8504 | 580 | 80.6 | globlastp |
| LAB728_H122 | pseudotsuga\|10v1\|SRR065119S0022990 | 4052 | 8505 | 580 | 80.6 | globlastp |
| LAB728_H123 | trigonella\|11v1\|SRR066194X128074 | 4053 | 8506 | 580 | 80.6 | globlastp |
| LAB728_H166 | amborella\|12v3\|SRR038644.508290_T1 | 4054 | 8507 | 580 | 80.57 | glotblastn |
| LAB728_H124 | ambrosia\|11v1\|SRR346935.222870_T1 | 4055 | 8508 | 580 | 80.5 | glotblastn |
| LAB728_H125 | euphorbia\|11v1\|DV119884_P1 | 4056 | 8509 | 580 | 80.5 | globlastp |
| LAB728_H126 | thellungiella_parvulum\|11v1\|DN776428 | 4057 | 8510 | 580 | 80.5 | globlastp |
| LAB728_H127 | triphysaria\|10v1\|EY173064 | 4058 | 8511 | 580 | 80.41 | glotblastn |
| LAB728_H128 | orobanche\|10v1\|SRR023189S0004653_P1 | 4059 | 8512 | 580 | 80.4 | globlastp |
| LAB728_H129 | ambrosia\|11v1\|SRR346935.178351_P1 | 4060 | 8513 | 580 | 80.3 | globlastp |
| LAB728_H130 | trigonella\|11v1\|SRR066194X115429 | 4061 | 8514 | 580 | 80.3 | globlastp |
| LAB728_H131 | lotus\|09v1\|BP041471_T1 | 4062 | 8515 | 580 | 80.27 | glotblastn |
| LAB728_H132 | centaurea\|gb166\|EH713087_T1 | 4063 | 8516 | 580 | 80.24 | glotblastn |
| LAB728_H167 | blueberry\|12v1\|CV191186_T1 | 4064 | 8517 | 580 | 80.23 | glotblastn |
| LAB728_H168 | cowpea\|12v1\|FF395857_P1 | 4065 | 8518 | 580 | 80.2 | globlastp |
| LAB728_H133 | monkeyflower\|12v1\|DV208545_P1 | 4066 | 8519 | 580 | 80.2 | globlastp |
| LAB728_H134 | ambrosia\|11v1\|SRR346935.334999_T1 | 4067 | 8520 | 580 | 80.13 | glotblastn |
| LAB728_H135 | amorphophallus\|11v2\|SRR089351X102383_P1 | 4068 | 8521 | 580 | 80.1 | globlastp |
| LAB728_H136 | b_rapa\|11v1\|CD828399_P1 | 4069 | 8522 | 580 | 80.1 | globlastp |
| LAB728_H137 | canola\|11v1\|EE562156_T1 | 4070 | 8523 | 580 | 80.1 | glotblastn |
| LAB728_H138 | cirsium\|11v1\|SRR346952.1025144_P1 | 4071 | 8524 | 580 | 80.1 | globlastp |
| LAB728_H139 | medicago\|12v1\|AI974779_P1 | 4072 | 8525 | 580 | 80.1 | globlastp |
| LAB729_H1 | barley\|10v2\|AV834870 | 4073 | 8526 | 581 | 80.59 | glotblastn |
| LAB729_H2 | foxtail_millet\|11v3\|PHY7SI006747M_T1 | 4074 | 8527 | 581 | 80.59 | glotblastn |
| LAB729_H5 | switchgrass\|12v1\|FE635085_T1 | 4075 | 8528 | 581 | 80.59 | glotblastn |
| LAB729_H3 | maize\|10v1\|BI233587_P1 | 4076 | 8529 | 581 | 80.2 | globlastp |
| LAB729_H4 | lovegrass\|gb167\|EH188628_T1 | 4077 | 8530 | 581 | 80.17 | glotblastn |
| LAB729_H5 | switchgrass\|gb167\|FE635086 | 4078 | 8531 | 581 | 80.17 | glotblastn |
| LAB733_H1 | rice\|11v1\|BE228642 | 4079 | 8532 | 585 | 97.5 | globlastp |
| LAB733_H2 | brachypodium\|12v1\|BRADI2G15630_P1 | 4080 | 8533 | 585 | 84.1 | globlastp |
| LAB733_H3 | foxtail_millet\|11v3\|EC613863_P1 | 4081 | 8534 | 585 | 81.4 | globlastp |
| LAB733_H4 | oat\|11v1\|GR316970_P1 | 4082 | 8535 | 585 | 81 | globlastp |
| LAB733_H7 | switchgrass\|12v1\|FE644413_P1 | 4083 | 8536 | 585 | 80.7 | globlastp |
| LAB733_H8 | switchgrass\|12v1\|DN143122_P1 | 4084 | 8537 | 585 | 80.4 | globlastp |
| LAB733_H9 | wheat\|12v3\|BE591325_T1 | 4085 | 8538 | 585 | 80 | glotblastn |
| LAB733_H5 | barley\|10v2\|BE437797 | 4086 | 8539 | 585 | 80 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB733_H6 | maize\|10v1\|BM501431_T1 | 4087 | 8540 | 585 | 80 | glotblastn |
| LAB734_H1 | sorghum\|12v1\|SB04G030260 | 4088 | 8541 | 586 | 80.7 | globlastp |
| LAB735_H1 | foxtail_millet\|11v3\|PHY7SI029502M_P1 | 4089 | 8542 | 587 | 86.8 | globlastp |
| LAB735_H2 | sorghum\|12v1\|SB02G038090 | 4090 | 8543 | 587 | 86.1 | globlastp |
| LAB735_H6 | barley\|12v1\|AW982945_P1 | 4091 | 8544 | 587 | 85.3 | globlastp |
| LAB735_H3 | maize\|10v1\|T70636_P1 | 4092 | 8545 | 587 | 85 | globlastp |
| LAB735_H4 | brachypodium\|12v1\|BRADI1G22870_P1 | 4093 | 8546 | 587 | 82.9 | globlastp |
| LAB735_H5 | maize\|10v1\|CD568493_P1 | 4094 | 8547 | 587 | 82.3 | globlastp |
| LAB736_H1 | sugarcane\|10v1\|AA644740 | 4095 | 8548 | 588 | 94.2 | globlastp |
| LAB736_H2 | foxtail_millet\|11v3\|EC613905_T1 | 4096 | 8549 | 588 | 93.82 | glotblastn |
| LAB736_H3 | foxtail_millet\|11v3\|EC612809_P1 | 4097 | 8550 | 588 | 93.8 | globlastp |
| LAB736_H4 | millet\|10v1\|CD725278_P1 | 4098 | 8551 | 588 | 93.8 | globlastp |
| LAB736_H5 | switchgrass\|gb167\|DW177243 | 4099 | 8552 | 588 | 93.8 | globlastp |
| LAB736_H6 | switchgrass\|gb167\|FE642331 | 4100 | 8552 | 588 | 93.8 | globlastp |
| LAB736_H5, LAB736_H6 | switchgrass\|12v1\|FE598015_P1 | 4101 | 8552 | 588 | 93.8 | globlastp |
| LAB736_H7 | maize\|10v1\|AA030697_P1 | 4102 | 8553 | 588 | 93.4 | globlastp |
| LAB736_H8 | millet\|10v1\|EVO454PM010191_P1 | 4103 | 8554 | 588 | 93.4 | globlastp |
| LAB736_H9 | rice\|11v1\|AA750586 | 4104 | 8555 | 588 | 93.4 | globlastp |
| LAB736_H10 | rice\|11v1\|AA751627 | 4105 | 8555 | 588 | 93.4 | globlastp |
| LAB736_H11 | sugarcane\|10v1\|CA068735 | 4106 | 8556 | 588 | 93.4 | globlastp |
| LAB736_H12 | switchgrass\|gb167\|DN143437 | 4107 | 8557 | 588 | 93.4 | globlastp |
| LAB736_H13 | switchgrass\|12v1\|FE598001_P1 | 4108 | 8558 | 588 | 93.4 | globlastp |
| LAB736_H13 | switchgrass\|gb167\|FE598001 | 4109 | 8558 | 588 | 93.4 | globlastp |
| LAB736_H15 | barley\|10v2\|BE412864 | 4110 | 8559 | 588 | 93.1 | globlastp |
| LAB736_H16 | cenchrus\|gb166\|BM084845_P1 | 4111 | 8560 | 588 | 93.1 | globlastp |
| LAB736_H17 | cenchrus\|gb166\|EB653522_P1 | 4112 | 8561 | 588 | 93.1 | globlastp |
| LAB736_H18 | foxtail_millet\|11v3\|PHY7SI007119M_P1 | 4113 | 8562 | 588 | 93.1 | globlastp |
| LAB736_H19 | leymus\|gb166\|CN465854_P1 | 4114 | 8559 | 588 | 93.1 | globlastp |
| LAB736_H22 | sorghum\|12v1\|SB02G029380 | 4115 | 8563 | 588 | 93.1 | globlastp |
| LAB736_H23 | sorghum\|12v1\|SB02G029400 | 4116 | 8563 | 588 | 93.1 | globlastp |
| LAB736_H12 | switchgrass\|12v1\|DN143431_T1 | 4117 | 8564 | 588 | 93.05 | glotblastn |
| LAB736_H94 | wheat\|12v3\|BE398874_P1 | 4118 | 8565 | 588 | 92.7 | globlastp |
| LAB736_H15 | barley\|12v1\|BE412864_P1 | 4119 | 8565 | 588 | 92.7 | globlastp |
| LAB736_H20 | rye\|12v1\|DRR001012.109618 | 4120 | 8565 | 588 | 92.7 | globlastp |
| LAB736_H24 | maize\|10v1\|AI665475_P1 | 4121 | 8566 | 588 | 92.7 | globlastp |
| LAB736_H25 | maize\|10v1\|AI491408_P1 | 4122 | 8567 | 588 | 92.3 | globlastp |
| LAB736_H14 | rye\|12v1\|DRR001013.119239 | 4123 | 8568 | 588 | 92.28 | glotblastn |
| LAB736_H21 | rye\|12v1\|DRR001012.137575 | 4124 | 8569 | 588 | 91.9 | globlastp |
| LAB736_H27 | fescue\|gb161\|DT676666_P1 | 4125 | 8570 | 588 | 91.9 | globlastp |
| LAB736_H28 | leymus\|gb166\|CN466276_P1 | 4126 | 8571 | 588 | 91.9 | globlastp |
| LAB736_H31 | pseudoroegneria\|gb167\|FF340278 | 4127 | 8571 | 588 | 91.9 | globlastp |
| LAB736_H33 | wheat\|10v2\|BE398359 | 4128 | 8572 | 588 | 91.9 | globlastp |
| LAB736_H26 | barley\|10v2\|BE413337 | 4129 | 8573 | 588 | 91.5 | globlastp |
| LAB736_H26 | barley\|12v1\|BE413337_P1 | 4130 | 8573 | 588 | 91.5 | globlastp |
| LAB736_H29 | oat\|11v1\|GO583356_P1 | 4131 | 8574 | 588 | 91.5 | globlastp |
| LAB736_H32 | rye\|12v1\|BE588084 | 4132 | 8573 | 588 | 91.5 | globlastp |
| LAB736_H33 | wheat\|12v3\|BE398359_P1 | 4133 | 8573 | 588 | 91.5 | globlastp |
| LAB736_H34 | oat\|11v1\|GO587864_P1 | 4134 | 8575 | 588 | 91.5 | globlastp |
| LAB736_H95 | banana\|12v1\|ES432602_P1 | 4135 | 8576 | 588 | 91.1 | globlastp |
| LAB736_H96 | banana\|12v1\|FF560412_P1 | 4136 | 8577 | 588 | 91.1 | globlastp |
| LAB736_H97 | banana\|12v1\|MAGEN2012029387_P1 | 4137 | 8576 | 588 | 91.1 | globlastp |
| LAB736_H30 | oil_palm\|11v1\|EL595260XX2_P1 | 4138 | 8578 | 588 | 90.7 | globlastp |
| LAB736_H38 | brachypodium\|12v1\|BRADI4G34750_P1 | 4139 | 8579 | 588 | 90.7 | globlastp |
| LAB736_H39 | brachypodium\|12v1\|BRADI5G24680_P1 | 4140 | 8579 | 588 | 90.7 | globlastp |
| LAB736_H98 | banana\|12v1\|FF559351_P1 | 4141 | 8580 | 588 | 90.3 | globlastp |
| LAB736_H35 | rye\|12v1\|BE586513 | 4142 | 8581 | 588 | 90.3 | globlastp |
| LAB736_H41 | amorphophallus\|11v2\|SRR089351X108750_P1 | 4143 | 8582 | 588 | 90.3 | globlastp |
| LAB736_H36 | oil_palm\|11v1\|EL685376_P1 | 4144 | 8583 | 588 | 90 | globlastp |
| LAB736_H37 | rye\|12v1\|BE495288 | 4145 | 8584 | 588 | 90 | globlastp |
| LAB736_H44 | platanus\|11v1\|SRR096786X101987_P1 | 4146 | 8585 | 588 | 90 | globlastp |
| LAB736_H45 | amborella\|12v2\|CK763796 | 4147 | 8586 | 588 | 90 | globlastp |
| LAB736_H99 | banana\|12v1\|FL650674_P1 | 4148 | 8587 | 588 | 89.6 | globlastp |
| LAB736_H40 | oil_palm\|11v1\|EL693924_P1 | 4149 | 8588 | 588 | 89.6 | globlastp |
| LAB736_H49 | phalaenopsis\|11v1\|CB032502_P1 | 4150 | 8589 | 588 | 89.6 | globlastp |
| LAB736_H43 | banana\|10v1\|FF559351 | 4151 | 8590 | 588 | 89.58 | glotblastn |
| LAB736_H47 | liriodendron\|gb166\|CK747001_P1 | 4152 | 8591 | 588 | 89.2 | globlastp |
| LAB736_H42 | amorphophallus\|11v2\|SRR089351X100023_T1 | 4153 | 8592 | 588 | 89.19 | glotblastn |
| LAB736_H100 | banana\|12v1\|FF560304_P1 | 4154 | 8593 | 588 | 88.5 | globlastp |
| LAB736_H55 | chestnut\|gb170\|SRR006295S0000018_P1 | 4155 | 8594 | 588 | 88.5 | globlastp |
| LAB736_H57 | oak\|10v1\|DN950219_P1 | 4156 | 8594 | 588 | 88.5 | globlastp |
| LAB736_H58 | oak\|10v1\|FN710662_P1 | 4157 | 8594 | 588 | 88.5 | globlastp |
| LAB736_H52 | avocado\|10v1\|CV005126_P1 | 4158 | 8595 | 588 | 88.4 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB736_H61 | nuphar\|gb166\|CK743266_P1 | 4159 | 8596 | 588 | 88.4 | globlastp |
| LAB736_H46 | clementine\|11v1\|CF834680_P1 | 4160 | 8597 | 588 | 88.1 | globlastp |
| LAB736_H48 | orange\|11v1\|CF834680_P1 | 4161 | 8597 | 588 | 88.1 | globlastp |
| LAB736_H101 | prunus_mume\|13v1\|SRR345674.29976_P1 | 4162 | 8598 | 588 | 88 | globlastp |
| LAB736_H102 | zostera\|12v1\|AM771243_P1 | 4163 | 8599 | 588 | 88 | globlastp |
| LAB736_H51 | rye\|12v1\|DRR001012.132032 | 4164 | 8600 | 588 | 88 | globlastp |
| LAB736_H63 | phalaenopsis\|11v1\|SRR125771.1002084_P1 | 4165 | 8601 | 588 | 88 | globlastp |
| LAB736_H69 | eschscholzia\|11v1\|CK746882_P1 | 4166 | 8602 | 588 | 88 | globlastp |
| LAB736_H70 | eschscholzia\|11v1\|SRR014116.107174_P1 | 4167 | 8603 | 588 | 88 | globlastp |
| LAB736_H74 | zostera\|10v1\|AM771243 | 4168 | 8599 | 588 | 88 | globlastp |
| LAB736_H103 | amborella\|12v3\|CK763796_P1 | 4169 | 8604 | 588 | 87.9 | globlastp |
| LAB736_H54 | rye\|12v1\|BE496010 | 4170 | 8605 | 588 | 87.9 | globlastp |
| LAB736_H56 | chestnut\|gb170\|SRR006295S0000020_P1 | 4171 | 8606 | 588 | 87.7 | globlastp |
| LAB736_H93 | thalictrum\|11v1\|SRR096787X118621 | 4172 | 8607 | 588 | 87.64 | glotblastn |
| LAB736_H53 | peanut\|10v1\|ES703917_P1 | 4173 | 8608 | 588 | 87.6 | globlastp |
| LAB736_H59 | cotton\|11v1\|CO092918_P1 | 4174 | 8609 | 588 | 87.6 | globlastp |
| LAB736_H60 | gossypium_raimondii\|12v1\|DR453902_P1 | 4175 | 8609 | 588 | 87.6 | globlastp |
| LAB736_H66 | chelidonium\|11v1\|SRR084752X105613_P1 | 4176 | 8610 | 588 | 87.6 | globlastp |
| LAB736_H87 | platanus\|11v1\|SRR096786X100009_P1 | 4177 | 8611 | 588 | 87.6 | globlastp |
| LAB736_H88 | poppy\|11v1\|SRR030259.118612_P1 | 4178 | 8612 | 588 | 87.6 | globlastp |
| LAB736_H104 | aristolochia\|10v1\|SRR039082S0167593_P1 | 4179 | 8613 | 588 | 87.3 | globlastp |
| LAB736_H105 | eschscholzia\|11v1\|SRR014116.101239_P1 | 4180 | 8614 | 588 | 87.3 | globlastp |
| LAB736_H62 | peanut\|10v1\|EE124632_P1 | 4181 | 8615 | 588 | 87.3 | globlastp |
| LAB736_H65 | prunus\|10v1\|PPA018912M | 4182 | 8616 | 588 | 87.3 | globlastp |
| LAB736_H67 | cotton\|11v1\|AI054819_P1 | 4183 | 8617 | 588 | 87.3 | globlastp |
| LAB736_H68 | cotton\|11v1\|BQ402123XX1_P1 | 4184 | 8618 | 588 | 87.3 | globlastp |
| LAB736_H71 | gossypium_raimondii\|12v1\|BQ407784_P1 | 4185 | 8619 | 588 | 87.3 | globlastp |
| LAB736_H77 | aristolochia\|10v1\|FD760421_P1 | 4186 | 8620 | 588 | 87.3 | globlastp |
| LAB736_H86 | nasturtium\|11v1\|SRR032558.104348_P1 | 4187 | 8621 | 588 | 87.3 | globlastp |
| LAB736_H91 | spruce\|11v1\|ES878796 | 4188 | 8622 | 588 | 87.3 | globlastp |
| LAB736_H106 | amborella\|12v3\|FD431280_T1 | 4189 | 8623 | 588 | 87.26 | glotblastn |
| LAB736_H107 | cacao\|10v1\|CA796703_P1 | 4190 | 8624 | 588 | 86.9 | globlastp |
| LAB736_H108 | chelidonium\|11v1\|SRR084752X112713_P1 | 4191 | 8625 | 588 | 86.9 | globlastp |
| LAB736_H109 | chickpea\|13v2\|GR396963_P1 | 4192 | 8626 | 588 | 86.9 | globlastp |
| LAB736_H110 | eschscholzia\|11v1\|SRR014116.101817_P1 | 4193 | 8627 | 588 | 86.9 | globlastp |
| LAB736_H111 | grape\|11v1\|GSVIVT01033050001_P1 | 4194 | 8628 | 588 | 86.9 | globlastp |
| LAB736_H112 | hornbeam\|12v1\|SRR364455.106623_P1 | 4195 | 8629 | 588 | 86.9 | globlastp |
| LAB736_H113 | nasturtium\|11v1\|SRR032558.105454_P1 | 4196 | 8630 | 588 | 86.9 | globlastp |
| LAB736_H114 | poppy\|11v1\|SRR030259.145318_P1 | 4197 | 8631 | 588 | 86.9 | globlastp |
| LAB736_H115 | zostera\|12v1\|SRR057351X107705D1_P1 | 4198 | 8632 | 588 | 86.9 | globlastp |
| LAB736_H72 | pigeonpea\|11v1\|EE604706_P1 | 4199 | 8633 | 588 | 86.9 | globlastp |
| LAB736_H73 | soybean\|11v1\|GLYMA11G11040 | 4200 | 8634 | 588 | 86.9 | globlastp |
| LAB736_H73 | soybean\|12v1\|GLYMA11G11040_P1 | 4201 | 8634 | 588 | 86.9 | globlastp |
| LAB736_H78 | cacao\|10v1\|CU471632_P1 | 4202 | 8635 | 588 | 86.9 | globlastp |
| LAB736_H81 | cotton\|11v1\|BE055064XX1_P1 | 4203 | 8636 | 588 | 86.9 | globlastp |
| LAB736_H83 | gossypium_raimondii\|12v1\|AI054819_P1 | 4204 | 8636 | 588 | 86.9 | globlastp |
| LAB736_H84 | gossypium_raimondii\|12v1\|BE051919_P1 | 4205 | 8637 | 588 | 86.9 | globlastp |
| LAB736_H89 | rose\|12v1\|BI978658 | 4206 | 8638 | 588 | 86.9 | globlastp |
| LAB736_H92 | strawberry\|11v1\|DV440629 | 4207 | 8639 | 588 | 86.9 | globlastp |
| LAB736_H75 | apple\|11v1\|CO052839_T1 | 4208 | 8640 | 588 | 86.87 | glotblastn |
| LAB736_H116 | abies\|11v2\|SRR098676X106954_P1 | 4209 | 8641 | 588 | 86.5 | globlastp |
| LAB736_H117 | blueberry\|12v1\|CF810829_P1 | 4210 | 8642 | 588 | 86.5 | globlastp |
| LAB736_H118 | cedrus\|11v1\|SRR065007X112685_P1 | 4211 | 8643 | 588 | 86.5 | globlastp |
| LAB736_H119 | eschscholzia\|11v1\|SRR014116.12977_P1 | 4212 | 8644 | 588 | 86.5 | globlastp |
| LAB736_H120 | eucalyptus\|11v2\|DR410025_P1 | 4213 | 8645 | 588 | 86.5 | globlastp |
| LAB736_H121 | euonymus\|11v1\|SRR070038X10220_P1 | 4214 | 8646 | 588 | 86.5 | globlastp |
| LAB736_H122 | grape\|11v1\|GSVIVT01008585001_P1 | 4215 | 8647 | 588 | 86.5 | globlastp |
| LAB736_H123 | hornbeam\|12v1\|SRR364455.109238_P1 | 4216 | 8648 | 588 | 86.5 | globlastp |
| LAB736_H124 | ipomoea_nil\|10v1\|BJ553366_P1 | 4217 | 8649 | 588 | 86.5 | globlastp |
| LAB736_H125 | kiwi\|gb166\|FG400583_P1 | 4218 | 8650 | 588 | 86.5 | globlastp |
| LAB736_H126 | nasturtium\|11v1\|SRR032558.113300_P1 | 4219 | 8651 | 588 | 86.5 | globlastp |
| LAB736_H127 | pigeonpea\|11v1\|SRR054580X122588_P1 | 4220 | 8652 | 588 | 86.5 | globlastp |
| LAB736_H128 | poppy\|11v1\|FE966899_P1 | 4221 | 8653 | 588 | 86.5 | globlastp |
| LAB736_H129 | poppy\|11v1\|SRR030259.66296_P1 | 4222 | 8654 | 588 | 86.5 | globlastp |
| LAB736_H130 | poppy\|11v1\|SRR030263.268044_P1 | 4223 | 8655 | 588 | 86.5 | globlastp |
| LAB736_H131 | rose\|12v1\|EC589036_P1 | 4224 | 8656 | 588 | 86.5 | globlastp |
| LAB736_H79 | cassava\|09v1\|CK644576_P1 | 4225 | 8657 | 588 | 86.5 | globlastp |
| LAB736_H80 | cotton\|11v1\|BE051919_P1 | 4226 | 8658 | 588 | 86.5 | globlastp |
| LAB736_H82 | cotton\|11v1\|CO074939_P1 | 4227 | 8659 | 588 | 86.5 | globlastp |
| LAB736_H90 | soybean\|11v1\|GLYMA12G03230 | 4228 | 8660 | 588 | 86.5 | globlastp |
| LAB736_H90 | soybean\|12v1\|GLYMA12G03230_P1 | 4229 | 8660 | 588 | 86.5 | globlastp |
| LAB736_H132 | blueberry\|12v1\|CV191532_T1 | 4230 | 8661 | 588 | 86.49 | glotblastn |
| LAB736_H133 | pigeonpea\|11v1\|SRR054580X120749_T1 | 4231 | 8662 | 588 | 86.49 | glotblastn |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB736_H134 | spruce\|11v1\|SRR065813X172800XX2_T1 | 4232 | 8663 | 588 | 86.49 | glotblastn |
| LAB736_H135 | clover\|gb162\|BB902472_P1 | 4233 | 8664 | 588 | 86.2 | globlastp |
| LAB736_H136 | soybean\|12v1\|GLYMA02G00540T2_P1 | 4234 | 8665 | 588 | 86.2 | globlastp |
| LAB736_H137 | clementine\|11v1\|EY756332_P1 | 4235 | 8666 | 588 | 86.1 | globlastp |
| LAB736_H138 | distylium\|11v1\|SRR065077X101515_P1 | 4236 | 8667 | 588 | 86.1 | globlastp |
| LAB736_H139 | euonymus\|11v1\|SRR070038X105593_P1 | 4237 | 8668 | 588 | 86.1 | globlastp |
| LAB736_H140 | ginger\|gb164\|DY366887_P1 | 4238 | 8669 | 588 | 86.1 | globlastp |
| LAB736_H141 | ipomoea_nil\|10v1\|BJ554172_P1 | 4239 | 8670 | 588 | 86.1 | globlastp |
| LAB736_H142 | kiwi\|gb166\|FG403536_P1 | 4240 | 8671 | 588 | 86.1 | globlastp |
| LAB736_H143 | maritime_pine\|10v1\|BX249937_P1 | 4241 | 8672 | 588 | 86.1 | globlastp |
| LAB736_H144 | nasturtium\|11v1\|GH167097_T1 | 4242 | 8673 | 588 | 86.1 | glotblastn |
| LAB736_H145 | orange\|11v1\|SRR099042X120439_P1 | 4243 | 8666 | 588 | 86.1 | globlastp |
| LAB736_H146 | pine\|10v2\|AA556512_P1 | 4244 | 8674 | 588 | 86.1 | globlastp |
| LAB736_H147 | pine\|10v2\|AA739809_P1 | 4245 | 8675 | 588 | 86.1 | globlastp |
| LAB736_H148 | poppy\|11v1\|SRR030263.301941_P1 | 4246 | 8676 | 588 | 86.1 | globlastp |
| LAB736_H149 | primula\|11v1\|SRR098679X115137_P1 | 4247 | 8677 | 588 | 86.1 | globlastp |
| LAB736_H150 | prunus_mume\|13v1\|BU039504_P1 | 4248 | 8678 | 588 | 86.1 | globlastp |
| LAB736_H151 | prunus\|10v1\|BU039504_P1 | 4249 | 8678 | 588 | 86.1 | globlastp |
| LAB736_H152 | sciadopitys\|10v1\|SRR065035S0002289_P1 | 4250 | 8679 | 588 | 86.1 | globlastp |
| LAB736_H153 | sequoia\|10v1\|SRR065044S0004259_P1 | 4251 | 8680 | 588 | 86.1 | globlastp |
| LAB736_H154 | sequoia\|10v1\|SRR065044S0013081_P1 | 4252 | 8681 | 588 | 86.1 | globlastp |
| LAB736_H155 | spruce\|11v1\|CO226532XX2_T1 | 4253 | 8682 | 588 | 86.1 | glotblastn |
| LAB736_H156 | spruce\|11v1\|ES245525_P1 | 4254 | 8683 | 588 | 86.1 | globlastp |
| LAB736_H157 | spruce\|11v1\|ES246400_P1 | 4255 | 8683 | 588 | 86.1 | globlastp |
| LAB736_H158 | spruce\|11v1\|EX346680_P1 | 4256 | 8683 | 588 | 86.1 | globlastp |
| LAB736_H199 | spruce\|11v1\|EX357435_P1 | 4257 | 8683 | 588 | 86.1 | globlastp |
| LAB736_H160 | spruce\|11v1\|GW735401_T1 | 4258 | 8684 | 588 | 86.1 | glotblastn |
| LAB736_H161 | walnuts\|gb166\|EL890883_P1 | 4259 | 8685 | 588 | 86.1 | globlastp |
| LAB736_H64 | avocado\|10v1\|CK748322_P1 | 4260 | 8686 | 588 | 86.1 | globlastp |
| LAB736_H85 | hevea\|10v1\|EC601153_P1 | 4261 | 8687 | 588 | 86.1 | globlastp |
| LAB736_H162 | beech\|11v1\|SRR006294.12792_P1 | 4262 | 8688 | 588 | 85.8 | globlastp |
| LAB736_H163 | soybean\|12v1\|GLYMA10G00890_P1 | 4263 | 8689 | 588 | 85.8 | globlastp |
| LAB736_H164 | trigonella\|11v1\|SRR066194X107494_P1 | 4264 | 8690 | 588 | 85.8 | globlastp |
| LAB736_H165 | chelidonium\|11v1\|SRR084752X103293_T1 | 4265 | 8691 | 588 | 85.71 | glotblastn |
| LAB736_H166 | flaveria\|11v1\|SRR149229.103791_T1 | 4266 | 8692 | 588 | 85.71 | glotblastn |
| LAB736_H167 | poppy\|11v1\|SRR030259.102452_T1 | 4267 | 8693 | 588 | 85.71 | glotblastn |
| LAB736_H168 | spruce\|11v1\|EX347396XX1_T1 | 4268 | 8694 | 588 | 85.71 | glotblastn |
| LAB736_H169 | bean\|12v2\|CA898006_P1 | 4269 | 8695 | 588 | 85.7 | globlastp |
| LAB736_H170 | beech\|11v1\|SRR006293.1351_P1 | 4270 | 8696 | 588 | 85.7 | globlastp |
| LAB736_H171 | cassava\|09v1\|CK649579_P1 | 4271 | 8697 | 588 | 85.7 | globlastp |
| LAB736_H172 | cassava\|09v1\|CK652178_P1 | 4272 | 8698 | 588 | 85.7 | globlastp |
| LAB736_H173 | cassava\|09v1\|DB921837_P1 | 4273 | 8699 | 588 | 85.7 | globlastp |
| LAB736_H174 | catharanthus\|11v1\|EG556652_P1 | 4274 | 8700 | 588 | 85.7 | globlastp |
| LAB736_H175 | cucumber\|09v1\|GD179495_P1 | 4275 | 8701 | 588 | 85.7 | globlastp |
| LAB736_H176 | flaveria\|11v1\|SRR149229.120920_P1 | 4276 | 8702 | 588 | 85.7 | globlastp |
| LAB736_H177 | flaveria\|11v1\|SRR149229.151152_P1 | 4277 | 8703 | 588 | 85.7 | globlastp |
| LAB736_H178 | flaveria\|11v1\|SRR149232.107239_P1 | 4278 | 8703 | 588 | 85.7 | globlastp |
| LAB736_H179 | flaveria\|11v1\|SRR149232.110412XX2_P1 | 4279 | 8704 | 588 | 85.7 | globlastp |
| LAB736_H180 | flaveria\|11v1\|SRR149238.161140_P1 | 4280 | 8703 | 588 | 85.7 | globlastp |
| LAB736_H181 | ipomoea_batatas\|10v1\|BM878730_P1 | 4281 | 8705 | 588 | 85.7 | globlastp |
| LAB736_H182 | kiwi\|gb166\|FG396383_P1 | 4282 | 8706 | 588 | 85.7 | globlastp |
| LAB736_H183 | lettuce\|12v1\|DW047012_P1 | 4283 | 8707 | 588 | 85.7 | globlastp |
| LAB736_H184 | poppy\|11v1\|SRR030259.158249_P1 | 4284 | 8708 | 588 | 85.7 | globlastp |
| LAB736_H185 | primula\|11v1\|SRR098679X115190_P1 | 4285 | 8709 | 588 | 85.7 | globlastp |
| LAB736_H186 | pseudotsuga\|10v1\|SRR065119S0016570_P1 | 4286 | 8710 | 588 | 85.7 | globlastp |
| LAB736_H187 | valeriana\|11v1\|SRR099039X105607_P1 | 4287 | 8711 | 588 | 85.7 | globlastp |
| LAB736_H188 | coffea\|10v1\|DV663644_P1 | 4288 | 8712 | 588 | 85.4 | globlastp |
| LAB736_H189 | poppy\|11v1\|SRR030259.104491_T1 | 4289 | 8713 | 588 | 85.33 | glotblastn |
| LAB736_H190 | amsonia\|11v1\|SRR098688X101879XX1_P1 | 4290 | 8714 | 588 | 85.3 | globlastp |
| LAB736_H191 | aquilegia\|10v2\|DT730656_P1 | 4291 | 8715 | 588 | 85.3 | globlastp |
| LAB736_H192 | basilicum\|10v1\|DY328816_P1 | 4292 | 8716 | 588 | 85.3 | globlastp |
| LAB736_H193 | bean\|12v2\|CA898001_P1 | 4293 | 8717 | 588 | 85.3 | globlastp |
| LAB736_H194 | cucurbita\|11v1\|SRR091276X116595_P1 | 4294 | 8718 | 588 | 85.3 | globlastp |
| LAB736_H195 | eucalyptus\|11v2\|CT982618_P1 | 4295 | 8719 | 588 | 85.3 | globlastp |
| LAB736_H196 | flaveria\|11v1\|SRR149229.106615XX1_P1 | 4296 | 8720 | 588 | 85.3 | globlastp |
| LAB736_H197 | flaveria\|11v1\|SRR149229.213778_P1 | 4297 | 8721 | 588 | 85.3 | globlastp |
| LAB736_H198 | flaveria\|11v1\|SRR149232.124299_P1 | 4298 | 8722 | 588 | 85.3 | globlastp |
| LAB736_H199 | flaveria\|11v1\|SRR149244.108574_P1 | 4299 | 8723 | 588 | 85.3 | globlastp |
| LAB736_H200 | lettuce\|12v1\|DW046271_P1 | 4300 | 8724 | 588 | 85.3 | globlastp |
| LAB736_H201 | podocarpus\|10v1\|SRR065014S0033625_P1 | 4301 | 8725 | 588 | 85.3 | globlastp |
| LAB736_H202 | poplar\|13v1\|AI161831_P1 | 4302 | 8726 | 588 | 85.3 | globlastp |
| LAB736_H203 | poplar\|13v1\|BU830427_P1 | 4303 | 8727 | 588 | 85.3 | globlastp |
| LAB736_H204 | sunflower\|12v1\|CD854677_P1 | 4304 | 8728 | 588 | 85.3 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB736_H205 | sunflower\|12v1\|CF076744_P1 | 4305 | 8728 | 588 | 85.3 | globlastp |
| LAB736_H206 | sunflower\|12v1\|DY915995_P1 | 4306 | 8729 | 588 | 85.3 | globlastp |
| LAB736_H207 | sunflower\|12v1\|DY916466_P1 | 4307 | 8728 | 588 | 85.3 | globlastp |
| LAB736_H208 | sunflower\|12v1\|DY933489_P1 | 4308 | 8728 | 588 | 85.3 | globlastp |
| LAB736_H209 | sunflower\|12v1\|EE632782_P1 | 4309 | 8728 | 588 | 85.3 | globlastp |
| LAB736_H210 | tabernaemontana\|11v1\|SRR098689X100198_P1 | 4310 | 8730 | 588 | 85.3 | globlastp |
| LAB736_H211 | tragopogon\|10v1\|SRR020205S0000111_P1 | 4311 | 8731 | 588 | 85.3 | globlastp |
| LAB736_H212 | tragopogon\|10v1\|SRR020205S0001935_P1 | 4312 | 8732 | 588 | 85.3 | globlastp |
| LAB736_H213 | tripterygium\|11v1\|SRR098677X10006_P1 | 4313 | 8733 | 588 | 85.3 | globlastp |
| LAB736_H214 | tripterygium\|11v1\|SRR098677X106720_P1 | 4314 | 8733 | 588 | 85.3 | globlastp |
| LAB736_H215 | castorbean\|12v1\|CF981381_T1 | 4315 | 8734 | 588 | 84.94 | glotblastn |
| LAB736_H216 | catharanthus\|11v1\|AM232370_T1 | 4316 | 8735 | 588 | 84.94 | glotblastn |
| LAB736_H217 | phyla\|11v2\|SRR099037X150513_T1 | 4317 | 8736 | 588 | 84.94 | glotblastn |
| LAB736_H218 | sarracenia\|11v1\|SRR192669.107869_T1 | 4318 | 8737 | 588 | 84.94 | glotblastn |
| LAB736_H219 | sorghum\|12v1\|SB07G026082_T1 | 4319 | 8738 | 588 | 84.94 | glotblastn |
| LAB736_H220 | tragopogon\|10v1\|SRR020205S0037787_T1 | 4320 | 8739 | 588 | 84.94 | glotblastn |
| LAB736_H221 | ambrosia\|11v1\|SRR346943.40528_P1 | 4321 | 8740 | 588 | 84.9 | globlastp |
| LAB736_H222 | amsonia\|11v1\|SRR098688X102951_P1 | 4322 | 8741 | 588 | 84.9 | globlastp |
| LAB736_H223 | arnica\|11v1\|SRR099034X100590_P1 | 4323 | 8742 | 588 | 84.9 | globlastp |
| LAB736_H224 | blueberry\|12v1\|SRR353282X23303D1_P1 | 4324 | 8743 | 588 | 84.9 | globlastp |
| LAB736_H225 | castorbean\|12v1\|EG660381_P1 | 4325 | 8744 | 588 | 84.9 | globlastp |
| LAB736_H226 | cephalotaxus\|11v1\|SRR064395X105184_P1 | 4326 | 8745 | 588 | 84.9 | globlastp |
| LAB736_H227 | cichorium\|gb171\|EH672726_P1 | 4327 | 8746 | 588 | 84.9 | globlastp |
| LAB736_H228 | cotton\|11v1\|DR459437_P1 | 4328 | 8747 | 588 | 84.9 | globlastp |
| LAB736_H229 | cowpea\|12v1\|FG813262_P1 | 4329 | 8748 | 588 | 84.9 | globlastp |
| LAB736_H230 | cucurbita\|11v1\|SRR091276X103724_P1 | 4330 | 8749 | 588 | 84.9 | globlastp |
| LAB736_H231 | cucurbita\|11v1\|SRR091276X105006_P1 | 4331 | 8750 | 588 | 84.9 | globlastp |
| LAB736_H232 | cynara\|gb167\|GE585720_P1 | 4332 | 8751 | 588 | 84.9 | globlastp |
| LAB736_H233 | euonymus\|11v1\|SRR070038X103272_P1 | 4333 | 8752 | 588 | 84.9 | globlastp |
| LAB736_H234 | flax\|11v1\|JG029731_P1 | 4334 | 8753 | 588 | 84.9 | globlastp |
| LAB736_H235 | gossypium_raimondii\|12v1\|DR459437_P1 | 4335 | 8747 | 588 | 84.9 | globlastp |
| LAB736_H236 | kiwi\|gb166\|FG408675_P1 | 4336 | 8754 | 588 | 84.9 | globlastp |
| LAB736_H237 | poplar\|13v1\|AI162308_P1 | 4337 | 8755 | 588 | 84.9 | globlastp |
| LAB736_H238 | poplar\|13v1\|BI132334_P1 | 4338 | 8756 | 588 | 84.9 | globlastp |
| LAB736_H239 | sesame\|12v1\|JK047611_P1 | 4339 | 8757 | 588 | 84.9 | globlastp |
| LAB736_H240 | sunflower\|12v1\|DY943109_P1 | 4340 | 8758 | 588 | 84.9 | globlastp |
| LAB736_H241 | sunflower\|12v1\|EL422321_P1 | 4341 | 8759 | 588 | 84.9 | globlastp |
| LAB736_H242 | tabernaemontana\|11v1\|SRR098689X10126_P1 | 4342 | 8760 | 588 | 84.9 | globlastp |
| LAB736_H243 | tripterygium\|11v1\|SRR098677X113122_P1 | 4343 | 8761 | 588 | 84.9 | globlastp |
| LAB736_H244 | valeriana\|11v1\|SRR099039X108870_P1 | 4344 | 8762 | 588 | 84.9 | globlastp |
| LAB736_H245 | valeriana\|11v1\|SRR099039X134053_P1 | 4345 | 8763 | 588 | 84.9 | globlastp |
| LAB736_H246 | nicotiana_benthamiana\|12v1\|EB427301_T1 | 4346 | 8764 | 588 | 84.62 | glotblastn |
| LAB736_H247 | ambrosia\|11v1\|SRR346935.121008_P1 | 4347 | 8765 | 588 | 84.6 | globlastp |
| LAB736_H248 | ambrosia\|11v1\|SRR346935.128177_P1 | 4348 | 8766 | 588 | 84.6 | globlastp |
| LAB736_H249 | castorbean\|12v1\|EE254608_P1 | 4349 | 8767 | 588 | 84.6 | globlastp |
| LAB736_H250 | cichorium\|gb171\|EH685572_P1 | 4350 | 8768 | 588 | 84.6 | globlastp |
| LAB736_H251 | cirsium\|11v1\|SRR346952.107645_P1 | 4351 | 8769 | 588 | 84.6 | globlastp |
| LAB736_H252 | cirsium\|11v1\|SRR346952.113099_P1 | 4352 | 8770 | 588 | 84.6 | globlastp |
| LAB736_H253 | cryptomeria\|gb166\|BW994294_P1 | 4353 | 8771 | 588 | 84.6 | globlastp |
| LAB736_H254 | cucumber\|09v1\|AM721621_P1 | 4354 | 8772 | 588 | 84.6 | globlastp |
| LAB736_H255 | cucurbita\|11v1\|SRR091276X134320_P1 | 4355 | 8773 | 588 | 84.6 | globlastp |
| LAB736_H256 | flax\|11v1\|GW864708_P1 | 4356 | 8774 | 588 | 84.6 | globlastp |
| LAB736_H257 | grape\|11v1\|GSVIVT01036540001_P1 | 4357 | 8775 | 588 | 84.6 | globlastp |
| LAB736_H258 | lotus\|09v1\|AI967802_P1 | 4358 | 8776 | 588 | 84.6 | globlastp |
| LAB736_H259 | melon\|10v1\|AM721621_P1 | 4359 | 8777 | 588 | 84.6 | globlastp |
| LAB736_H260 | momordica\|10v1\|SRR071315S0003271_P1 | 4360 | 8778 | 588 | 84.6 | globlastp |
| LAB736_H261 | phyla\|11v2\|SRR099035X121827_P1 | 4361 | 8779 | 588 | 84.6 | globlastp |
| LAB736_H262 | phyla\|11v2\|SRR099035X22765_P1 | 4362 | 8780 | 588 | 84.6 | globlastp |
| LAB736_H263 | podocarpus\|10v1\|SRR065014S0011977_P1 | 4363 | 8781 | 588 | 84.6 | globlastp |
| LAB736_H264 | poplar\|13v1\|AI161478_P1 | 4364 | 8782 | 588 | 84.6 | globlastp |
| LAB736_H265 | pseudotsuga\|10v1\|SRR065119S0007565_P1 | 4365 | 8783 | 588 | 84.6 | globlastp |
| LAB736_H266 | rye\|12v1\|DRR001012.194009_P1 | 4366 | 8784 | 588 | 84.6 | globlastp |
| LAB736_H267 | thalictrum\|11v1\|SRR096787X113214_P1 | 4367 | 8785 | 588 | 84.6 | globlastp |
| LAB736_H268 | tobacco\|gb162\|CV017258_P1 | 4368 | 8786 | 588 | 84.6 | globlastp |
| LAB736_H269 | valeriana\|11v1\|SRR099039X110882_P1 | 4369 | 8787 | 588 | 84.6 | globlastp |
| LAB736_H270 | vinca\|11v1\|SRR098690X114977_P1 | 4370 | 8788 | 588 | 84.6 | globlastp |
| LAB736_H271 | watermelon\|11v1\|AM721621_P1 | 4371 | 8789 | 588 | 84.6 | globlastp |
| LAB736_H272 | arnica\|11v1\|SRR099034X115562_T1 | 4372 | 8790 | 588 | 84.56 | glotblastn |
| LAB736_H273 | cirsium\|11v1\|SRR346952.1002504_T1 | 4373 | 8791 | 588 | 84.56 | glotblastn |
| LAB736_H274 | flaveria\|11v1\|SRR149232.10037_T1 | 4374 | 8792 | 588 | 84.56 | glotblastn |
| LAB736_H275 | phyla\|11v2\|SRR099037X120018_T1 | 4375 | 8793 | 588 | 84.56 | glotblastn |
| LAB736_H276 | thalictrum\|11v1\|SRR096787X102413_T1 | 4376 | 8794 | 588 | 84.56 | glotblastn |
| LAB736_H277 | ambrosia\|11v1\|SRR346935.200534_P1 | 4377 | 8795 | 588 | 84.2 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB736_H278 | aquilegia|10v2|JGIAC009830_P1 | 4378 | 8796 | 588 | 84.2 | globlastp |
| LAB736_H279 | arnica|11v1|SRR099034X116220XX1_P1 | 4379 | 8797 | 588 | 84.2 | globlastp |
| LAB736_H280 | catharanthus|11v1|EG560971_P1 | 4380 | 8798 | 588 | 84.2 | globlastp |
| LAB736_H281 | centaurea|gb166|EH714103_P1 | 4381 | 8799 | 588 | 84.2 | globlastp |
| LAB736_H282 | centaurea|gb166|EH717477_P1 | 4382 | 8800 | 588 | 84.2 | globlastp |
| LAB736_H283 | centaurea|gb166|EH719179_P1 | 4383 | 8799 | 588 | 84.2 | globlastp |
| LAB736_H284 | centaurea|gb166|EH777742_P1 | 4384 | 8800 | 588 | 84.2 | globlastp |
| LAB736_H285 | chickpea|13v2|FE669101_P1 | 4385 | 8801 | 588 | 84.2 | globlastp |
| LAB736_H286 | cirsium|11v1|SRR346952.1056417_P1 | 4386 | 8799 | 588 | 84.2 | globlastp |
| LAB736_H287 | cirsium|11v1|SRR346952.1136935_P1 | 4387 | 8800 | 588 | 84.2 | globlastp |
| LAB736_H288 | dandelion|10v1|DY820686_P1 | 4388 | 8802 | 588 | 84.2 | globlastp |
| LAB736_H289 | dandelion|10v1|DY823032_P1 | 4389 | 8803 | 588 | 84.2 | globlastp |
| LAB736_H290 | medicago|12v1|AA660765_P1 | 4390 | 8804 | 588 | 84.2 | globlastp |
| LAB736_H291 | monkeyflower|12v1|DV206229_P1 | 4391 | 8805 | 588 | 84.2 | globlastp |
| LAB736_H292 | nicotiana_benthamiana|12v1|AJ718619_P1 | 4392 | 8806 | 588 | 84.2 | globlastp |
| LAB736_H293 | nicotiana_benthamiana|12v1|AY310805_P1 | 4393 | 8807 | 588 | 84.2 | globlastp |
| LAB736_H294 | nicotiana_benthamiana|12v1|BP751876_P1 | 4394 | 8808 | 588 | 84.2 | globlastp |
| LAB736_H295 | safflower|gb162|EL378862_P1 | 4395 | 8800 | 588 | 84.2 | globlastp |
| LAB736_H296 | safflower|gb162|EL386347_P1 | 4396 | 8799 | 588 | 84.2 | globlastp |
| LAB736_H297 | salvia|10v1|CV166698_P1 | 4397 | 8809 | 588 | 84.2 | globlastp |
| LAB736_H298 | spurge|gb161|BI993548_P1 | 4398 | 8810 | 588 | 84.2 | globlastp |
| LAB736_H299 | sunflower|12v1|CD851537_P1 | 4399 | 8811 | 588 | 84.2 | globlastp |
| LAB736_H300 | sunflower|12v1|CD851768_P1 | 4400 | 8812 | 588 | 84.2 | globlastp |
| LAB736_H301 | sunflower|12v1|CD851975_P1 | 4401 | 8813 | 588 | 84.2 | globlastp |
| LAB736_H302 | sunflower|12v1|CX946573_P1 | 4402 | 8814 | 588 | 84.2 | globlastp |
| LAB736_H303 | sunflower|12v1|DY916584_P1 | 4403 | 8811 | 588 | 84.2 | globlastp |
| LAB736_H304 | tobacco|gb162|EB446005_P1 | 4404 | 8807 | 588 | 84.2 | globlastp |
| LAB736_H305 | vinca|11v1|SRR098690X104183_P1 | 4405 | 8815 | 588 | 84.2 | globlastp |
| LAB736_H306 | vinca|11v1|SRR098690X118043_P1 | 4406 | 8816 | 588 | 84.2 | globlastp |
| LAB736_H307 | ambrosia|11v1|SRR346943.103510_T1 | 4407 | 8817 | 588 | 84.17 | glotblastn |
| LAB736_H308 | ginger|gb164|DY365135_T1 | 4408 | 8818 | 588 | 84.17 | glotblastn |
| LAB736_H309 | guizotia|10v1|GE568006_T1 | 4409 | 8819 | 588 | 84.17 | glotblastn |
| LAB736_H310 | epimedium|11v1|SRR013502.12372_P1 | 4410 | 8820 | 588 | 84 | globlastp |
| LAB736_H311 | apple|11v1|CN444563_P1 | 4411 | 8821 | 588 | 83.8 | globlastp |
| LAB736_H312 | artemisia|10v1|EY040905_P1 | 4412 | 8822 | 588 | 83.8 | globlastp |
| LAB736_H313 | bupleurum|11v1|SRR301254.109062_P1 | 4413 | 8823 | 588 | 83.8 | globlastp |
| LAB736_H314 | cephalotaxus|11v1|SRR064395X100755_P1 | 4414 | 8824 | 588 | 83.8 | globlastp |
| LAB736_H315 | cleome_spinosa|10v1|SRR015531S0004626_P1 | 4415 | 8825 | 588 | 83.8 | globlastp |
| LAB736_H316 | cucumber|09v1|CK085809_P1 | 4416 | 8826 | 588 | 83.8 | globlastp |
| LAB736_H317 | euphorbia|11v1|SRR098678X114301_P1 | 4417 | 8827 | 588 | 83.8 | globlastp |
| LAB736_H318 | fagopyrum|11v1|SRR063689X10433_P1 | 4418 | 8828 | 588 | 83.8 | globlastp |
| LAB736_H319 | flax|11v1|JG030614_P1 | 4419 | 8829 | 588 | 83.8 | globlastp |
| LAB736_H320 | fraxinus|11v1|SRR058827.118860_P1 | 4420 | 8830 | 588 | 83.8 | globlastp |
| LAB736_H321 | nicotiana_benthamiana|12v1|BP744671_P1 | 4421 | 8831 | 588 | 83.8 | globlastp |
| LAB736_H322 | sunflower|12v1|DY946843_P1 | 4422 | 8832 | 588 | 83.8 | globlastp |
| LAB736_H323 | taxus|10v1|SRR032523S0000376_P1 | 4423 | 8833 | 588 | 83.8 | globlastp |
| LAB736_H324 | taxus|10v1|SRR032523S0007416_P1 | 4424 | 8834 | 588 | 83.8 | globlastp |
| LAB736_H325 | watermelon|11v1|AM714282_P1 | 4425 | 8835 | 588 | 83.8 | globlastp |
| LAB736_H326 | ambrosia|11v1|SRR346935.139842_T1 | 4426 | 8836 | 588 | 83.78 | glotblastn |
| LAB736_H327 | ambrosia|11v1|SRR346943.100107_T1 | 4427 | 8836 | 588 | 83.78 | glotblastn |
| LAB736_H328 | bruguiera|gb166|BP939977_T1 | 4428 | 8837 | 588 | 83.77 | glotblastn |
| LAB736_H329 | eggplant|10v1|FS002632_P1 | 4429 | 8838 | 588 | 83.5 | globlastp |
| LAB736_H330 | fagopyrum|11v1|SRR063689X29084_T1 | 4430 | 8839 | 588 | 83.46 | glotblastn |
| LAB736_H331 | arnica|11v1|SRR099034X102482_P1 | 4431 | 8840 | 588 | 83.4 | globlastp |
| LAB736_H332 | artemisia|10v1|SRR019254S0015330_P1 | 4432 | 8841 | 588 | 83.4 | globlastp |
| LAB736_H333 | cannabis|12v1|JK493102_P1 | 4433 | 8842 | 588 | 83.4 | globlastp |
| LAB736_H334 | cirsium|11v1|SRR346952.103512_P1 | 4434 | 8843 | 588 | 83.4 | globlastp |
| LAB736_H335 | euonymus|11v1|SRR070038X10672_P1 | 4435 | 8844 | 588 | 83.4 | globlastp |
| LAB736_H336 | euphorbia|11v1|DV126326_P1 | 4436 | 8845 | 588 | 83.4 | globlastp |
| LAB736_H337 | humulus|11v1|EX517745_P1 | 4437 | 8842 | 588 | 83.4 | globlastp |
| LAB736_H338 | melon|10v1|AM714282_P1 | 4438 | 8846 | 588 | 83.4 | globlastp |
| LAB736_H339 | orobanche|10v1|SRR023189S0012506_P1 | 4439 | 8847 | 588 | 83.4 | globlastp |
| LAB736_H340 | rye|12v1|DRR001012.121140_T1 | 4440 | 8848 | 588 | 83.4 | glotblastn |
| LAB736_H341 | senecio|gb170|DY663749_P1 | 4441 | 8849 | 588 | 83.4 | globlastp |
| LAB736_H342 | trigonella|11v1|SRR066194X10492_P1 | 4442 | 8850 | 588 | 83.4 | globlastp |
| LAB736_H343 | triphysaria|10v1|SRR023500S0004223_P1 | 4443 | 8851 | 588 | 83.4 | globlastp |
| LAB736_H344 | gnetum|10v1|EX946344_P1 | 4444 | 8852 | 588 | 83.1 | globlastp |
| LAB736_H345 | ambrosia|11v1|SRR346935.152382_T1 | 4445 | 8853 | 588 | 83.01 | glotblastn |
| LAB736_H346 | flaveria|11v1|SRR149232.10525_T1 | 4446 | 8854 | 588 | 83.01 | glotblastn |
| LAB736_H347 | lotus|09v1|LLBW594340_T1 | 4447 | 8855 | 588 | 83.01 | glotblastn |
| LAB736_H348 | utricularia|11v1|SRR094438.100830_T1 | 4448 | 8856 | 588 | 83.01 | glotblastn |
| LAB736_H349 | cleome_spinosa|10v1|GR931681_P1 | 4449 | 8857 | 588 | 83 | globlastp |
| LAB736_H350 | cleome_spinosa|10v1|GR931694_P1 | 4450 | 8858 | 588 | 83 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB736_H351 | dandelion\|10v1\|DY809241_P1 | 4451 | 8859 | 588 | 83 | globlastp |
| LAB736_H352 | olea\|13v1\|SRR014463X11285D1_P1 | 4452 | 8860 | 588 | 83 | globlastp |
| LAB736_H353 | olea\|13v1\|SRR014463X20456D1_P1 | 4453 | 8861 | 588 | 83 | globlastp |
| LAB736_H354 | olea\|13v1\|SRR014463X50558D1_P1 | 4454 | 8862 | 588 | 83 | globlastp |
| LAB736_H355 | triphysaria\|10v1\|BM356527_P1 | 4455 | 8863 | 588 | 83 | globlastp |
| LAB736_H356 | triphysaria\|10v1\|EX992837_P1 | 4456 | 8863 | 588 | 83 | globlastp |
| LAB736_H357 | tripterygium\|11v1\|SRR098677X107213_P1 | 4457 | 8864 | 588 | 83 | globlastp |
| LAB736_H358 | fagopyrum\|11v1\|SRR063689X102658_P1 | 4458 | 8865 | 588 | 82.7 | globlastp |
| LAB736_H359 | tomato\|11v1\|BG124605_P1 | 4459 | 8866 | 588 | 82.7 | globlastp |
| LAB736_H360 | fagopyrum\|11v1\|SRR063703X101240_T1 | 4460 | 8867 | 588 | 82.69 | glotblastn |
| LAB736_H361 | utricularia\|11v1\|SRR094438.11242_T1 | 4461 | 8868 | 588 | 82.63 | glotblastn |
| LAB736_H362 | wheat\|12v3\|CA484492_T1 | 4462 | 8869 | 588 | 82.63 | glotblastn |
| LAB736_H363 | olea\|13v1\|SRR014464X37685D1_P1 | 4463 | 8870 | 588 | 82.6 | globlastp |
| LAB736_H364 | orobanche\|10v1\|SRR023189S0006337_P1 | 4464 | 8871 | 588 | 82.6 | globlastp |
| LAB736_H365 | thellungiella_parvulum\|11v1\|BY802561_P1 | 4465 | 8872 | 588 | 82.6 | globlastp |
| LAB736_H366 | tripterygium\|11v1\|SRR098677X101979_P1 | 4466 | 8873 | 588 | 82.6 | globlastp |
| LAB736_H367 | fagopyrum\|11v1\|GO898729_P1 | 4467 | 8874 | 588 | 82.4 | globlastp |
| LAB736_H368 | fagopyrum\|11v1\|SRR063689X111618_P1 | 4468 | 8875 | 588 | 82.4 | globlastp |
| LAB736_H369 | fern\|gb171\|BP916158_P1 | 4469 | 8876 | 588 | 82.4 | globlastp |
| LAB736_H370 | liquorice\|gb171\|FS241495_P1 | 4470 | 8877 | 588 | 82.3 | globlastp |
| LAB736_H371 | nicotiana_benthamiana\|12v1\|BP746782_P1 | 4471 | 8878 | 588 | 82.3 | globlastp |
| LAB736_H372 | potato\|10v1\|BF053135_P1 | 4472 | 8879 | 588 | 82.3 | globlastp |
| LAB736_H373 | potato\|10v1\|BF460091_P1 | 4473 | 8880 | 588 | 82.3 | globlastp |
| LAB736_H374 | solanum_phureja\|09v1\|SPHBG124605_P1 | 4474 | 8880 | 588 | 82.3 | globlastp |
| LAB736_H375 | artemisia\|10v1\|EY045386_T1 | 4475 | 8881 | 588 | 82.24 | glotblastn |
| LAB736_H376 | b_rapa\|11v1\|H74713_P1 | 4476 | 8882 | 588 | 82.2 | globlastp |
| LAB736_H377 | canola\|11v1\|DY028402_P1 | 4477 | 8883 | 588 | 82.2 | globlastp |
| LAB736_H378 | cleome_spinosa\|10v1\|SRR015531S0002670_P1 | 4478 | 8884 | 588 | 82.2 | globlastp |
| LAB736_H379 | humulus\|11v1\|GD249260_P1 | 4479 | 8885 | 588 | 82.2 | globlastp |
| LAB736_H380 | monkeyflower\|12v1\|DV206488_P1 | 4480 | 8886 | 588 | 82.2 | globlastp |
| LAB736_H381 | olea\|13v1\|SRR014463X29930D1_P1 | 4481 | 8887 | 588 | 82.2 | globlastp |
| LAB736_H382 | thellungiella_halophilum\|11v1\|BY802561_P1 | 4482 | 8888 | 588 | 82.2 | globlastp |
| LAB736_H383 | thellungiella_halophilum\|11v1\|BY805880_P1 | 4483 | 8889 | 588 | 82.2 | globlastp |
| LAB736_H384 | arabidopsis\|10v1\|AT2G47610_P1 | 4484 | 8890 | 588 | 81.9 | globlastp |
| LAB736_H385 | b_juncea\|12v1\|E6ANDIZ01A9AN0_P1 | 4485 | 8891 | 588 | 81.9 | globlastp |
| LAB736_H386 | canola\|11v1\|CN829492_P1 | 4486 | 8892 | 588 | 81.9 | globlastp |
| LAB736_H387 | cleome_gynandra\|10v1\|SRR015532S0000623_P1 | 4487 | 8893 | 588 | 81.9 | globlastp |
| LAB736_H388 | potato\|10v1\|BG351194_P1 | 4488 | 8894 | 588 | 81.9 | globlastp |
| LAB736_H389 | sarracenia\|11v1\|SRR192669.162752XX1_P1 | 4489 | 8895 | 588 | 81.9 | globlastp |
| LAB736_H390 | solanum_phureja\|09v1\|SPHBG126430_P1 | 4490 | 8894 | 588 | 81.9 | globlastp |
| LAB736_H391 | strawberry\|11v1\|SRR034859S0009620_P1 | 4491 | 8896 | 588 | 81.9 | globlastp |
| LAB736_H392 | thellungiella_halophilum\|11v1\|BY801480_P1 | 4492 | 8897 | 588 | 81.9 | globlastp |
| LAB736_H393 | triphysaria\|10v1\|EY129416_P1 | 4493 | 8898 | 588 | 81.9 | globlastp |
| LAB736_H394 | fraxinus\|11v1\|SRR058827.118836_T1 | 4494 | 8899 | 588 | 81.85 | glotblastn |
| LAB736_H395 | b_juncea\|12v1\|E6ANDIZ01ADW5C_P1 | 4495 | 8900 | 588 | 81.5 | globlastp |
| LAB736_H396 | b_oleracea\|gb161\|AM385950_P1 | 4496 | 8901 | 588 | 81.5 | globlastp |
| LAB736_H397 | b_rapa\|11v1\|CD813355_P1 | 4497 | 8900 | 588 | 81.5 | globlastp |
| LAB736_H398 | b_rapa\|11v1\|H07664_P1 | 4498 | 8901 | 588 | 81.5 | globlastp |
| LAB736_H399 | canola\|11v1\|CN731188_P1 | 4499 | 8901 | 588 | 81.5 | globlastp |
| LAB736_H400 | radish\|gb164\|EV527247_P1 | 4500 | 8902 | 588 | 81.5 | globlastp |
| LAB736_H401 | solanum_phureja\|09v1\|SPHBG131735_P1 | 4501 | 8903 | 588 | 81.5 | globlastp |
| LAB736_H402 | tomato\|11v1\|BG126430_P1 | 4502 | 8904 | 588 | 81.5 | globlastp |
| LAB736_H403 | b_oleracea\|gb161\|DY027254_T1 | 4503 | 8905 | 588 | 81.47 | glotblastn |
| LAB736_H404 | fraxinus\|11v1\|SRR058827.107830_T1 | 4504 | 8906 | 588 | 81.47 | glotblastn |
| LAB736_H405 | fraxinus\|11v1\|SRR058827.108879XX1_T1 | 4505 | 8907 | 588 | 81.47 | glotblastn |
| LAB736_H76 | apple\|11v1\|MDP0000243029_P1 | 4506 | 8908 | 588 | 81.2 | globlastp |
| LAB736_H406 | b_juncea\|12v1\|E6ANDIZ01AK52I_P1 | 4507 | 8909 | 588 | 81.1 | globlastp |
| LAB736_H407 | b_juncea\|12v1\|E6ANDIZ01ASS71_P1 | 4508 | 8910 | 588 | 81.1 | globlastp |
| LAB736_H408 | b_juncea\|12v1\|E6ANDIZ01BEY25_P1 | 4509 | 8911 | 588 | 81.1 | globlastp |
| LAB736_H409 | b_juncea\|12v1\|E6ANDIZ01BIGDC_P1 | 4510 | 8912 | 588 | 81.1 | globlastp |
| LAB736_H410 | b_oleracea\|gb161\|DY025922_P1 | 4511 | 8913 | 588 | 81.1 | globlastp |
| LAB736_H411 | b_rapa\|11v1\|CD817380_P1 | 4512 | 8914 | 588 | 81.1 | globlastp |
| LAB736_H412 | canola\|11v1\|CN726276_P1 | 4513 | 8915 | 588 | 81.1 | globlastp |
| LAB736_H413 | canola\|11v1\|CN730269_P1 | 4514 | 8915 | 588 | 81.1 | globlastp |
| LAB736_H414 | canola\|11v1\|CN732143_P1 | 4515 | 8913 | 588 | 81.1 | globlastp |
| LAB736_H415 | canola\|11v1\|CN735686_P1 | 4516 | 8916 | 588 | 81.1 | globlastp |
| LAB736_H416 | canola\|11v1\|DW999229_P1 | 4517 | 8915 | 588 | 81.1 | globlastp |
| LAB736_H417 | canola\|11v1\|EE474766_P1 | 4518 | 8915 | 588 | 81.1 | globlastp |
| LAB736_H418 | canola\|11v1\|H07610_P1 | 4519 | 8917 | 588 | 81.1 | globlastp |
| LAB736_H419 | canola\|11v1\|H07664_P1 | 4520 | 8918 | 588 | 81.1 | globlastp |
| LAB736_H420 | canola\|11v1\|SRR001111.11920_P1 | 4521 | 8915 | 588 | 81.1 | globlastp |
| LAB736_H421 | canola\|11v1\|SRR001111.13473_P1 | 4522 | 8918 | 588 | 81.1 | globlastp |
| LAB736_H422 | ginger\|gb164\|DY365119_P1 | 4523 | 8919 | 588 | 81.1 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB736_H423 | iceplant\|gb164\|BE035811_P1 | 4524 | 8920 | 588 | 81.1 | globlastp |
| LAB736_H424 | radish\|gb164\|EV526734_P1 | 4525 | 8915 | 588 | 81.1 | globlastp |
| LAB736_H425 | radish\|gb164\|EV539295_P1 | 4526 | 8921 | 588 | 81.1 | globlastp |
| LAB736_H426 | radish\|gb164\|EW713801_P1 | 4527 | 8922 | 588 | 81.1 | globlastp |
| LAB736_H427 | radish\|gb164\|EW714466_P1 | 4528 | 8915 | 588 | 81.1 | globlastp |
| LAB736_H428 | safflower\|gb162\|EL403192_P1 | 4529 | 8923 | 588 | 81.1 | globlastp |
| LAB736_H429 | b_juncea\|12v1\|E6ANDIZ01BGI91_T1 | 4530 | 8924 | 588 | 81.08 | glotblastn |
| LAB736_H430 | fraxinus\|11v1\|SRR058827.106101_T1 | 4531 | 8925 | 588 | 81.08 | glotblastn |
| LAB736_H431 | ceratodon\|10v1\|SRR074890S0013604_P1 | 4532 | 8926 | 588 | 81 | globlastp |
| LAB736_H432 | pteridium\|11v1\|SRR043594X107257_P1 | 4533 | 8927 | 588 | 80.9 | globlastp |
| LAB736_H433 | pteridium\|11v1\|SRR043594X11299_P1 | 4534 | 8928 | 588 | 80.9 | globlastp |
| LAB736_H434 | watermelon\|11v1\|VMEL00271614810744_P1 | 4535 | 8929 | 588 | 80.9 | globlastp |
| LAB736_H435 | pepper\|12v1\|BM059772_P1 | 4536 | 8930 | 588 | 80.8 | globlastp |
| LAB736_H436 | arabidopsis_lyrata\|09v1\|JGIAL019637_P1 | 4537 | 8931 | 588 | 80.7 | globlastp |
| LAB736_H437 | arabidopsis\|10v1\|AT3G62870_P1 | 4538 | 8932 | 588 | 80.7 | globlastp |
| LAB736_H438 | b_juncea\|12v1\|E6ANDIZ01A2BTE_P1 | 4539 | 8933 | 588 | 80.7 | globlastp |
| LAB736_H439 | b_juncea\|12v1\|E6ANDIZ01AWD04_P1 | 4540 | 8934 | 588 | 80.7 | globlastp |
| LAB736_H440 | b_oleracea\|gb161\|DY027226_P1 | 4541 | 8935 | 588 | 80.7 | globlastp |
| LAB736_H441 | b_rapa\|11v1\|CD815533_P1 | 4542 | 8936 | 588 | 80.7 | globlastp |
| LAB736_H442 | b_rapa\|11v1\|CX188832_P1 | 4543 | 8937 | 588 | 80.7 | globlastp |
| LAB736_H443 | b_rapa\|11v1\|H07610_P1 | 4544 | 8938 | 588 | 80.7 | globlastp |
| LAB736_H444 | canola\|11v1\|CN732426_P1 | 4545 | 8938 | 588 | 80.7 | globlastp |
| LAB736_H445 | canola\|11v1\|EE454032_P1 | 4546 | 8938 | 588 | 80.7 | globlastp |
| LAB736_H446 | canola\|11v1\|EE554163XX1_P1 | 4547 | 8937 | 588 | 80.7 | globlastp |
| LAB736_H447 | cynara\|gb167\|GE606374_P1 | 4548 | 8939 | 588 | 80.7 | globlastp |
| LAB736_H448 | flaveria\|11v1\|SRR149229.148826_P1 | 4549 | 8940 | 588 | 80.7 | globlastp |
| LAB736_H449 | radish\|gb164\|EV525677_P1 | 4550 | 8941 | 588 | 80.7 | globlastp |
| LAB736_H450 | radish\|gb164\|EV541257_P1 | 4551 | 8942 | 588 | 80.7 | globlastp |
| LAB736_H451 | radish\|gb164\|EW717163_P1 | 4552 | 8943 | 588 | 80.7 | globlastp |
| LAB736_H452 | b_juncea\|12v1\|E6ANDIZ01A8D7A_T1 | 4553 | 8944 | 588 | 80.69 | glotblastn |
| LAB736_H453 | flaveria\|11v1\|SRR149238.2401_T1 | 4554 | 8945 | 588 | 80.69 | glotblastn |
| LAB736_H454 | physcomitrella\|10v1\|BQ040518_P1 | 4555 | 8946 | 588 | 80.6 | globlastp |
| LAB736_H50 | platanus\|11v1\|SRR096786X135848_P1 | 4556 | 8947 | 588 | 80.6 | globlastp |
| LAB736_H455 | cirsium\|11v1\|SRR346952.610836_P1 | 4557 | 8948 | 588 | 80.5 | globlastp |
| LAB736_H456 | arabidopsis_lyrata\|09v1\|JGIAL016184_T1 | 4558 | 8949 | 588 | 80.31 | glotblastn |
| LAB736_H457 | flaveria\|11v1\|SRR149229.379853_T1 | 4559 | 8950 | 588 | 80.31 | glotblastn |
| LAB736_H458 | cannabis\|12v1\|JK493528_P1 | 4560 | 8951 | 588 | 80.3 | globlastp |
| LAB736_H459 | canola\|11v1\|EE460183_P1 | 4561 | 8952 | 588 | 80.3 | globlastp |
| LAB736_H460 | fraxinus\|11v1\|SRR058827.11248_P1 | 4562 | 8953 | 588 | 80.3 | globlastp |
| LAB736_H461 | fraxinus\|11v1\|SRR058827.143853_P1 | 4563 | 8954 | 588 | 80.3 | globlastp |
| LAB736_H462 | radish\|gb164\|EV570087_P1 | 4564 | 8955 | 588 | 80.3 | globlastp |
| LAB736_H463 | silene\|11v1\|SRR096785X119902_P1 | 4565 | 8956 | 588 | 80.3 | globlastp |
| LAB736_H464 | thellungiella_parvulum\|11v1\|BY801481_P1 | 4566 | 8957 | 588 | 80.3 | globlastp |
| LAB736_H465 | marchantia\|gb166\|AU081821_P1 | 4567 | 8958 | 588 | 80.2 | globlastp |
| LAB738, LAB738_H1 | rice\|11v1\|AA751333 | 4568 | 8959 | 589 | 99.9 | globlastp |
| LAB738_H2 | barley\|10v2\|AV833411 | 4569 | 8960 | 589 | 96.4 | globlastp |
| LAB738_H2 | barley\|12v1\|AV833411_P1 | 4570 | 8960 | 589 | 96.4 | globlastp |
| LAB738_H3 | brachypodium\|12v1\|BRADI1G35960_P1 | 4571 | 8961 | 589 | 96.3 | globlastp |
| LAB738_H4 | rye\|12v1\|DRR001012.111848 | 4572 | 8962 | 589 | 96.3 | globlastp |
| LAB738_H5 | rye\|12v1\|DRR001012.116924 | 4573 | 8962 | 589 | 96.3 | globlastp |
| LAB738_H6 | wheat\|10v2\|BE423931 | 4574 | 8963 | 589 | 96.1 | globlastp |
| LAB738_H6 | wheat\|12v3\|BE423931_P1 | 4575 | 8963 | 589 | 96.1 | globlastp |
| LAB738_H94 | wheat\|12v3\|AL818007_P1 | 4576 | 8964 | 589 | 96 | globlastp |
| LAB738_H95 | wheat\|12v3\|CV066767_P1 | 4577 | 8965 | 589 | 96 | globlastp |
| LAB738_H7 | sugarcane\|10v1\|CA074185 | 4578 | 8966 | 589 | 95.2 | globlastp |
| LAB738_H8 | sorghum\|12v1\|SB10G024200 | 4579 | 8967 | 589 | 95.1 | globlastp |
| LAB738_H96 | switchgrass\|12v1\|FL697837_P1 | 4580 | 8968 | 589 | 94.7 | globlastp |
| LAB738_H97 | switchgrass\|12v1\|PV12v1PRD050484_P1 | 4581 | 8968 | 589 | 94.7 | globlastp |
| LAB738_H11 | switchgrass\|12v1\|FE599555_P1 | 4582 | 8969 | 589 | 94.5 | globlastp |
| LAB738_H9 | foxtail_millet\|11v3\|PHY7SI005897M_P1 | 4583 | 8970 | 589 | 94.2 | globlastp |
| LAB738_H10 | foxtail_millet\|11v3\|SICRP101553_P1 | 4584 | 8970 | 589 | 94.2 | globlastp |
| LAB738_H11 | switchgrass\|gb167\|FE599555 | 4585 | 8971 | 589 | 94.2 | globlastp |
| LAB738_H12 | millet\|10v1\|EVO454PM035993_P1 | 4586 | 8972 | 589 | 93.9 | globlastp |
| LAB738_H13 | maize\|10v1\|AI691519_P1 | 4587 | 8973 | 589 | 93.5 | globlastp |
| LAB738_H14 | maize\|10v1\|AW171782_P1 | 4588 | 8974 | 589 | 93.2 | globlastp |
| LAB738_H98 | banana\|12v1\|MAGEN2012027451_P1 | 4589 | 8975 | 589 | 89.3 | globlastp |
| LAB738_H15 | oil_palm\|11v1\|EL685913_P1 | 4590 | 8976 | 589 | 89.2 | globlastp |
| LAB738_H16 | aristolochia\|10v1\|FD749188_P1 | 4591 | 8977 | 589 | 85.3 | globlastp |
| LAB738_H17 | clementine\|11v1\|CF828766_P1 | 4592 | 8978 | 589 | 85.1 | globlastp |
| LAB738_H18 | orange\|11v1\|CF828766_P1 | 4593 | 8978 | 589 | 85.1 | globlastp |
| LAB738_H19 | poplar\|10v1\|BI135550 | 4594 | 8979 | 589 | 84.92 | glotblastn |
| LAB738_H20 | phalaenopsis\|11v1\|SRR125771.1009671_P1 | 4595 | 8980 | 589 | 84.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB738_H21 | poplar\|10v1\|BI138396 | 4596 | 8981 | 589 | 84.9 | globlastp |
| LAB738_H19, LAB738_H21 | poplar\|13v1\|BI135550_P1 | 4597 | 8981 | 589 | 84.9 | globlastp |
| LAB738_H22 | amorphophallus\|11v2\|SRR089351X379368_T1 | 4598 | 8982 | 589 | 84.66 | glotblastn |
| LAB738_H23 | vinca\|11v1\|SRR098690X134508 | 4599 | 8983 | 589 | 84.66 | glotblastn |
| LAB738_H99 | castorbean\|12v1\|EE258884_T1 | 4600 | 8984 | 589 | 84.54 | glotblastn |
| LAB738_H24 | apple\|11v1\|CN491356_P1 | 4601 | 8985 | 589 | 84.5 | globlastp |
| LAB738_H100 | aquilegia\|10v2\|DT746718_P1 | 4602 | 8986 | 589 | 84.3 | globlastp |
| LAB738_H101 | sesame\|12v1\|SESI12V1264936_P1 | 4603 | 8987 | 589 | 84.3 | globlastp |
| LAB738_H25 | tabernaemontana\|11v1\|SRR098689X112973 | 4604 | 8988 | 589 | 84.3 | globlastp |
| LAB738_H26 | cotton\|11v1\|CO079317_P1 | 4605 | 8989 | 589 | 84.1 | globlastp |
| LAB738_H27 | euphorbia\|11v1\|SRR098678X104741_P1 | 4606 | 8990 | 589 | 84.1 | globlastp |
| LAB738_H28 | vinca\|11v1\|SRR098690X103965 | 4607 | 8991 | 589 | 84.1 | globlastp |
| LAB738_H29 | cotton\|11v1\|AI726119_T1 | 4608 | 8992 | 589 | 84.02 | glotblastn |
| LAB738_H102 | bean\|12v2\|SRR001334.132978_P1 | 4609 | 8993 | 589 | 84 | globlastp |
| LAB738_H103 | prunus_mume\|13v1\|BU040865_P1 | 4610 | 8994 | 589 | 84 | globlastp |
| LAB738_H31 | cacao\|10v1\|CU484549_P1 | 4611 | 8995 | 589 | 84 | globlastp |
| LAB738_H32 | cucumber\|09v1\|BGI454G0046050_P1 | 4612 | 8996 | 589 | 84 | globlastp |
| LAB738_H33 | gossypium_raimondii\|12v1\|AI726119_P1 | 4613 | 8997 | 589 | 84 | globlastp |
| LAB738_H34 | grape\|11v1\|DV221675_P1 | 4614 | 8998 | 589 | 84 | globlastp |
| LAB738_H35 | grape\|11v1\|GSVIVT01033529001_P1 | 4615 | 8998 | 589 | 84 | globlastp |
| LAB738_H36 | tomato\|11v1\|CK266233 | 4616 | 8999 | 589 | 84 | globlastp |
| LAB738_H43 | poplar\|13v1\|AI166027_P1 | 4617 | 9000 | 589 | 84 | globlastp |
| LAB738_H37 | arabidopsis\|10v1\|AT3G57880_P1 | 4618 | 9001 | 589 | 83.9 | globlastp |
| LAB738_H38 | plantago\|11v2\|SRR066373X11771_P1 | 4619 | 9002 | 589 | 83.9 | globlastp |
| LAB738_H39 | watermelon\|11v1\|VMEL04875107700323 | 4620 | 9003 | 589 | 83.9 | globlastp |
| LAB738_H40 | arabidopsis_lyrata\|09v1\|JGIAL019081_P1 | 4621 | 9004 | 589 | 83.8 | globlastp |
| LAB738_H41 | eucalyptus\|11v2\|ES596977_P1 | 4622 | 9005 | 589 | 83.8 | globlastp |
| LAB738_H42 | flaveria\|11v1\|SRR149229.93324_P1 | 4623 | 9006 | 589 | 83.8 | globlastp |
| LAB738_H43 | poplar\|10v1\|AI166027 | 4624 | 9007 | 589 | 83.8 | globlastp |
| LAB738_H44 | solanum_phureja\|09v1\|SPHCK266233 | 4625 | 9008 | 589 | 83.8 | globlastp |
| LAB738_H45 | tripterygium\|11v1\|SRR098677X101001 | 4626 | 9009 | 589 | 83.8 | globlastp |
| LAB738_H46 | tomato\|11v1\|AI486042 | 4627 | 9010 | 589 | 83.7 | globlastp |
| LAB738_H47 | beech\|11v1\|SRR006293.32563_T1 | 4628 | 9011 | 589 | 83.66 | glotblastn |
| LAB738_H48 | pigeonpea\|11v1\|SRR054580X105301_P1 | 4629 | 9012 | 589 | 83.6 | globlastp |
| LAB738_H104 | bean\|12v2\|CA913595_P1 | 4630 | 9013 | 589 | 83.5 | globlastp |
| LAB738_H105 | nicotiana_benthamiana\|12v1\|EH370031_P1 | 4631 | 9014 | 589 | 83.5 | globlastp |
| LAB738_H49 | bean\|12v1\|CA913595 | 4632 | 9013 | 589 | 83.5 | globlastp |
| LAB738_H50 | cucumber\|09v1\|AM714320_P1 | 4633 | 9015 | 589 | 83.5 | globlastp |
| LAB738_H51 | pigeonpea\|11v1\|CCIIPG11029439_P1 | 4634 | 9016 | 589 | 83.5 | globlastp |
| LAB738_H52 | pigeonpea\|11v1\|SRR054580X127989_P1 | 4635 | 9016 | 589 | 83.5 | globlastp |
| LAB738_H53 | thellungiella_halophilum\|11v1\|DN774551 | 4636 | 9017 | 589 | 83.5 | globlastp |
| LAB738_H54 | thellungiella_halophilum\|11v1\|EHCRP065122 | 4637 | 9017 | 589 | 83.5 | globlastp |
| LAB738_H106 | blueberry\|12v1\|SRR353282X25634D1_T1 | 4638 | 9018 | 589 | 83.4 | glotblastn |
| LAB738_H55 | strawberry\|11v1\|DY674884 | 4639 | 9019 | 589 | 83.4 | globlastp |
| LAB738_H56 | watermelon\|11v1\|AM714320 | 4640 | 9020 | 589 | 83.4 | globlastp |
| LAB738_H57 | beet\|12v1\|BQ583781_P1 | 4641 | 9021 | 589 | 83.3 | globlastp |
| LAB738_H58 | monkeyflower\|10v1\|DV207742 | 4642 | 9022 | 589 | 83.3 | globlastp |
| LAB738_H58 | monkeyflower\|12v1\|DV207742_P1 | 4643 | 9022 | 589 | 83.3 | globlastp |
| LAB738_H59 | valeriana\|11v1\|SRR099039X11064 | 4644 | 9023 | 589 | 83.3 | globlastp |
| LAB738_H60 | silene\|11v1\|SRR096785X105314 | 4645 | 9024 | 589 | 83.2 | globlastp |
| LAB738_H107 | zostera\|12v1\|SRR057351X101106D1_P1 | 4646 | 9025 | 589 | 83.1 | globlastp |
| LAB738_H61 | zostera\|10v1\|SRR057351S0009902 | 4647 | 9025 | 589 | 83.1 | globlastp |
| LAB738_H108 | aquilegia\|10v2\|DR913521_P1 | 4648 | 9026 | 589 | 83 | globlastp |
| LAB738_H62 | amborella\|12v3\|SRR038634.16406_P1 | 4649 | 9027 | 589 | 83 | globlastp |
| LAB738_H63 | b_rapa\|11v1\|CD813540_P1 | 4650 | 9028 | 589 | 83 | globlastp |
| LAB738_H64 | soybean\|11v1\|GLYMA19G32730 | 4651 | 9029 | 589 | 83 | globlastp |
| LAB738_H64 | soybean\|12v1\|GLYMA19G32730_P1 | 4652 | 9029 | 589 | 83 | globlastp |
| LAB738_H65 | thellungiella_parvulum\|11v1\|DN774551 | 4653 | 9030 | 589 | 83 | globlastp |
| LAB738_H109 | banana\|12v1\|MAGEN2012020855_P1 | 4654 | 9031 | 589 | 82.9 | globlastp |
| LAB738_H66 | medicago\|12v1\|BG448505_P1 | 4655 | 9032 | 589 | 82.9 | globlastp |
| LAB738_H67 | soybean\|11v1\|GLYMA03G29840 | 4656 | 9033 | 589 | 82.9 | globlastp |
| LAB738_H67 | soybean\|12v1\|GLYMA03G29840T3_P1 | 4657 | 9033 | 589 | 82.9 | globlastp |
| LAB738_H68 | chickpea\|11v1\|GR914055 | 4658 | 9034 | 589 | 82.8 | globlastp |
| LAB738_H68 | chickpea\|13v2\|GR914055_P1 | 4659 | 9034 | 589 | 82.8 | globlastp |
| LAB738_H69 | sunflower\|12v1\|DY904454 | 4660 | 9035 | 589 | 82.7 | globlastp |
| LAB738_H70 | poppy\|11v1\|SRR030259.120954_P1 | 4661 | 9036 | 589 | 82.6 | globlastp |
| LAB738_H71 | canola\|11v1\|EE553143_P1 | 4662 | 9037 | 589 | 82.5 | globlastp |
| LAB738_H72 | solanum_phureja\|09v1\|SPHCRPSP045467 | 4663 | 9038 | 589 | 82.5 | globlastp |
| LAB738_H73 | tomato\|11v1\|FN000203 | 4664 | 9039 | 589 | 82.5 | globlastp |
| LAB738_H110 | lettuce\|12v1\|CV699924_P1 | 4665 | 9040 | 589 | 82.4 | globlastp |
| LAB738_H74 | b_rapa\|11v1\|CD826734_P1 | 4666 | 9041 | 589 | 82.4 | globlastp |
| LAB738_H75 | amorphophallus\|11v2\|SRR089351X104690_P1 | 4667 | 9042 | 589 | 82.3 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB738_H76 | chickpea|11v1|SRR133517.110375 | 4668 | 9043 | 589 | 82.1 | globlastp |
| LAB738_H76 | chickpea|13v2|SRR133517.110375_P1 | 4669 | 9043 | 589 | 82.1 | globlastp |
| LAB738_H77 | nasturtium|11v1|SRR032558.127153_P1 | 4670 | 9044 | 589 | 81.8 | globlastp |
| LAB738_H78 | orobanche|10v1|SRR023189S0037981_P1 | 4671 | 9045 | 589 | 81.8 | globlastp |
| LAB738_H111 | nicotiana_benthamiana|12v1|FG132662_P1 | 4672 | 9046 | 589 | 81.7 | globlastp |
| LAB738_H79 | prunus|10v1|BU040865 | 4673 | 9047 | 589 | 81.7 | globlastp |
| LAB738_H112 | nicotiana_benthamiana|12v1|EB434069_P1 | 4674 | 9048 | 589 | 81.6 | globlastp |
| LAB738_H113 | lettuce|12v1|DY960088_P1 | 4675 | 9049 | 589 | 81.5 | globlastp |
| LAB738_H80 | cotton|11v1|AI728115_P1 | 4676 | 9050 | 589 | 81.5 | globlastp |
| LAB738_H81 | cotton|11v1|BG440202_P1 | 4677 | 9051 | 589 | 81.5 | globlastp |
| LAB738_H82 | gossypium_raimondii|12v1|AI728115_P1 | 4678 | 9051 | 589 | 81.5 | globlastp |
| LAB738_H83 | arabidopsis_lyrata|09v1|JGIAL004632_P1 | 4679 | 9052 | 589 | 81.4 | globlastp |
| LAB738_H84 | eschscholzia|11v1|SRR014116.104771_T1 | 4680 | 9053 | 589 | 81.4 | glotblastn |
| LAB738_H85 | cacao|10v1|CU471395_P1 | 4681 | 9054 | 589 | 81.3 | globlastp |
| LAB738_H86 | soybean|11v1|GLYMA10G11910 | 4682 | 9055 | 589 | 81.2 | globlastp |
| LAB738_H86 | soybean|12v1|GLYMA10G11910_P1 | 4683 | 9055 | 589 | 81.2 | globlastp |
| LAB738_H114 | nicotiana_benthamiana|12v1|NB12v1CRP063262_P1 | 4684 | 9056 | 589 | 81.1 | globlastp |
| LAB738_H87 | orange|11v1|BQ623995_P1 | 4685 | 9057 | 589 | 81.1 | globlastp |
| LAB738_H88 | thellungiella_halophilum|11v1|EHJGI11005539 | 4686 | 9058 | 589 | 81 | globlastp |
| LAB738_H89 | clementine|11v1|BQ623995_P1 | 4687 | 9059 | 589 | 80.9 | globlastp |
| LAB738_H90 | arabidopsis|10v1|AT1G51570_P1 | 4688 | 9060 | 589 | 80.8 | globlastp |
| LAB738_H91 | gossypium_raimondii|12v1|DT544433_P1 | 4689 | 9061 | 589 | 80.4 | globlastp |
| LAB738_H92 | cotton|11v1|CO108032_P1 | 4690 | 9062 | 589 | 80.3 | globlastp |
| LAB738_H93 | ambrosia|11v1|SRR346935.103505_P1 | 4691 | 9063 | 589 | 80.2 | globlastp |
| LAB740_H1 | sorghum|12v1|SB03G000860 | 4692 | 9064 | 591 | 90.3 | globlastp |
| LAB740_H2 | maize|10v1|AW438269_T1 | 4693 | 9065 | 591 | 89.16 | glotblastn |
| LAB740_H3 | leymus|gb166|EG375183_P1 | 4694 | 9066 | 591 | 80.4 | globlastp |
| LAB740_H4 | wheat|10v2|BE492719 | 4695 | 9067 | 591 | 80.4 | globlastp |
| LAB741_H1 | maize|10v1|AI947275_P1 | 4696 | 9068 | 592 | 92.2 | globlastp |
| LAB741_H2 | foxtail_millet|11v3|PHY7SI001484M_P1 | 4697 | 9069 | 592 | 87.6 | globlastp |
| LAB741_H3 | switchgrass|12v1|GD020272_P1 | 4698 | 9070 | 592 | 85.6 | globlastp |
| LAB741_H4 | switchgrass|12v1|GD032484_P1 | 4699 | 9071 | 592 | 85.2 | globlastp |
| LAB744_H3 | switchgrass|12v1|FL909921_T1 | 4700 | 9072 | 594 | 87.13 | glotblastn |
| LAB744_H5 | switchgrass|12v1|HO323691_T1 | 4701 | 9073 | 594 | 86.14 | glotblastn |
| LAB744_H2 | millet|10v1|EVO454PM086263_T1 | 4702 | 9074 | 594 | 86.14 | glotblastn |
| LAB744_H3 | switchgrass|gb167|FL909921 | 4703 | 9075 | 594 | 86.14 | glotblastn |
| LAB744_H4 | foxtail_millet|11v3|PHY7SI001466M_T1 | 4704 | 9076 | 594 | 85.15 | glotblastn |
| LAB748_H1 | sugarcane|10v1|CA121279 | 4705 | 596 | 596 | 100 | globlastp |
| LAB748_H2 | maize|10v1|AW054474_P1 | 4706 | 9077 | 596 | 97.6 | globlastp |
| LAB748_H3 | foxtail_millet|11v3|PHY7SI037580M_P1 | 4707 | 9078 | 596 | 96.4 | globlastp |
| LAB748_H4 | maize|10v1|AW147094_P1 | 4708 | 9079 | 596 | 95.2 | globlastp |
| LAB748_H5 | millet|10v1|EVO454PM034430_P1 | 4709 | 9080 | 596 | 95.2 | globlastp |
| LAB748_H6 | wheat|10v2|CA617591 | 4710 | 9079 | 596 | 95.2 | globlastp |
| LAB748_H7 | rice|11v1|GFXAC091247X34 | 4711 | 9081 | 596 | 92.8 | globlastp |
| LAB748_H8 | oat|11v1|GO581442_P1 | 4712 | 9082 | 596 | 91.7 | globlastp |
| LAB748_H9 | fescue|gb161|DT697589_P1 | 4713 | 9083 | 596 | 90.5 | globlastp |
| LAB748_H10 | brachypodium|12v1|BRADI1G03410_P1 | 4714 | 9084 | 596 | 89.2 | globlastp |
| LAB748_H11 | switchgrass|gb167|FL840000 | 4715 | 9085 | 596 | 89.2 | globlastp |
| LAB748_H11 | switchgrass|12v1|DN141373_P1 | 4716 | 9086 | 596 | 88 | globlastp |
| LAB748_H12 | lovegrass|gb167|EH186314_P1 | 4717 | 9087 | 596 | 88 | globlastp |
| LAB748_H13 | foxtail_millet|11v3|PHY7SI031695M_P1 | 4718 | 9088 | 596 | 86.7 | globlastp |
| LAB748_H14 | millet|10v1|EVO454PM032837_P1 | 4719 | 9089 | 596 | 86.7 | globlastp |
| LAB748_H15 | switchgrass|12v1|FE617806_P1 | 4720 | 9090 | 596 | 85.5 | globlastp |
| LAB748_H15 | switchgrass|gb167|FE617806 | 4721 | 9090 | 596 | 85.5 | globlastp |
| LAB748_H29 | banana|12v1|MAGEN2012018813_P1 | 4722 | 9091 | 596 | 84.7 | globlastp |
| LAB748_H16 | oil_palm|11v1|EY397345_P1 | 4723 | 9092 | 596 | 84.5 | globlastp |
| LAB748_H17 | epimedium|11v1|SRR013502.17003_P1 | 4724 | 9093 | 596 | 83.3 | globlastp |
| LAB748_H18 | avocado|10v1|CV459198_P1 | 4725 | 9094 | 596 | 82.1 | globlastp |
| LAB748_H19 | switchgrass|12v1|FE656831_T1 | 4726 | 9095 | 596 | 81.93 | glotblastn |
| LAB748_H19 | switchgrass|gb167|FE656831 | 4727 | 9096 | 596 | 81.9 | globlastp |
| LAB748_H30 | zostera|12v1|SRR057351X122968D1_P1 | 4728 | 9097 | 596 | 81 | globlastp |
| LAB748_H20 | liriodendron|gb166|FD488260_P1 | 4729 | 9098 | 596 | 81 | globlastp |
| LAB748_H21 | oil_palm|11v1|SRR190698.141100XX1_P1 | 4730 | 9099 | 596 | 81 | globlastp |
| LAB748_H22 | zostera|10v1|SRR057351S0024218 | 4731 | 9097 | 596 | 81 | globlastp |
| LAB748_H23 | amborella|12v3|CK762188_T1 | 4732 | 9100 | 596 | 80.95 | glotblastn |
| LAB748_H24 | poppy|11v1|SRR030259.100938_T1 | 4733 | 9101 | 596 | 80.95 | glotblastn |
| LAB748_H25 | poppy|11v1|SRR030259.189287_T1 | 4734 | 9101 | 596 | 80.95 | glotblastn |
| LAB748_H26 | rice|11v1|CV730687 | 4735 | 9102 | 596 | 80 | globlastp |
| LAB748_H27 | sarracenia|11v1|SRR192669.109235 | 4736 | 9103 | 596 | 80 | globlastp |
| LAB748_H28 | sunflower|12v1|DY955975 | 4737 | 9104 | 596 | 80 | globlastp |
| LAB749_H2 | foxtail_millet|11v3|PHY7SI036600M_P1 | 4738 | 9105 | 597 | 81.3 | globlastp |
| LAB750_H3 | switchgrass|gb167|DN149820 | 4739 | 9106 | 598 | 85.75 | glotblastn |
| LAB750_H3 | switchgrass|12v1|DN149820_P1 | 4740 | 9107 | 598 | 85.4 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB752_H1 | maize\|10v1\|AI795704_P1 | 4741 | 9108 | 600 | 97.1 | globlastp |
| LAB752_H2 | foxtail_millet\|11v3\|PHY7SI016661M_P1 | 4742 | 9109 | 600 | 94 | globlastp |
| LAB752_H3 | millet\|10v1\|EVO454PM003018_P1 | 4743 | 9110 | 600 | 89.3 | globlastp |
| LAB752_H4 | rice\|11v1\|CB630474 | 4744 | 9111 | 600 | 88.2 | globlastp |
| LAB752_H5 | rice\|11v1\|HS335780 | 4745 | 9112 | 600 | 87.82 | glotblastn |
| LAB752_H6 | rye\|12v1\|DRR001012.105294 | 4746 | 9113 | 600 | 85.3 | globlastp |
| LAB752_H7 | brachypodium\|12v1\|BRADI3G03990_P1 | 4747 | 9114 | 600 | 84.8 | globlastp |
| LAB752_H8 | wheat\|10v2\|BE418284 | 4748 | 9115 | 600 | 84.8 | globlastp |
| LAB753_H2 | foxtail_millet\|11v3\|PHY7SI034194M_P1 | 4749 | 9116 | 601 | 83.3 | globlastp |
| LAB753_H3 | switchgrass\|12v1\|SRR187770.885396_P1 | 4750 | 9117 | 601 | 81.5 | globlastp |
| LAB755_H1 | sugarcane\|10v1\|CA072083 | 4751 | 9118 | 603 | 99 | globlastp |
| LAB755_H2 | maize\|10v1\|AI891244_P1 | 4752 | 9119 | 603 | 97.7 | globlastp |
| LAB755_H3 | maize\|10v1\|BG319910_P1 | 4753 | 9120 | 603 | 97.4 | globlastp |
| LAB755_H19 | switchgrass\|12v1\|FE601494_P1 | 4754 | 9121 | 603 | 95.7 | globlastp |
| LAB755_H4 | foxtail_millet\|11v3\|EC612069_P1 | 4755 | 9122 | 603 | 95.7 | globlastp |
| LAB755_H5 | millet\|10v1\|EVO454PM017512_P1 | 4756 | 9123 | 603 | 95.7 | globlastp |
| LAB755_H6 | switchgrass\|gb167\|FE601494 | 4757 | 9121 | 603 | 95.7 | globlastp |
| LAB755_H7 | cenchrus\|gb166\|EB662143_P1 | 4758 | 9124 | 603 | 95.4 | globlastp |
| LAB755_H8 | switchgrass\|gb167\|FE630750 | 4759 | 9125 | 603 | 95.4 | globlastp |
| LAB755_H20 | switchgrass\|12v1\|FE630750_T1 | 4760 | 9126 | 603 | 95.38 | glotblastn |
| LAB755_H9 | wheat\|10v2\|BE401944 | 4761 | 9127 | 603 | 93.4 | globlastp |
| LAB755_H9 | wheat\|12v3\|BE401262_P1 | 4762 | 9127 | 603 | 93.4 | globlastp |
| LAB755_H10 | rye\|12v1\|BE586997 | 4763 | 9128 | 603 | 93.1 | globlastp |
| LAB755_H11 | barley\|10v2\|BI950683 | 4764 | 9129 | 603 | 92.4 | globlastp |
| LAB755_H12 | brachypodium\|12v1\|BRADI1G56720_P1 | 4765 | 9130 | 603 | 92.4 | globlastp |
| LAB755_H13 | rye\|12v1\|DRR001012.129717 | 4766 | 9131 | 603 | 91.42 | glotblastn |
| LAB755_H14 | rice\|11v1\|BF430488 | 4767 | 9132 | 603 | 91.4 | globlastp |
| LAB755_H21 | wheat\|12v3\|BE516195_T1 | 4768 | 9133 | 603 | 88.45 | glotblastn |
| LAB755_H15 | oat\|11v1\|GO589959_P1 | 4769 | 9134 | 603 | 86.8 | globlastp |
| LAB755_H16 | leymus\|gb166\|EG375676_P1 | 4770 | 9135 | 603 | 85.8 | globlastp |
| LAB755_H17 | rye\|12v1\|BE705438 | 4771 | 9136 | 603 | 85.5 | globlastp |
| LAB755_H18 | rye\|12v1\|DRR001013.103314 | 4772 | 9137 | 603 | 85.2 | glotblastn |
| LAB755_H22 | barley\|12v1\|BG418473_P1 | 4773 | 9138 | 603 | 82.1 | globlastp |
| LAB755_H11 | barley\|12v1\|BF259611_P1 | 4774 | 9139 | 603 | 82 | globlastp |
| LAB756_H1 | maize\|10v1\|BE509971_P1 | 4775 | 9140 | 604 | 95.2 | globlastp |
| LAB756_H2 | foxtail_millet\|11v3\|P1HY7SI029403M_P1 | 4776 | 9141 | 604 | 92.7 | globlastp |
| LAB756_H9 | wheat\|12v3\|CA698703_P1 | 4777 | 9142 | 604 | 86.2 | globlastp |
| LAB756_H10 | wheat\|12v3\|BE500675_P1 | 4778 | 9143 | 604 | 86 | globlastp |
| LAB756_H4 | wheat\|10v2\|BE500675 | 4779 | 9144 | 604 | 85.6 | globlastp |
| LAB756_H4 | wheat\|12v3\|BF482273_P1 | 4780 | 9144 | 604 | 85.6 | globlastp |
| LAB756_H5 | barley\|10v2\|BF625584 | 4781 | 9145 | 604 | 85.5 | globlastp |
| LAB756_H5 | barley\|12v1\|BF625584_P1 | 4782 | 9145 | 604 | 85.5 | globlastp |
| LAB756_H6 | rye\|12v1\|BE637164 | 4783 | 9146 | 604 | 84.9 | globlastp |
| LAB756_H7 | brachypodium\|12v1\|BRADI2G36950_P1 | 4784 | 9147 | 604 | 84.6 | globlastp |
| LAB756_H11 | switchgrass\|12v1\|FE611271_T1 | 4785 | 9148 | 604 | 82.16 | glotblastn |
| LAB756_H8 | oat\|11v1\|GR314603_T1 | 4786 | 9149 | 604 | 82.01 | glotblastn |
| LAB757_H1 | maize\|10v1\|BU098544_P1 | 4787 | 9150 | 605 | 92.1 | globlastp |
| LAB757_H4 | brachypodium\|12v1\|BRADI4G33500_P1 | 4788 | 9151 | 605 | 83 | globlastp |
| LAB758_H1 | maize\|10v1\|AI943758_P1 | 4789 | 9152 | 606 | 88.3 | globlastp |
| LAB758_H2 | sorghum\|12v1\|SB01G022280 | 4790 | 9153 | 606 | 84.8 | globlastp |
| LAB758_H3 | maize\|10v1\|AI586577_P1 | 4791 | 9154 | 606 | 83.3 | globlastp |
| LAB758_H4 | switchgrass\|gb167\|FE611481 | 4792 | 9155 | 606 | 82.3 | globlastp |
| LAB759_H1 | sugarcane\|10v1\|CF569861 | 4793 | 9156 | 607 | 99.2 | globlastp |
| LAB759_H2 | maize\|10v1\|BG840584_P1 | 4794 | 9157 | 607 | 96.2 | globlastp |
| LAB759_H6 | switchgrass\|12v1\|FL762763_P1 | 4795 | 9158 | 607 | 94.7 | globlastp |
| LAB759_H3 | foxtail_millet\|11v3\|PHY7SI031493M_P1 | 4796 | 9159 | 607 | 94.7 | globlastp |
| LAB759_H4 | millet\|10v1\|PMSLX0019079D1_P1 | 4797 | 9159 | 607 | 94.7 | globlastp |
| LAB759_H5 | switchgrass\|12v1\|FL788295_P1 | 4798 | 9158 | 607 | 94.7 | globlastp |
| LAB759_H5 | switchgrass\|gb167\|FL762763 | 4799 | 9158 | 607 | 94.7 | globlastp |
| LAB760_H1 | sugarcane\|10v1\|CA177853 | 4800 | 9160 | 608 | 94.3 | globlastp |
| LAB760_H2 | sugarcane\|10v1\|CA077053 | 4801 | 9161 | 608 | 93 | globlastp |
| LAB760_H8 | switchgrass\|12v1\|DN140645_P1 | 4802 | 9162 | 608 | 92.4 | globlastp |
| LAB760_H3 | switchgrass\|12v1\|DN143706_P1 | 4803 | 9163 | 608 | 92 | globlastp |
| LAB760_H3 | switchgrass\|gb167\|DN143706 | 4804 | 9163 | 608 | 92 | globlastp |
| LAB760_H4 | maize\|10v1\|ZMU17350_P1 | 4805 | 9164 | 608 | 91.9 | globlastp |
| LAB760_H5 | maize\|10v1\|ZMU17351_P1 | 4806 | 9165 | 608 | 91.9 | globlastp |
| LAB760_H6 | foxtail_millet\|11v3\|PHY7SI006473M_P1 | 4807 | 9166 | 608 | 91.5 | globlastp |
| LAB760_H7 | cenchrus\|gb166\|EB653187_P1 | 4808 | 9167 | 608 | 91.2 | globlastp |
| LAB760_H8 | switchgrass\|gb167\|DN140645 | 4809 | 9168 | 608 | 91 | globlastp |
| LAB760_H9 | sorghum\|12v1\|SB03G025520 | 4810 | 9169 | 608 | 90.8 | globlastp |
| LAB760_H10 | foxtail_millet\|11v3\|PHY7SI030346M_P1 | 4811 | 9170 | 608 | 88.4 | globlastp |
| LAB760_H11 | pseudoroegneria\|gb167\|FF350486 | 4812 | 9171 | 608 | 87.8 | globlastp |
| LAB760_H12 | fescue\|gb161\|DT679269_P1 | 4813 | 9172 | 608 | 87.1 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB760_H13 | oat\|11v1\|GR318697_P1 | 4814 | 9173 | 608 | 87.1 | globlastp |
| LAB760_H14 | oat\|11v1\|CN817771_P1 | 4815 | 9174 | 608 | 86.8 | globlastp |
| LAB760_H15 | oat\|11v1\|GR315717_P1 | 4816 | 9174 | 608 | 86.8 | globlastp |
| LAB760_H16 | oat\|11v1\|CN819042_P1 | 4817 | 9175 | 608 | 86.5 | globlastp |
| LAB760_H17 | brachypodium\|12v1\|BRADI1G25860_P1 | 4818 | 9176 | 608 | 86.3 | globlastp |
| LAB760_H18 | barley\|10v2\|BE413112 | 4819 | 9177 | 608 | 86.2 | globlastp |
| LAB760_H18 | barley\|12v1\|BE413112_P1 | 4820 | 9177 | 608 | 86.2 | globlastp |
| LAB760_H19 | leymus\|gb166\|CD808458_P1 | 4821 | 9178 | 608 | 86 | globlastp |
| LAB760_H20 | pseudoroegneria\|gb167\|FF340160 | 4822 | 9179 | 608 | 86 | globlastp |
| LAB760_H21 | rye\|12v1\|BE704669 | 4823 | 9180 | 608 | 86 | globlastp |
| LAB760_H22 | wheat\|10v2\|BE216960 | 4824 | 9181 | 608 | 86 | globlastp |
| LAB760_H22 | wheat\|12v3\|BE216960_P1 | 4825 | 9181 | 608 | 86 | globlastp |
| LAB760_H23 | rice\|11v1\|AA753367 | 4826 | 9182 | 608 | 85.8 | globlastp |
| LAB761_H1 | maize\|10v1\|AI901825_P1 | 4827 | 9183 | 609 | 95 | globlastp |
| LAB761_H2 | switchgrass\|12v1\|FL804327_P1 | 4828 | 9184 | 609 | 93.9 | globlastp |
| LAB761_H2 | switchgrass\|gb167\|FE620812 | 4829 | 9185 | 609 | 93.6 | globlastp |
| LAB761_H3 | sugarcane\|10v1\|CA073413 | 4830 | 9186 | 609 | 88.3 | globlastp |
| LAB761_H4 | rice\|11v1\|BI807111 | 4831 | 9187 | 609 | 86.9 | globlastp |
| LAB761_H5 | brachypodium\|12v1\|BRADI2G03370_P1 | 4832 | 9188 | 609 | 86.1 | globlastp |
| LAB761_H7 | wheat\|12v3\|BE637769_P1 | 4833 | 9189 | 609 | 83.8 | globlastp |
| LAB761_H6 | rye\|12v1\|DRR001012.319088 | 4834 | 9190 | 609 | 83.6 | globlastp |
| LAB761_H7 | wheat\|10v2\|BE637769 | 4835 | 9191 | 609 | 83.6 | globlastp |
| LAB761_H8 | rye\|12v1\|DRR001012.129842 | 4836 | 9192 | 609 | 83.3 | globlastp |
| LAB761_H9 | rye\|12v1\|DRR001012.202045 | 4837 | 9193 | 609 | 83.3 | globlastp |
| LAB761_H10 | rye\|12v1\|DRR001012.363435 | 4838 | 9194 | 609 | 83.29 | glotblastn |
| LAB761_H11 | rye\|12v1\|DRR001013.43321 | 4839 | 9195 | 609 | 80.94 | glotblastn |
| LAB761_H12 | foxtail_millet\|11v3\|PHY7SI002366M_P1 | 4840 | 9196 | 609 | 80.8 | globlastp |
| LAB761_H13 | switchgrass\|12v1\|FE600995_P1 | 4841 | 9197 | 609 | 80.2 | globlastp |
| LAB762_H1 | sugarcane\|10v1\|CA094266 | 4842 | 9198 | 610 | 98.6 | globlastp |
| LAB762_H2 | maize\|10v1\|AI901314_P1 | 4843 | 9199 | 610 | 94.9 | globlastp |
| LAB762_H3 | foxtail_millet\|11v3\|PHY7SI002044M_P1 | 4844 | 9200 | 610 | 93.2 | globlastp |
| LAB762_H10 | switchgrass\|12v1\|FL817879_P1 | 4845 | 9201 | 610 | 92.7 | globlastp |
| LAB762_H11 | switchgrass\|12v1\|FL851031_P1 | 4846 | 9202 | 610 | 92.7 | globlastp |
| LAB762_H4 | millet\|10v1\|EVO454PM045429_P1 | 4847 | 9203 | 610 | 92.4 | globlastp |
| LAB762_H5 | rice\|11v1\|AU058134 | 4848 | 9204 | 610 | 87.9 | globlastp |
| LAB762_H6 | brachypodium\|12v1\|BRADI2G42932_P1 | 4849 | 9205 | 610 | 85.6 | globlastp |
| LAB762_H7 | rye\|12v1\|DRR001012.137316 | 4850 | 9206 | 610 | 85.6 | globlastp |
| LAB762_H8 | barley\|10v2\|AJ485891 | 4851 | 9207 | 610 | 85 | globlastp |
| LAB762_H12 | wheat\|12v3\|BE402159_P1 | 4852 | 9208 | 610 | 84.7 | globlastp |
| LAB762_H9 | wheat\|10v2\|BE402159 | 4853 | 9209 | 610 | 84.7 | globlastp |
| LAB763_H1 | maize\|10v1\|BG349143_P1 | 4854 | 9210 | 611 | 97.1 | globlastp |
| LAB763_H2 | maize\|10v1\|CD998134_P1 | 4855 | 9211 | 611 | 95.4 | globlastp |
| LAB763_H8 | switchgrass\|12v1\|DN151198_P1 | 4856 | 9212 | 611 | 92.1 | globlastp |
| LAB763_H3 | foxtail_millet\|11v3\|PHY7SI002741M_P1 | 4857 | 9213 | 611 | 91.6 | globlastp |
| LAB763_H4 | millet\|10v1\|EVO454PM021669_P1 | 4858 | 9214 | 611 | 90.8 | globlastp |
| LAB763_H5 | rice\|11v1\|CB483512 | 4859 | 9215 | 611 | 90.8 | globlastp |
| LAB763_H6 | rice\|11v1\|BI796638 | 4860 | 9216 | 611 | 90 | globlastp |
| LAB763_H7 | switchgrass\|gb167\|FE605980 | 4861 | 9217 | 611 | 89.17 | glotblastn |
| LAB763_H7 | switchgrass\|12v1\|FE605980_T1 | 4862 | 9218 | 611 | 88.75 | glotblastn |
| LAB763_H8 | switchgrass\|gb167\|DN151198 | 4863 | 9219 | 611 | 88.7 | globlastp |
| LAB763_H9 | brachypodium\|12v1\|BRADI2G45690T2_P1 | 4864 | 9220 | 611 | 86.2 | globlastp |
| LAB763_H10 | leymus\|gb166\|EG374812_P1 | 4865 | 9221 | 611 | 85.4 | globlastp |
| LAB763_H11 | wheat\|10v2\|BE406566 | 4866 | 9222 | 611 | 84.9 | globlastp |
| LAB763_H11 | wheat\|12v3\|BE406566_P1 | 4867 | 9222 | 611 | 84.9 | globlastp |
| LAB763_H12 | rye\|12v1\|DRR001012.117963 | 4868 | 9223 | 611 | 84.5 | globlastp |
| LAB763_H13 | barley\|10v2\|BF621257 | 4869 | 9224 | 611 | 84.1 | globlastp |
| LAB763_H13 | barley\|12v1\|BF621257_P1 | 4870 | 9224 | 611 | 84.1 | globlastp |
| LAB763_H14 | oat\|11v1\|GO592659_P1 | 4871 | 9225 | 611 | 83.7 | globlastp |
| LAB764_H1 | maize\|10v1\|AI491605_P1 | 4872 | 9226 | 612 | 96.8 | globlastp |
| LAB764_H2 | foxtail_millet\|11v3\|PHY7SI001129M_P1 | 4873 | 9227 | 612 | 95.5 | globlastp |
| LAB764_H3 | millet\|10v1\|EVO454PM034717_P1 | 4874 | 9228 | 612 | 92.7 | globlastp |
| LAB764_H19 | switchgrass\|12v1\|FE622905_T1 | 4875 | 9229 | 612 | 91.78 | glotblastn |
| LAB764_H4 | rice\|11v1\|AA750113 | 4876 | 9230 | 612 | 90.7 | globlastp |
| LAB764_H5 | brachypodium\|12v1\|BRADI2G49460_P1 | 4877 | 9231 | 612 | 84.3 | globlastp |
| LAB764_H6 | millet\|10v1\|CD724502_P1 | 4878 | 9232 | 612 | 84 | globlastp |
| LAB764_H7 | foxtail_millet\|11v3\|PHY7SI021809M_P1 | 4879 | 9233 | 612 | 83.6 | globlastp |
| LAB764_H8 | maize\|10v1\|AI677105_P1 | 4880 | 9234 | 612 | 83.6 | globlastp |
| LAB764_H9 | sorghum\|12v1\|SB09G026080 | 4881 | 9235 | 612 | 83.6 | globlastp |
| LAB764_H20 | switchgrass\|12v1\|DN147696_P1 | 4882 | 9236 | 612 | 83.4 | globlastp |
| LAB764_H21 | switchgrass\|12v1\|FE652151_P1 | 4883 | 9237 | 612 | 83.2 | globlastp |
| LAB764_H10 | rye\|12v1\|DRR001012.107471 | 4884 | 9238 | 612 | 83.2 | globlastp |
| LAB764_H11 | barley\|10v2\|BF255578 | 4885 | 9239 | 612 | 83 | globlastp |
| LAB764_H11 | barley\|12v1\|BI950337_P1 | 4886 | 9239 | 612 | 83 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB764_H12 | leymus\|gb166\|EG375107_P1 | 4887 | 9240 | 612 | 83 | globlastp |
| LAB764_H13 | brachypodium\|12v1\|BRADI2G19390_P1 | 4888 | 9241 | 612 | 82.9 | globlastp |
| LAB764_H14 | maize\|10v1\|AI612416_P1 | 4889 | 9242 | 612 | 81.7 | globlastp |
| LAB764_H15 | rice\|11v1\|AA753037 | 4890 | 9243 | 612 | 81.6 | globlastp |
| LAB764_H16 | wheat\|10v2\|BE404250XX1 | 4891 | 9244 | 612 | 81.6 | globlastp |
| LAB764_H22 | switchgrass\|12v1\|FL699860_P1 | 4892 | 9245 | 612 | 81.4 | globlastp |
| LAB764_H16 | wheat\|12v3\|BE404250_T1 | 4893 | 9246 | 612 | 81.25 | glotblastn |
| LAB764_H17 | switchgrass\|gb167\|FE622905 | 4894 | 9247 | 612 | 81.2 | globlastp |
| LAB765_H1 | sugarcane\|10v1\|CA071302 | 4895 | 9248 | 613 | 98 | globlastp |
| LAB765_H2 | maize\|10v1\|AW066821_P1 | 4896 | 9249 | 613 | 95.2 | globlastp |
| LAB765_H4, LAB765_H5 | switchgrass\|12v1\|FE601807_P1 | 4897 | 9250 | 613 | 94 | globlastp |
| LAB765_H3 | foxtail_millet\|11v3\|PHY7SI001717M_P1 | 4898 | 9251 | 613 | 93.8 | globlastp |
| LAB765_H4 | switchgrass\|gb167\|FE601808 | 4899 | 9252 | 613 | 93.8 | globlastp |
| LAB765_H5 | switchgrass\|gb167\|FE601807 | 4900 | 9253 | 613 | 93 | globlastp |
| LAB765_H6 | millet\|10v1\|EVO454PM012248_P1 | 4901 | 9254 | 613 | 92.8 | globlastp |
| LAB765_H7 | rice\|11v1\|AF071063 | 4902 | 9255 | 613 | 90.5 | globlastp |
| LAB765_H8 | rice\|11v1\|CK043743 | 4903 | 9256 | 613 | 90 | glotblastn |
| LAB765_H9 | maize\|10v1\|AI714826_P1 | 4904 | 9257 | 613 | 89.9 | globlastp |
| LAB765_H20 | switchgrass\|12v1\|FE636720_P1 | 4905 | 9258 | 613 | 87.9 | globlastp |
| LAB765_H10 | brachypodium\|12v1\|BRADI2G50250_P1 | 4906 | 9259 | 613 | 85.5 | globlastp |
| LAB765_H11 | fescue\|gb161\|DT675095_P1 | 4907 | 9260 | 613 | 84.3 | globlastp |
| LAB765_H12 | leymus\|gb166\|EG375598_P1 | 4908 | 9261 | 613 | 83.2 | globlastp |
| LAB765_H13 | barley\|10v2\|BE422148 | 4909 | 9262 | 613 | 83 | globlastp |
| LAB765_H13 | barley\|12v1\|BE422148_P1 | 4910 | 9263 | 613 | 82.8 | globlastp |
| LAB765_H14 | wheat\|10v2\|BE415693 | 4911 | 9264 | 613 | 82.8 | globlastp |
| LAB765_H14, LAB765_H17 | wheat\|12v3\|BE415693_P1 | 4912 | 9264 | 613 | 82.8 | globlastp |
| LAB765_H15 | rye\|12v1\|BE495414 | 4913 | 9265 | 613 | 82.6 | globlastp |
| LAB765_H16 | rye\|12v1\|BE704883 | 4914 | 9266 | 613 | 81.8 | globlastp |
| LAB765_H17 | wheat\|10v2\|BE489787 | 4915 | 9267 | 613 | 81.8 | globlastp |
| LAB765_H18 | rye\|12v1\|DRR001012.200584 | 4916 | 9268 | 613 | 81.75 | glotblastn |
| LAB765_H19 | rye\|12v1\|DRR001012.264867 | 4917 | 9269 | 613 | 81.5 | globlastp |
| LAB767_H1 | maize\|10v1\|AW331209_P1 | 4918 | 9270 | 614 | 89.9 | globlastp |
| LAB767_H2 | foxtail_millet\|11v3\|PHY7SI002131M_P1 | 4919 | 9271 | 614 | 89.1 | globlastp |
| LAB767_H3 | switchgrass\|12v1\|FL851255_P1 | 4920 | 9272 | 614 | 87.5 | globlastp |
| LAB769_H1 | maize\|10v1\|CO522797_P1 | 4921 | 9273 | 616 | 92.3 | globlastp |
| LAB769_H2 | foxtail_millet\|11v3\|PHY7SI002070M_P1 | 4922 | 9274 | 616 | 91.2 | globlastp |
| LAB769_H3 | switchgrass\|12v1\|DN148033_P1 | 4923 | 9275 | 616 | 89.5 | globlastp |
| LAB637 | barley\|12v1\|BG299942_P1 | 4924 | 496 | 617 | 89.4 | globlastp |
| LAB770_H8 | sorghum\|12v1\|SB12V2PRD019448_P1 | 4925 | 9276 | 617 | 84.6 | globlastp |
| LAB770_H9 | switchgrass\|12v1\|PV12v1PRD049054_P1 | 4926 | 9277 | 617 | 81.4 | globlastp |
| LAB771_H1 | sugarcane\|10v1\|CA081882 | 4927 | 9278 | 618 | 93.6 | globlastp |
| LAB771_H2 | maize\|10v1\|AI941802_P1 | 4928 | 9279 | 618 | 87.4 | globlastp |
| LAB771_H3 | switchgrass\|12v1\|FL692950_P1 | 4929 | 9280 | 618 | 80.1 | globlastp |
| LAB772_H1 | maize\|10v1\|BE519282_P1 | 4930 | 9281 | 619 | 85.2 | globlastp |
| LAB772_H2 | foxtail_millet\|11v3\|PHY7SI030470M_P1 | 4931 | 9282 | 619 | 81.3 | globlastp |
| LAB772_H3 | switchgrass\|12v1\|FL754977_P1 | 4932 | 9283 | 619 | 80.7 | globlastp |
| LAB772_H4 | switchgrass\|12v1\|FL709979_P1 | 4933 | 9284 | 619 | 80.4 | globlastp |
| LAB774_H1 | sugarcane\|10v1\|CA110976 | 4934 | 9285 | 621 | 85.9 | globlastp |
| LAB774_H2 | maize\|10v1\|BG360671_P1 | 4935 | 9286 | 621 | 84.2 | globlastp |
| LAB774_H3 | maize\|10v1\|AW433466_P1 | 4936 | 9287 | 621 | 82.6 | globlastp |
| LAB774_H4 | foxtail_millet\|11v3\|PHY7SI026915M_P1 | 4937 | 9288 | 621 | 82 | globlastp |
| LAB774_H5 | cenchrus\|gb166\|EB657496_P1 | 4938 | 9289 | 621 | 80.1 | globlastp |
| LAB776_H1 | maize\|10v1\|AI820267_T1 | 4939 | 9290 | 623 | 97.4 | glotblastn |
| LAB776_H2 | maize\|10v1\|AI964431_P1 | 4940 | 9291 | 623 | 96.8 | globlastp |
| LAB776_H8 | switchgrass\|12v1\|FL735004_P1 | 4941 | 9292 | 623 | 90.3 | globlastp |
| LAB776_H3 | switchgrass\|gb167\|FE607266 | 4942 | 9293 | 623 | 90.3 | globlastp |
| LAB776_H4 | foxtail_millet\|11v3\|PHY7SI011233M_P1 | 4943 | 9294 | 623 | 89 | globlastp |
| LAB776_H3 | switchgrass\|12v1\|FE607266_P1 | 4944 | 9295 | 623 | 88.3 | globlastp |
| LAB776_H5 | millet\|10v1\|EVO454PM100662_P1 | 4945 | 9296 | 623 | 88.3 | globlastp |
| LAB776_H6 | cynodon\|10v1\|ES306077_T1 | 4946 | 9297 | 623 | 83.44 | glotblastn |
| LAB776_H7 | sugarcane\|10v1\|CF572448 | 4947 | 9298 | 623 | 83.12 | glotblastn |
| LAB777_H1 | sugarcane\|10v1\|CA073655 | 4948 | 9299 | 624 | 97.9 | globlastp |
| LAB777_H2 | cenchrus\|gb166\|EB652913_P1 | 4949 | 9300 | 624 | 95 | globlastp |
| LAB777_H3 | sugarcane\|10v1\|BQ529871 | 4950 | 9301 | 624 | 95 | globlastp |
| LAB777_H4 | switchgrass\|12v1\|DN150112_P1 | 4951 | 9302 | 624 | 95 | globlastp |
| LAB777_H4 | switchgrass\|gb167\|FL738222 | 4952 | 9302 | 624 | 95 | globlastp |
| LAB777_H5 | foxtail_millet\|11v3\|PHY7SI007467M_P1 | 4953 | 9303 | 624 | 94.3 | globlastp |
| LAB777_H6 | millet\|10v1\|EVO454PM482204_P1 | 4954 | 9304 | 624 | 92.9 | globlastp |
| LAB777_H7 | switchgrass\|gb167\|DN150112 | 4955 | 9305 | 624 | 92.9 | globlastp |
| LAB777_H8 | maize\|10v1\|BE224777_P1 | 4956 | 9306 | 624 | 90.8 | globlastp |
| LAB777_H9 | maize\|10v1\|BE512607_P1 | 4957 | 9306 | 624 | 90.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB777_H10 | rice\|11v1\|OSU19030 | 4958 | 9307 | 624 | 90.8 | globlastp |
| LAB777_H11 | lolium\|10v1\|AU248896_P1 | 4959 | 9308 | 624 | 81.6 | globlastp |
| LAB778_H1 | sugarcane\|10v1\|CA067949 | 4960 | 9309 | 625 | 99.2 | globlastp |
| LAB778_H2 | foxtail_millet\|11v3\|PHY7SI010401M_P1 | 4961 | 9310 | 625 | 98.9 | globlastp |
| LAB778_H3 | maize\|10v1\|AW067269_P1 | 4962 | 9311 | 625 | 98.9 | globlastp |
| LAB778_H5 | switchgrass\|12v1\|FE615622_P1 | 4963 | 9312 | 625 | 98.6 | globlastp |
| LAB778_H4 | maize\|10v1\|AI622258_P1 | 4964 | 9313 | 625 | 98.4 | globlastp |
| LAB778_H5 | switchgrass\|gb167\|FE615622 | 4965 | 9314 | 625 | 98.4 | globlastp |
| LAB778_H6 | cynodon\|10v1\|ES294272_T1 | 4966 | 9315 | 625 | 97.83 | glotblastn |
| LAB778_H7 | rice\|11v1\|BM421296 | 4967 | 9316 | 625 | 96.7 | globlastp |
| LAB778_H8 | brachypodium\|12v1\|BRADI5G12000_P1 | 4968 | 9317 | 625 | 96.2 | globlastp |
| LAB778_H146 | wheat\|12v3\|BM135910_P1 | 4969 | 9318 | 625 | 95.4 | globlastp |
| LAB778_H9 | pseudoroegneria\|gb167\|FF347577 | 4970 | 9319 | 625 | 95.4 | globlastp |
| LAB778_H10 | rye\|12v1\|DRR001012.144060 | 4971 | 9318 | 625 | 95.4 | globlastp |
| LAB778_H11 | wheat\|10v2\|BF293546 | 4972 | 9318 | 625 | 95.4 | globlastp |
| LAB778_H12 | barley\|10v2\|BF623086 | 4973 | 9320 | 625 | 95.1 | globlastp |
| LAB778_H11 | wheat\|12v3\|CD925906_P1 | 4974 | 9321 | 625 | 94.9 | globlastp |
| LAB778_H147 | banana\|12v1\|MAGEN2012010475_P1 | 4975 | 9322 | 625 | 88.6 | globlastp |
| LAB778_H148 | aquilegia\|10v2\|DR925484_P1 | 4976 | 9323 | 625 | 87.6 | globlastp |
| LAB778_H13 | aquilegia\|10v1\|DR925484 | 4977 | 9323 | 625 | 87.6 | globlastp |
| LAB778_H14 | oil_palm\|11v1\|ES414401_P1 | 4978 | 9324 | 625 | 87.5 | globlastp |
| LAB778_H15 | grape\|11v1\|GSVIVT01004859001_P1 | 4979 | 9325 | 625 | 87.1 | globlastp |
| LAB778_H16 | oil_palm\|11v1\|SRR190698.11166_P1 | 4980 | 9326 | 625 | 87 | globlastp |
| LAB778_H17 | cassava\|09v1\|CK644949_P1 | 4981 | 9327 | 625 | 86.8 | globlastp |
| LAB778_H18 | castorbean\|12v1\|EG657108_P1 | 4982 | 9328 | 625 | 86.8 | globlastp |
| LAB778_H19 | amborella\|12v3\|FD439662_P1 | 4983 | 9329 | 625 | 86.5 | globlastp |
| LAB778_H20 | papaya\|gb165\|EX253111_P1 | 4984 | 9330 | 625 | 86.4 | globlastp |
| LAB778_H21 | gossypium_raimondii\|12v1\|DT557358_P1 | 4985 | 9331 | 625 | 86.3 | globlastp |
| LAB778_H22 | chelidonium\|11v1\|SRR084752X110977_T1 | 4986 | 9332 | 625 | 86.29 | glotblastn |
| LAB778_H23 | apple\|11v1\|DT042056_P1 | 4987 | 9333 | 625 | 86 | globlastp |
| LAB778_H24 | clementine\|11v1\|CX069420_P1 | 4988 | 9334 | 625 | 86 | globlastp |
| LAB778_H25 | cotton\|11v1\|CO094851_P1 | 4989 | 9335 | 625 | 86 | globlastp |
| LAB778_H26 | orange\|11v1\|CX069420_P1 | 4990 | 9334 | 625 | 86 | globlastp |
| LAB778_H27 | pigeonpea\|11v1\|SRR054580X203000_P1 | 4991 | 9336 | 625 | 86 | globlastp |
| LAB778_H28 | soybean\|11v1\|GLYMA18G02020 | 4992 | 9337 | 625 | 86 | globlastp |
| LAB778_H28 | soybean\|12v1\|GLYMA18G02020_P1 | 4993 | 9337 | 625 | 86 | globlastp |
| LAB778_H29 | cacao\|10v1\|EH057818_P1 | 4994 | 9338 | 625 | 85.9 | globlastp |
| LAB778_H30 | oil_palm\|11v1\|SRR190698.204428_P1 | 4995 | 9339 | 625 | 85.9 | globlastp |
| LAB778_H31 | thellungiella_halophilum\|11v1\|EHJGI11028729 | 4996 | 9340 | 625 | 85.9 | globlastp |
| LAB778_H149 | prunus_mume\|13v1\|CV049924_P1 | 4997 | 9341 | 625 | 85.7 | globlastp |
| LAB778_H32 | apple\|11v1\|CN928566_P1 | 4998 | 9342 | 625 | 85.7 | globlastp |
| LAB778_H33 | cotton\|11v1\|DT557358_P1 | 4999 | 9343 | 625 | 85.7 | globlastp |
| LAB778_H34 | prunus\|10v1\|CN928566 | 5000 | 9344 | 625 | 85.7 | globlastp |
| LAB778_H35 | soybean\|11v1\|GLYMA05G31170 | 5001 | 9345 | 625 | 85.7 | globlastp |
| LAB778_H35 | soybean\|12v1\|GLYMA05G31170_P1 | 5002 | 9345 | 625 | 85.7 | globlastp |
| LAB778_H36 | soybean\|11v1\|GLYMA11G38090 | 5003 | 9346 | 625 | 85.7 | globlastp |
| LAB778_H36 | soybean\|12v1\|GLYMA11G38090_P1 | 5004 | 9346 | 625 | 85.7 | globlastp |
| LAB778_H37 | amsonia\|11v1\|SRR098688X102716_T1 | 5005 | 9347 | 625 | 85.64 | glotblastn |
| LAB778_H150 | banana\|12v1\|MAGEN2012024778_P1 | 5006 | 9348 | 625 | 85.6 | globlastp |
| LAB778_H38 | potato\|10v1\|BG592780_P1 | 5007 | 9349 | 625 | 85.6 | globlastp |
| LAB778_H39 | solanum_phureja\|09v1\|SPHBG629261 | 5008 | 9349 | 625 | 85.6 | globlastp |
| LAB778_H40 | cotton\|11v1\|DW485628_P1 | 5009 | 9350 | 625 | 85.4 | globlastp |
| LAB778_H41 | gossypium_raimondii\|12v1\|DR453115_P1 | 5010 | 9350 | 625 | 85.4 | globlastp |
| LAB778_H42 | lotus\|09v1\|GO031508_P1 | 5011 | 9351 | 625 | 85.4 | globlastp |
| LAB778_H43 | soybean\|11v1\|GLYMA08G14360 | 5012 | 9352 | 625 | 85.4 | globlastp |
| LAB778_H43 | soybean\|12v1\|GLYMA08G14360_P1 | 5013 | 9352 | 625 | 85.4 | globlastp |
| LAB778_H44 | strawberry\|11v1\|SRR034865S0053110 | 5014 | 9353 | 625 | 85.4 | globlastp |
| LAB778_H45 | chestnut\|gb170\|SRR006295S0011045_P1 | 5015 | 9354 | 625 | 85.2 | globlastp |
| LAB778_H46 | euphorbia\|11v1\|DV153284XX1_P1 | 5016 | 9355 | 625 | 85.2 | globlastp |
| LAB778_H47 | oak\|10v1\|DB997278_P1 | 5017 | 9356 | 625 | 85.2 | globlastp |
| LAB778_H48 | poplar\|10v1\|BI130238 | 5018 | 9357 | 625 | 85.2 | globlastp |
| LAB778_H48 | poplar\|13v1\|BI130238_P1 | 5019 | 9357 | 625 | 85.2 | globlastp |
| LAB778_H49 | solanum_phureja\|09v1\|SPHBG097630 | 5020 | 9358 | 625 | 85.2 | globlastp |
| LAB778_H50 | trigonella\|11v1\|SRR066194X205048 | 5021 | 9359 | 625 | 85.2 | globlastp |
| LAB778_H51 | watermelon\|11v1\|AM724931 | 5022 | 9360 | 625 | 85.2 | globlastp |
| LAB778_H57 | cowpea\|12v1\|FF393869_P1 | 5023 | 9361 | 625 | 85.2 | globlastp |
| LAB778_H52 | cotton\|11v1\|DR452607_P1 | 5024 | 9362 | 625 | 85.1 | globlastp |
| LAB778_H53 | gossypium_raimondii\|12v1\|DR452607_P1 | 5025 | 9363 | 625 | 85.1 | globlastp |
| LAB778_H54 | ambrosia\|11v1\|SRR346935.123282_P1 | 5026 | 9364 | 625 | 84.9 | globlastp |
| LAB778_H55 | ambrosia\|11v1\|SRR346935.208678_P1 | 5027 | 9365 | 625 | 84.9 | globlastp |
| LAB778_H56 | arabidopsis\|10v1\|AT2G22310_P1 | 5028 | 9366 | 625 | 84.9 | globlastp |
| LAB778_H57 | cowpea\|gb166\|FF393869 | 5029 | 9367 | 625 | 84.9 | globlastp |
| LAB778_H58 | peanut\|10v1\|CD037908_P1 | 5030 | 9368 | 625 | 84.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB778_H59 | pigeonpea\|11v1\|SRR054580X102551_P1 | 5031 | 9369 | 625 | 84.9 | globlastp |
| LAB778_H60 | poplar\|10v1\|BU890899 | 5032 | 9370 | 625 | 84.9 | globlastp |
| LAB778_H60 | poplar\|13v1\|BU890899_P1 | 5033 | 9370 | 625 | 84.9 | globlastp |
| LAB778_H151 | nicotiana_benthamiana\|12v1\|BP749169_P1 | 5034 | 9371 | 625 | 84.8 | globlastp |
| LAB778_H152 | bean\|12v2\|FG231136_P1 | 5035 | 9372 | 625 | 84.6 | globlastp |
| LAB778_H61 | bean\|12v1\|FG231136 | 5036 | 9372 | 625 | 84.6 | globlastp |
| LAB778_H62 | cannabis\|12v1\|JK494861_P1 | 5037 | 9373 | 625 | 84.6 | globlastp |
| LAB778_H63 | cirsium\|11v1\|SRR346952.1045820XX1_P1 | 5038 | 9374 | 625 | 84.6 | globlastp |
| LAB778_H64 | cucumber\|09v1\|DV631552_P1 | 5039 | 9375 | 625 | 84.6 | globlastp |
| LAB778_H65 | sunflower\|12v1\|BQ966718 | 5040 | 9376 | 625 | 84.6 | globlastp |
| LAB778_H66 | sunflower\|12v1\|EE617132 | 5041 | 9377 | 625 | 84.6 | globlastp |
| LAB778_H67 | ambrosia\|11v1\|SRR346935.244240_T1 | 5042 | 9378 | 625 | 84.55 | glotblastn |
| LAB778_H153 | nicotiana_benthamiana\|12v1\|EH624032_P1 | 5043 | 9379 | 625 | 84.4 | globlastp |
| LAB778_H68 | chickpea\|11v1\|GR408350 | 5044 | 9380 | 625 | 84.4 | globlastp |
| LAB778_H69 | cirsium\|11v1\|SRR346952.1000105_P1 | 5045 | 9381 | 625 | 84.4 | globlastp |
| LAB778_H70 | tomato\|11v1\|BG097630 | 5046 | 9382 | 625 | 84.4 | globlastp |
| LAB778_H71 | tomato\|11v1\|BG629261 | 5047 | 9383 | 625 | 84.3 | globlastp |
| LAB778_H154 | blueberry\|12v1\|SRR353282X35736D1_T1 | 5048 | 9384 | 625 | 84.28 | glotblastn |
| LAB778_H72 | ambrosia\|11v1\|SRR346935.191390_T1 | 5049 | 9385 | 625 | 84.28 | glotblastn |
| LAB778_H73 | ambrosia\|11v1\|SRR346935.212665_T1 | 5050 | 9386 | 625 | 84.28 | glotblastn |
| LAB778_H74 | flaveria\|11v1\|SRR149229.219118_T1 | 5051 | 9387 | 625 | 84.28 | glotblastn |
| LAB778_H75 | cirsium\|11v1\|SRR346952.1003793_P1 | 5052 | 9388 | 625 | 84.1 | globlastp |
| LAB778_H76 | flaveria\|11v1\|SRR149229.10679_P1 | 5053 | 9389 | 625 | 84.1 | globlastp |
| LAB778_H77 | thellungiella_parvulum\|11v1\|DN774189 | 5054 | 9390 | 625 | 84.1 | globlastp |
| LAB778_H78 | ambrosia\|11v1\|SRR346943.111704_T1 | 5055 | 9391 | 625 | 84.01 | glotblastn |
| LAB778_H79 | humulus\|11v1\|SRR098683X71787_P1 | 5056 | 9392 | 625 | 84 | globlastp |
| LAB778_H80 | canola\|11v1\|EE440813_P1 | 5057 | 9393 | 625 | 83.9 | globlastp |
| LAB778_H81 | centaurea\|gb166\|EH713812_P1 | 5058 | 9394 | 625 | 83.8 | globlastp |
| LAB778_H82 | oil_palm\|11v1\|EY412217_P1 | 5059 | 9395 | 625 | 83.7 | globlastp |
| LAB778_H155 | bean\|12v2\|EC911834_P1 | 5060 | 9396 | 625 | 83.6 | globlastp |
| LAB778_H156 | lettuce\|12v1\|DW109814_P1 | 5061 | 9397 | 625 | 83.6 | globlastp |
| LAB778_H83 | arabidopsis_lyrata\|09v1\|JGIAL024106_P1 | 5062 | 9398 | 625 | 83.6 | globlastp |
| LAB778_H84 | arabidopsis\|10v1\|AT4G39910_P1 | 5063 | 9399 | 625 | 83.6 | globlastp |
| LAB778_H86 | thellungiella_halophilum\|11v1\|DN774189 | 5064 | 9400 | 625 | 83.6 | globlastp |
| LAB778_H87 | cirsium\|11v1\|SRR346952.106910_T1 | 5065 | 9401 | 625 | 83.56 | glotblastn |
| LAB778_H157 | zostera\|12v1\|SRR057351X104064D1_T1 | 5066 | 9402 | 625 | 83.33 | glotblastn |
| LAB778_H88 | artemisia\|10v1\|EY048740_P1 | 5067 | 9403 | 625 | 83.3 | globlastp |
| LAB778_H89 | eucalyptus\|11v2\|CU396941_P1 | 5068 | 9404 | 625 | 83.3 | globlastp |
| LAB778_H90 | flaveria\|11v1\|SRR149229.120455_P1 | 5069 | 9405 | 625 | 83.3 | globlastp |
| LAB778_H91 | b_rapa\|11v1\|CB686216_P1 | 5070 | 9406 | 625 | 83.2 | globlastp |
| LAB778_H92 | canola\|11v1\|DY000736_P1 | 5071 | 9406 | 625 | 83.2 | globlastp |
| LAB778_H93 | canola\|11v1\|EG020175_P1 | 5072 | 9406 | 625 | 83.2 | globlastp |
| LAB778_H94 | flaveria\|11v1\|SRR149232.110533_T1 | 5073 | 9407 | 625 | 83.15 | glotblastn |
| LAB778_H95 | b_rapa\|11v1\|CD815757_P1 | 5074 | 9408 | 625 | 83.1 | globlastp |
| LAB778_H158 | sesame\|12v1\|BU668130_P1 | 5075 | 9409 | 625 | 83 | globlastp |
| LAB778_H96 | arnica\|11v1\|SRR099034X117913_P1 | 5076 | 9410 | 625 | 83 | globlastp |
| LAB778_H97 | oat\|11v1\|CN820234_P1 | 5077 | 9411 | 625 | 82.9 | globlastp |
| LAB778_H98 | silene\|11v1\|SRR096785X127418 | 5078 | 9412 | 625 | 82.88 | glotblastn |
| LAB778_H99 | lettuce\|10v1\|DW067326 | 5079 | 9413 | 625 | 82.8 | globlastp |
| LAB778_H100 | poppy\|11v1\|SRR030259.121484_P1 | 5080 | 9414 | 625 | 82.6 | globlastp |
| LAB778_H101 | triphysaria\|10v1\|DR171314 | 5081 | 9415 | 625 | 82.4 | globlastp |
| LAB778_H102 | radish\|gb1641\|EW725241 | 5082 | 9416 | 625 | 82.35 | glotblastn |
| LAB778_H103 | utricularia\|11v1\|SRR094438.103840 | 5083 | 9417 | 625 | 82.2 | globlastp |
| LAB778_H104 | brachypodium\|12v1\|BRADI1G71830_P1 | 5084 | 9418 | 625 | 82.1 | globlastp |
| LAB778_H105 | rice\|11v1\|BI813450 | 5085 | 9419 | 625 | 82.1 | globlastp |
| LAB778_H106 | maritime_pine\|10v1\|CT577183_P1 | 5086 | 9420 | 625 | 82 | globlastp |
| LAB778_H107 | lettuce\|10v1\|DW046238 | 5087 | 9421 | 625 | 81.8 | globlastp |
| LAB778_H108 | monkeyflower\|10v1\|GO987130 | 5088 | 9422 | 625 | 81.77 | glotblastn |
| LAB778_H108 | monkeyflower\|12v1\|SRR037227.103136_T1 | 5089 | 9423 | 625 | 81.77 | glotblastn |
| LAB778_H109 | pine\|10v2\|CF391012_P1 | 5090 | 9424 | 625 | 81.7 | globlastp |
| LAB778_H110 | spruce\|11v1\|ES877270 | 5091 | 9425 | 625 | 81.7 | globlastp |
| LAB778_H111 | b_rapa\|11v1\|SRR019556.17488_P1 | 5092 | 9426 | 625 | 81.6 | globlastp |
| LAB778_H112 | sugarcane\|10v1\|BQ478957 | 5093 | 9427 | 625 | 81.6 | globlastp |
| LAB778_H113 | oat\|11v1\|CN820191_T1 | 5094 | 9428 | 625 | 81.52 | glotblastn |
| LAB778_H114 | foxtail_millet\|11v3\|PHY7SI036284M_P1 | 5095 | 9429 | 625 | 81.5 | globlastp |
| LAB778_H115 | maize\|10v1\|AI783101_P1 | 5096 | 9430 | 625 | 81.5 | globlastp |
| LAB778_H116 | cassava\|09v1\|DV457465_P1 | 5097 | 9431 | 625 | 81.4 | globlastp |
| LAB778_H159 | banana\|12v1\|MAGEN2012004141_P1 | 5098 | 9432 | 625 | 81.3 | globlastp |
| LAB778_H117 | ceratodon\|10v1\|SRR074890S0131228_P1 | 5099 | 9433 | 625 | 81.3 | globlastp |
| LAB778_H118 | barley\|10v2\|AV832449 | 5100 | 9434 | 625 | 81.2 | globlastp |
| LAB778_H118 | barley\|12v1\|AV832449_P1 | 5101 | 9434 | 625 | 81.2 | globlastp |
| LAB778_H119 | physcomitrella\|10v1\|BJ173503_P1 | 5102 | 9435 | 625 | 81.2 | globlastp |
| LAB778_H120 | spruce\|11v1\|ES664529 | 5103 | 9436 | 625 | 81.2 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB778_H121 | cichorium\|gb171\|EH696895_T1 | 5104 | 9437 | 625 | 81.13 | glotblastn |
| LAB778_H160 | wheat\|12v3\|CA616068_P1 | 5105 | 9438 | 625 | 81 | globlastp |
| LAB778_H122 | physcomitrella\|10v1\|BJ159588_P1 | 5106 | 9439 | 625 | 81 | globlastp |
| LAB778_H123 | wheat\|10v2\|CA498148 | 5107 | 9440 | 625 | 81 | globlastp |
| LAB778_H123 | wheat\|12v3\|CA498148_P1 | 5108 | 9440 | 625 | 81 | globlastp |
| LAB778_H124 | brachypodium\|12v1\|BRADI3G46610_T1 | 5109 | 9441 | 625 | 80.98 | glotblastn |
| LAB778_H125 | millet\|10v1\|EVO454PM018250_T1 | 5110 | 9442 | 625 | 80.98 | glotblastn |
| LAB778_H126 | canola\|11v1\|ES979784_T1 | 5111 | 9443 | 625 | 80.91 | glotblastn |
| LAB778_H127 | pseudotsuga\|10v1\|SRR065119S0049871 | 5112 | 9444 | 625 | 80.9 | globlastp |
| LAB778_H128 | amorphophallus\|11v2\|SRR089351X312027XX1_T1 | 5113 | 9445 | 625 | 80.76 | glotblastn |
| LAB778_H129 | silene\|11v1\|SRR096785X148997 | 5114 | 9446 | 625 | 80.76 | glotblastn |
| LAB778_H130 | orobanche\|10v1\|SRR023189S0000975_T1 | 5115 | 9447 | 625 | 80.71 | glotblastn |
| LAB778_H131 | millet\|10v1\|EVO454PM018821_P1 | 5116 | 9448 | 625 | 80.7 | globlastp |
| LAB778_H132 | rye\|12v1\|BE494881 | 5117 | 9449 | 625 | 80.7 | globlastp |
| LAB778_H133 | switchgrass\|gb167\|FE601077 | 5118 | 9450 | 625 | 80.7 | globlastp |
| LAB778_H134 | pine\|10v2\|BX253084_P1 | 5119 | 9451 | 625 | 80.6 | globlastp |
| LAB778_H135 | pseudotsuga\|10v1\|SRR065119S0041451 | 5120 | 9452 | 625 | 80.6 | globlastp |
| LAB778_H136 | sorghum\|12v1\|SB01G044530 | 5121 | 9453 | 625 | 80.5 | globlastp |
| LAB778_H137 | radish\|gb164\|EX905823 | 5122 | 9454 | 625 | 80.43 | glotblastn |
| LAB778_H161 | wheat\|12v3\|CA604484_P1 | 5123 | 9455 | 625 | 80.4 | globlastp |
| LAB778_H138 | cephalotaxus\|11v1\|SRR064395X140948_T1 | 5124 | 9456 | 625 | 80.38 | glotblastn |
| LAB778_H139 | phyla\|11v2\|SRR099035X135649_P1 | 5125 | 9457 | 625 | 80.2 | globlastp |
| LAB778_H140 | valeriana\|11v1\|SRR099039X104838 | 5126 | 9458 | 625 | 80.2 | globlastp |
| LAB778_H141 | artemisia\|10v1\|SRR019254S0050962_T1 | 5127 | 9459 | 625 | 80.16 | glotblastn |
| LAB778_H142 | physcomitrella\|10v1\|BY946660_T1 | 5128 | 9460 | 625 | 80.16 | glotblastn |
| LAB778_H143 | abies\|11v2\|SRR098676X101886_P1 | 5129 | 9461 | 625 | 80.1 | globlastp |
| LAB778_H144 | vinca\|11v1\|SRR098690X139284 | 5130 | 9462 | 625 | 80.1 | globlastp |
| LAB778_H145 | triphysaria\|10v1\|BM356629 | 5131 | 9463 | 625 | 80 | globlastp |
| LAB779_H1 | maize\|10v1\|AI861392_P1 | 5132 | 9464 | 626 | 97.9 | globlastp |
| LAB779_H2 | switchgrass\|12v1\|FE621281_P1 | 5133 | 9465 | 626 | 96.1 | globlastp |
| LAB779_H2 | switchgrass\|gb167\|FE621280 | 5134 | 9466 | 626 | 96.1 | globlastp |
| LAB779_H3 | foxtail_millet\|11v3\|EC612909_P1 | 5135 | 9467 | 626 | 95.3 | globlastp |
| LAB779_H4 | rice\|11v1\|BE040494 | 5136 | 9468 | 626 | 93.8 | globlastp |
| LAB779_H5 | barley\|10v2\|BF257464 | 5137 | 9469 | 626 | 90.4 | globlastp |
| LAB779_H5 | barley\|12v1\|BF257464_P1 | 5138 | 9469 | 626 | 90.4 | globlastp |
| LAB779_H6 | brachypodium\|12v1\|BRADI5G12110_P1 | 5139 | 9470 | 626 | 90.2 | globlastp |
| LAB779_H7 | rye\|12v1\|DRR001012.173397 | 5140 | 9471 | 626 | 89.9 | globlastp |
| LAB779_H8 | wheat\|10v2\|BE404593 | 5141 | 9472 | 626 | 89.9 | globlastp |
| LAB779_H8 | wheat\|12v3\|BE404593_P1 | 5142 | 9472 | 626 | 89.9 | globlastp |
| LAB779_H9 | fescue\|gb161\|DT688231_P1 | 5143 | 9473 | 626 | 88.9 | globlastp |
| LAB779_H10 | aristolochia\|10v1\|FD760907_P1 | 5144 | 9474 | 626 | 83.4 | globlastp |
| LAB779_H11 | castorbean\|11v1\|XM_002513850 | 5145 | 9475 | 626 | 82.9 | globlastp |
| LAB779_H11 | castorbean\|12v1\|XM_002513850_P1 | 5146 | 9475 | 626 | 82.9 | globlastp |
| LAB779_H12 | poplar\|10v1\|BU826815 | 5147 | 9476 | 626 | 82.9 | globlastp |
| LAB779_H12 | poplar\|13v1\|BU826815_P1 | 5148 | 9477 | 626 | 82.6 | globlastp |
| LAB779_H13 | cacao\|10v1\|CF973691_P1 | 5149 | 9478 | 626 | 82.4 | globlastp |
| LAB779_H14 | nasturtium\|11v1\|GH169581_P1 | 5150 | 9479 | 626 | 82.4 | globlastp |
| LAB779_H15 | pigeonpea\|11v1\|GW348250_P1 | 5151 | 9480 | 626 | 82.4 | globlastp |
| LAB779_H16 | soybean\|11v1\|GLYMA14G34600 | 5152 | 9481 | 626 | 82.4 | globlastp |
| LAB779_H16 | soybean\|12v1\|GLYMA14G34600_P1 | 5153 | 9481 | 626 | 82.4 | globlastp |
| LAB779_H44 | bean\|12v2\|CA847635_P1 | 5154 | 9482 | 626 | 82.1 | globlastp |
| LAB779_H17 | bean\|12v1\|CA847635 | 5155 | 9482 | 626 | 82.1 | globlastp |
| LAB779_H18 | beech\|11v1\|SRR006293.25067_P1 | 5156 | 9483 | 626 | 82.1 | globlastp |
| LAB779_H19 | tabernaemontana\|11v1\|SRR098689X114013 | 5157 | 9484 | 626 | 82.1 | globlastp |
| LAB779_H45 | aquilegia\|10v2\|DR917100_P1 | 5158 | 9485 | 626 | 81.9 | globlastp |
| LAB779_H20 | aquilegia\|10v1\|DR917100 | 5159 | 9485 | 626 | 81.9 | globlastp |
| LAB779_H21 | cannabis\|12v1\|GR222042_P1 | 5160 | 9486 | 626 | 81.9 | globlastp |
| LAB779_H22 | grape\|11v1\|GSVIVT01009009001_P1 | 5161 | 9487 | 626 | 81.9 | globlastp |
| LAB779_H46 | prunus_mume\|13v1\|CB819829_P1 | 5162 | 9488 | 626 | 81.6 | globlastp |
| LAB779_H47 | switchgrass\|12v1\|FE621280_P1 | 5163 | 9489 | 626 | 81.6 | globlastp |
| LAB779_H23 | euonymus\|11v1\|SRR070038X15779_P1 | 5164 | 9490 | 626 | 81.3 | globlastp |
| LAB779_H24 | papaya\|gb165\|EX245984_P1 | 5165 | 9491 | 626 | 81.3 | globlastp |
| LAB779_H25 | prunus\|10v1\|CB819829 | 5166 | 9492 | 626 | 81.3 | globlastp |
| LAB779_H48 | banana\|12v1\|BBS173T3_P1 | 5167 | 9493 | 626 | 81.1 | globlastp |
| LAB779_H26 | apple\|11v1\|CN494364_P1 | 5168 | 9494 | 626 | 81.1 | globlastp |
| LAB779_H27 | cotton\|11v1\|AI728059_P1 | 5169 | 9495 | 626 | 81.1 | globlastp |
| LAB779_H28 | gossypium_raimondii\|12v1\|AI728059_P1 | 5170 | 9496 | 626 | 81.1 | globlastp |
| LAB779_H29 | humulus\|11v1\|GD248389_P1 | 5171 | 9497 | 626 | 81.1 | globlastp |
| LAB779_H30 | soybean\|11v1\|GLYMA13G01920 | 5172 | 9498 | 626 | 81.1 | globlastp |
| LAB779_H30 | soybean\|12v1\|GLYMA13G01920_P1 | 5173 | 9498 | 626 | 81.1 | globlastp |
| LAB779_H31 | amsonia\|11v1\|SRR098688X170183_T1 | 5174 | 9499 | 626 | 81.09 | glotblastn |
| LAB779_H32 | flax\|11v1\|EB711727_T1 | 5175 | 9500 | 626 | 81.09 | glotblastn |
| LAB779_H33 | strawberry\|11v1\|SRR034860S0006032 | 5176 | 9501 | 626 | 80.83 | glotblastn |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB779_H34 | cotton\|11v1\|CO085575_P1 | 5177 | 9502 | 626 | 80.8 | globlastp |
| LAB779_H35 | oak\|10v1\|DN950218_P1 | 5178 | 9503 | 626 | 80.8 | globlastp |
| LAB779_H36 | poplar\|10v1\|BU823969 | 5179 | 9504 | 626 | 80.8 | globlastp |
| LAB779_H36 | poplar\|13v1\|BU823969_P1 | 5180 | 9504 | 626 | 80.8 | globlastp |
| LAB779_H37 | peanut\|10v1\|ES719251_P1 | 5181 | 9505 | 626 | 80.6 | globlastp |
| LAB779_H38 | rhizophora\|10v1\|SRR005792S0003758 | 5182 | 9506 | 626 | 80.6 | globlastp |
| LAB779_H49 | amborella\|12v3\|FD439477_P1 | 5183 | 9507 | 626 | 80.3 | globlastp |
| LAB779_H50 | banana\|12v1\|FL665645_P1 | 5184 | 9508 | 626 | 80.3 | globlastp |
| LAB779_H51 | olea\|13v1\|SRR014463X48161D1_P1 | 5185 | 9509 | 626 | 80.3 | globlastp |
| LAB779_H39 | monkeyflower\|12v1\|DV207649_P1 | 5186 | 9510 | 626 | 80.3 | globlastp |
| LAB779_H43 | chickpea\|13v2\|GR399123_P1 | 5187 | 9511 | 626 | 80.3 | globlastp |
| LAB779_H40 | b_rapa\|11v1\|CX190909_P1 | 5188 | 9512 | 626 | 80.1 | globlastp |
| LAB779_H41 | orange\|11v1\|CF418185_P1 | 5189 | 9513 | 626 | 80.1 | globlastp |
| LAB779_H42 | rose\|12v1\|EC587962 | 5190 | 9514 | 626 | 80.1 | globlastp |
| LAB779_H43 | chickpea\|11v1\|GR399123 | 5191 | 9515 | 626 | 80.05 | glotblastn |
| LAB780_H1 | maize\|10v1\|AI600277_P1 | 5192 | 9516 | 627 | 87 | globlastp |
| LAB780_H3 | switchgrass\|12v1\|HO265040_P1 | 5193 | 9517 | 627 | 84.6 | globlastp |
| LAB780_H4 | switchgrass\|12v1\|FL887464_P1 | 5194 | 9518 | 627 | 83.7 | globlastp |
| LAB780_H2 | foxtail_millet\|11v3\|PHY7SI010679M_P1 | 5195 | 9519 | 627 | 83.4 | globlastp |
| LAB781_H1 | sugarcane\|10v1\|CA128240XX1 | 5196 | 9520 | 628 | 87.3 | globlastp |
| LAB781_H4 | switchgrass\|12v1\|SRR187765.495706_T1 | 5197 | 9521 | 628 | 80.95 | glotblastn |
| LAB781_H2 | maize\|10v1\|SRR014551S0377837_T1 | 5198 | 9522 | 628 | 80.95 | glotblastn |
| LAB781_H3 | switchgrass\|12v1\|FL777489_T1 | 5199 | 9523 | 628 | 80.95 | glotblastn |
| LAB781_H3 | switchgrass\|gb167\|FL777489 | 5200 | 9524 | 628 | 80.95 | glotblastn |
| LAB782_H1 | sugarcane\|10v1\|CA066605 | 5201 | 9525 | 629 | 94.1 | globlastp |
| LAB782_H2 | maize\|10v1\|BM078700_P1 | 5202 | 9526 | 629 | 88.5 | globlastp |
| LAB782_H3 | foxtail_millet\|11v3\|PHY7SI009956M_P1 | 5203 | 9527 | 629 | 86.4 | globlastp |
| LAB782_H4 | millet\|10v1\|EVO454PM012428_P1 | 5204 | 9528 | 629 | 83.4 | globlastp |
| LAB782_H5 | switchgrass\|gb167\|FE623288 | 5205 | 9529 | 629 | 81.79 | glotblastn |
| LAB783_H1 | foxtail_millet\|11v3\|PHY7SI010613M_P1 | 5206 | 9530 | 630 | 92.1 | globlastp |
| LAB783_H2 | maize\|10v1\|CD941129_P1 | 5207 | 9531 | 630 | 91.6 | globlastp |
| LAB783_H6 | switchgrass\|12v1\|SRR187770.838615_P1 | 5208 | 9532 | 630 | 87.2 | globlastp |
| LAB783_H7 | switchgrass\|12v1\|SRR187766.338407_P1 | 5209 | 9533 | 630 | 87.1 | globlastp |
| LAB783_H3 | wheat\|10v2\|BF484446 | 5210 | 9534 | 630 | 81.3 | globlastp |
| LAB783_H4 | rice\|11v1\|BI305734 | 5211 | 9535 | 630 | 80.5 | globlastp |
| LAB783_H5 | rice\|11v1\|AU031195 | 5212 | 9536 | 630 | 80.27 | glotblastn |
| LAB783_H8 | wheat\|12v3\|BQ901541_P1 | 5213 | 9537 | 630 | 80 | globlastp |
| LAB784_H1 | maize\|10v1\|CO442798_P1 | 5214 | 9538 | 631 | 90.9 | globlastp |
| LAB784_H2 | foxtail_millet\|11v3\|PHY7SI009889M_P1 | 5215 | 9539 | 631 | 88.6 | globlastp |
| LAB784_H3 | switchgrass\|12v1\|DN142888_P1 | 5216 | 9540 | 631 | 86.3 | globlastp |
| LAB784_H3 | switchgrass\|gb167\|DN142888 | 5217 | 9541 | 631 | 85.9 | globlastp |
| LAB784_H4 | switchgrass\|gb167\|DN142031 | 5218 | 9542 | 631 | 85.3 | globlastp |
| LAB784_H4 | switchgrass\|12v1\|DN142031_P1 | 5219 | 9543 | 631 | 85.1 | globlastp |
| LAB784_H11 | switchgrass\|12v1\|SRR187767.875872_P1 | 5220 | 9544 | 631 | 83.5 | globlastp |
| LAB784_H5 | foxtail_millet\|11v3\|PHY7SI012090M_P1 | 5221 | 9545 | 631 | 83.2 | globlastp |
| LAB784_H12 | wheat\|12v3\|BE497227_T1 | 5222 | 9546 | 631 | 82.91 | glotblastn |
| LAB784_H6 | maize\|10v1\|DT944637_P1 | 5223 | 9547 | 631 | 82.7 | globlastp |
| LAB784_H7 | rye\|12v1\|DRR001012.122081 | 5224 | 9548 | 631 | 82.7 | globlastp |
| LAB784_H13 | barley\|12v1\|BU972778_P1 | 5225 | 9549 | 631 | 82.4 | globlastp |
| LAB784_H8 | foxtail_millet\|11v3\|PHY7SI009893M_P1 | 5226 | 9550 | 631 | 82.1 | globlastp |
| LAB784_H9 | sorghum\|12v1\|SB06G025990 | 5227 | 9551 | 631 | 81.8 | globlastp |
| LAB784_H10 | brachypodium\|12v1\|BRADI5G18920_T1 | 5228 | 9552 | 631 | 81.29 | glotblastn |
| LAB785_H1 | maize\|10v1\|AI943649_P1 | 5229 | 9553 | 632 | 93.9 | globlastp |
| LAB785_H2 | maize\|10v1\|CO522204_P1 | 5230 | 9554 | 632 | 92.7 | globlastp |
| LAB785_H3 | foxtail_millet\|11v3\|PHY7SI009822M_P1 | 5231 | 9555 | 632 | 89.8 | globlastp |
| LAB785_H4 | switchgrass\|gb167\|DN145209 | 5232 | 9556 | 632 | 89.5 | globlastp |
| LAB785_H5 | maize\|10v1\|DT652662_T1 | 5233 | 9557 | 632 | 88.91 | glotblastn |
| LAB785_H6 | maize\|10v1\|AW447873_T1 | 5234 | 9558 | 632 | 88.34 | glotblastn |
| LAB785_H7 | rice\|11v1\|CA762994 | 5235 | 9559 | 632 | 87.5 | globlastp |
| LAB785_H9 | wheat\|12v3\|BE415088XX1_P1 | 5236 | 9560 | 632 | 86 | globlastp |
| LAB785_H10 | barley\|12v1\|BU996159_P1 | 5237 | 9561 | 632 | 85.5 | globlastp |
| LAB785_H8 | brachypodium\|12v1\|BRADI5G19170_P1 | 5238 | 9562 | 632 | 84.6 | globlastp |
| LAB786_H1 | maize\|10v1\|CD940584_P1 | 5239 | 9563 | 633 | 87.8 | globlastp |
| LAB787_H1 | maize\|10v1\|CO517647_P1 | 5240 | 9564 | 634 | 89 | globlastp |
| LAB787_H2 | switchgrass\|12v1\|FL887410_P1 | 5241 | 9565 | 634 | 85.8 | globlastp |
| LAB787_H3 | switchgrass\|12v1\|FL887409_P1 | 5242 | 9566 | 634 | 85.5 | globlastp |
| LAB787_H4 | foxtail_millet\|11v3\|PHY7SI014111M_P1 | 5243 | 9567 | 634 | 85 | globlastp |
| LAB787_H5 | fescue\|gb161\|DT679567_T1 | 5244 | 9568 | 634 | 80.19 | globlastp |
| LAB787_H6 | wheat\|12v3\|BQ904010_T1 | 5245 | 9569 | 634 | 80.19 | glotblastn |
| LAB787_H7 | brachypodium\|12v1\|BRADI3G38777_P1 | 5246 | 9570 | 634 | 80.1 | globlastp |
| LAB788_H1 | sorghum\|12v1\|SB12V2PRD017103 | 5247 | — | 635 | 98.4 | glotblastn |
| LAB788_H2 | sugarcane\|10v1\|CA260219 | 5248 | 9571 | 635 | 97.6 | globlastp |
| LAB788_H3 | millet\|10v1\|EVO454PM131384_P1 | 5249 | 9572 | 635 | 96.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB788_H4 | wheat\|10v2\|CA485481 | 5250 | 9573 | 635 | 96 | globlastp |
| LAB788_H5 | foxtail_millet\|11v3\|PHY7SI038047M_P1 | 5251 | 9574 | 635 | 94.4 | globlastp |
| LAB788_H6 | switchgrass\|gb167\|FL786981 | 5252 | 9575 | 635 | 94.4 | globlastp |
| LAB788_H7 | switchgrass\|gb167\|GD025782 | 5253 | 9576 | 635 | 93.5 | globlastp |
| LAB788_H6, LAB788_H7 | switchgrass\|12v1\|FE618625_P1 | 5254 | 9576 | 635 | 93.5 | globlastp |
| LAB788_H8 | maize\|10v1\|CD943276_P1 | 5255 | 9577 | 635 | 92.8 | globlastp |
| LAB788_H23 | switchgrass\|12v1\|SRR187766.237753_T1 | 5256 | 9578 | 635 | 92.74 | glotblastn |
| LAB788_H9 | maize\|10v1\|BG517888_P1 | 5257 | 9579 | 635 | 92.7 | globlastp |
| LAB788_H10 | maize\|10v1\|BG354557_P1 | 5258 | 9580 | 635 | 92 | globlastp |
| LAB788_H11 | maize\|10v1\|EU972756_P1 | 5259 | 9581 | 635 | 91.2 | globlastp |
| LAB788_H12 | cynodon\|10v1\|ES292289_P1 | 5260 | 9582 | 635 | 91.1 | globlastp |
| LAB788_H13 | sorghum\|12v1\|SB01G038765 | 5261 | 9583 | 635 | 90.32 | glotblastn |
| LAB788_H14 | wheat\|10v2\|AL825356 | 5262 | 9584 | 635 | 85.6 | globlastp |
| LAB788_H14 | wheat\|12v3\|AL825356_P1 | 5263 | 9584 | 635 | 85.6 | globlastp |
| LAB788_H15 | rice\|11v1\|CA761785 | 5264 | 9585 | 635 | 84.1 | globlastp |
| LAB788_H16 | wheat\|10v2\|CA485751 | 5265 | 9585 | 635 | 84.1 | globlastp |
| LAB788_H16 | wheat\|12v3\|CA485751_P1 | 5266 | 9585 | 635 | 84.1 | globlastp |
| LAB788_H17 | brachypodium\|12v1\|BRADI1G65850_P1 | 5267 | 9586 | 635 | 84 | globlastp |
| LAB788_H18 | rye\|12v1\|DRR001012.11660 | 5268 | 9587 | 635 | 84 | globlastp |
| LAB788_H19 | rye\|12v1\|DRR001012.217026 | 5269 | 9587 | 635 | 84 | globlastp |
| LAB788_H20 | barley\|10v2\|AV923028 | 5270 | 9588 | 635 | 83.2 | globlastp |
| LAB788_H21 | wheat\|10v2\|CA650666 | 5271 | 9589 | 635 | 83.2 | globlastp |
| LAB788_H22 | oat\|11v1\|GO598161_P1 | 5272 | 9590 | 635 | 82.4 | globlastp |
| LAB791_H1 | sugarcane\|10v1\|BQ529695 | 5273 | 9591 | 638 | 99.5 | globlastp |
| LAB791_H2 | maize\|10v1\|AI783079_P1 | 5274 | 9592 | 638 | 97.9 | globlastp |
| LAB791_H3 | foxtail_millet\|11v3\|PHY7SI023315M_P1 | 5275 | 9593 | 638 | 97.4 | globlastp |
| LAB791_H4 | sugarcane\|10v1\|CA081540 | 5276 | 9594 | 638 | 97.4 | globlastp |
| LAB791_H24 | switchgrass\|12v1\|DN143962_P1 | 5277 | 9595 | 638 | 96.9 | globlastp |
| LAB791_H5 | millet\|10v1\|EVO454PM005958_P1 | 5278 | 9596 | 638 | 96.9 | globlastp |
| LAB791_H6 | switchgrass\|gb167\|DN143962 | 5279 | 9595 | 638 | 96.9 | globlastp |
| LAB791_H7 | switchgrass\|12v1\|FE625453_P1 | 5280 | 9597 | 638 | 96.4 | globlastp |
| LAB791_H7 | switchgrass\|gb167\|FE625453 | 5281 | 9597 | 638 | 96.4 | globlastp |
| LAB791_H8 | maize\|10v1\|AW018263_P1 | 5282 | 9598 | 638 | 95.9 | globlastp |
| LAB791_H25 | wheat\|12v3\|BE445087_P1 | 5283 | 9599 | 638 | 93.9 | globlastp |
| LAB791_H9 | barley\|10v2\|BI950704 | 5284 | 9600 | 638 | 93.9 | globlastp |
| LAB791_H9 | barley\|12v1\|BI950704_P1 | 5285 | 9600 | 638 | 93.9 | globlastp |
| LAB791_H10 | brachypodium\|12v1\|BRADI4G06510_P1 | 5286 | 9601 | 638 | 93.9 | globlastp |
| LAB791_H11 | rice\|11v1\|AU102059 | 5287 | 9602 | 638 | 93.8 | globlastp |
| LAB791_H26 | wheat\|12v3\|BE442756_P1 | 5288 | 9603 | 638 | 93.4 | globlastp |
| LAB791_H27 | wheat\|12v3\|SRR400826X517916D1_P1 | 5289 | 9603 | 638 | 93.4 | globlastp |
| LAB791_H12 | pseudoroegneria\|gb167\|FF343861 | 5290 | 9604 | 638 | 93.4 | globlastp |
| LAB791_H13 | wheat\|10v2\|BE442756 | 5291 | 9603 | 638 | 93.4 | globlastp |
| LAB791_H13 | wheat\|12v3\|BE499038_P1 | 5292 | 9605 | 638 | 93.4 | globlastp |
| LAB791_H14 | rye\|12v1\|BF146081 | 5293 | 9606 | 638 | 92.3 | globlastp |
| LAB791_H15 | lovegrass\|gb167\|EH184524_P1 | 5294 | 9607 | 638 | 91.8 | globlastp |
| LAB791_H16 | fescue\|gb161\|DT702783_P1 | 5295 | 9608 | 638 | 90.8 | globlastp |
| LAB791_H17 | oat\|11v1\|CN814680_P1 | 5296 | 9609 | 638 | 90.8 | globlastp |
| LAB791_H18 | cynodon\|10v1\|BQ826443_P1 | 5297 | 9610 | 638 | 87.8 | globlastp |
| LAB791_H28 | banana\|12v1\|MAGEN2012016842_P1 | 5298 | 9611 | 638 | 83.1 | globlastp |
| LAB791_H29 | banana\|12v1\|FF559352_P1 | 5299 | 9612 | 638 | 82.6 | globlastp |
| LAB791_H30 | banana\|12v1\|MAGEN2012026839_P1 | 5300 | 9613 | 638 | 82.2 | globlastp |
| LAB791_H19 | phalaenopsis\|11v1\|SRR125771.1007715_T1 | 5301 | 9614 | 638 | 81.12 | glotblastn |
| LAB791_H20 | cacao\|10v1\|CU550744_T1 | 5302 | 9615 | 638 | 80.41 | glotblastn |
| LAB791_H21 | lotus\|09v1\|BW617043_T1 | 5303 | 9616 | 638 | 80.1 | glotblastn |
| LAB791_H22 | oil_palm\|11v1\|EL681923_T1 | 5304 | 9617 | 638 | 80.1 | glotblastn |
| LAB791_H23 | cowpea\|12v1\|FF384610_T1 | 5305 | 9618 | 638 | 80 | glotblastn |
| LAB791_H23 | cowpea\|gb166\|FF384610 | 5306 | 9618 | 638 | 80 | glotblastn |
| LAB792_H1 | sugarcane\|10v1\|CA096552 | 5307 | 9619 | 639 | 95.9 | globlastp |
| LAB792_H18 | switchgrass\|12v1\|FE600294_P1 | 5308 | 9620 | 639 | 92.8 | globlastp |
| LAB792_H2 | foxtail_millet\|11v3\|PHY7SI023310M_P1 | 5309 | 9621 | 639 | 92.8 | globlastp |
| LAB792_H3 | switchgrass\|gb167\|FE600294 | 5310 | 9620 | 639 | 92.8 | globlastp |
| LAB792_H4 | switchgrass\|12v1\|DN143401_P1 | 5311 | 9622 | 639 | 91.8 | globlastp |
| LAB792_H4 | switchgrass\|gb167\|DN143401 | 5312 | 9622 | 639 | 91.8 | globlastp |
| LAB792_H5 | millet\|10v1\|EVO454PM041650_P1 | 5313 | 9623 | 639 | 89.7 | globlastp |
| LAB792_H6 | cynodon\|10v1\|ES296132_P1 | 5314 | 9624 | 639 | 87.2 | globlastp |
| LAB792_H7 | lovegrass\|gb167\|EH184941_P1 | 5315 | 9625 | 639 | 84.6 | globlastp |
| LAB792_H8 | brachypodium\|12v1\|BRADI2G37770_P1 | 5316 | 9626 | 639 | 84.2 | globlastp |
| LAB792_H9 | fescue\|gb161\|DT680806_P1 | 5317 | 9627 | 639 | 83.1 | globlastp |
| LAB792_H10 | pseudoroegneria\|gb167\|FF346074 | 5318 | 9628 | 639 | 82.1 | globlastp |
| LAB792_H11 | barley\|10v2\|BI949166 | 5319 | 9629 | 639 | 81.6 | globlastp |
| LAB792_H11 | barley\|12v1\|BI949166_P1 | 5320 | 9629 | 639 | 81.6 | globlastp |
| LAB792_H12 | leymus\|gb166\|EG393802_P1 | 5321 | 9630 | 639 | 81.1 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB792_H19 | wheat\|12v3\|BE400950_P1 | 5322 | 9631 | 639 | 80.8 | globlastp |
| LAB792_H13 | rye\|12v1\|DRR001012.129875 | 5323 | 9632 | 639 | 80.7 | globlastp |
| LAB792_H14 | rye\|12v1\|DRR001012.219766 | 5324 | 9632 | 639 | 80.7 | globlastp |
| LAB792_H15 | oat\|11v1\|GR340758_P1 | 5325 | 9633 | 639 | 80.6 | globlastp |
| LAB792_H16 | rice\|11v1\|BI809637 | 5326 | 9634 | 639 | 80.5 | globlastp |
| LAB792_H17 | wheat\|10v2\|BE400950 | 5327 | 9635 | 639 | 80.3 | globlastp |
| LAB792_H17 | wheat\|12v3\|CA485207_P1 | 5328 | 9635 | 639 | 80.3 | globlastp |
| LAB793_H1 | sugarcane\|10v1\|CA083729 | 5329 | 9636 | 640 | 97.6 | globlastp |
| LAB793_H2 | maize\|10v1\|BG349275_P1 | 5330 | 9637 | 640 | 94.9 | globlastp |
| LAB793_H3 | foxtail_millet\|11v3\|PHY7SI022841M_P1 | 5331 | 9638 | 640 | 93.9 | globlastp |
| LAB793_H4 | millet\|10v1\|EVO454PM005949_P1 | 5332 | 9639 | 640 | 93.5 | globlastp |
| LAB793_H5 | switchgrass\|gb167\|FE629745 | 5333 | 9640 | 640 | 92.9 | globlastp |
| LAB793_H6 | switchgrass\|12v1\|FE623446_P1 | 5334 | 9641 | 640 | 91.2 | globlastp |
| LAB793_H6 | switchgrass\|gb167\|FE623446 | 5335 | 9641 | 640 | 91.2 | globlastp |
| LAB793_H7 | rice\|11v1\|BI811508 | 5336 | 9642 | 640 | 89.1 | globlastp |
| LAB793_H8 | brachypodium\|12v1\|BRADI2G37950_P1 | 5337 | 9643 | 640 | 86.7 | globlastp |
| LAB793_H16 | wheat\|12v3\|BE213352_P1 | 5338 | 9644 | 640 | 85.4 | globlastp |
| LAB793_H9 | wheat\|10v2\|BE470964 | 5339 | 9645 | 640 | 85.4 | globlastp |
| LAB793_H9 | wheat\|12v3\|BE470964_P1 | 5340 | 9645 | 640 | 85.4 | globlastp |
| LAB793_H10 | rye\|12v1\|DRR001012.126664 | 5341 | 9646 | 640 | 84.7 | globlastp |
| LAB793_H11 | rye\|12v1\|DRR001012.149681 | 5342 | 9646 | 640 | 84.7 | globlastp |
| LAB793_H12 | rye\|12v1\|DRR001012.169047 | 5343 | 9646 | 640 | 84.7 | globlastp |
| LAB793_H13 | pseudoroegneria\|gb167\|FF353233 | 5344 | 9647 | 640 | 84.4 | globlastp |
| LAB793_H14 | barley\|10v2\|BE420584XX1 | 5345 | 9648 | 640 | 84 | globlastp |
| LAB793_H14 | barley\|12v1\|BE420584_P1 | 5346 | 9648 | 640 | 84 | globlastp |
| LAB793_H15 | oat\|11v1\|GR344693_P1 | 5347 | 9649 | 640 | 81.3 | globlastp |
| LAB794_H1 | maize\|10v1\|AI372267_P1 | 5348 | 9650 | 641 | 87.7 | globlastp |
| LAB794_H2 | sorghum\|12v1\|SB09G004660 | 5349 | 9651 | 641 | 83 | globlastp |
| LAB794_H3 | maize\|10v1\|BG841443_P1 | 5350 | 9652 | 641 | 80.8 | globlastp |
| LAB795_H1 | maize\|10v1\|AI833936_P1 | 5351 | 9653 | 642 | 90.1 | globlastp |
| LAB795_H2 | foxtail_millet\|11v3\|PHY7SI021709M_P1 | 5352 | 9654 | 642 | 88.9 | globlastp |
| LAB795_H3 | maize\|10v1\|CB351667_P1 | 5353 | 9655 | 642 | 88.3 | globlastp |
| LAB795_H5 | switchgrass\|12v1\|FL750760_P1 | 5354 | 9656 | 642 | 87.8 | globlastp |
| LAB795_H4 | rice\|11v1\|AU085763 | 5355 | 9657 | 642 | 81.5 | globlastp |
| LAB795_H6 | barley\|12v1\|BI949478_P1 | 5356 | 9658 | 642 | 80.5 | globlastp |
| LAB796_H1 | maize\|10v1\|AI622188_P1 | 5357 | 9659 | 643 | 94.4 | globlastp |
| LAB796_H2 | foxtail_millet\|11v3\|PHY7SI022955M_P1 | 5358 | 9660 | 643 | 89.6 | globlastp |
| LAB796_H3 | switchgrass\|12v1\|FE644404_P1 | 5359 | 9661 | 643 | 89.6 | globlastp |
| LAB796_H3 | switchgrass\|gb167\|FE621433 | 5360 | 9662 | 643 | 88.4 | globlastp |
| LAB796_H12 | switchgrass\|12v1\|FE621433_P1 | 5361 | 9663 | 643 | 88.1 | globlastp |
| LAB796_H4 | brachypodium\|12v1\|BRADI2G23570_P1 | 5362 | 9664 | 643 | 83.2 | globlastp |
| LAB796_H5 | barley\|10v2\|BI949038 | 5363 | 9665 | 643 | 82.9 | globlastp |
| LAB796_H13 | wheat\|12v3\|BQ903448_P1 | 5364 | 9666 | 643 | 82.6 | globlastp |
| LAB796_H6 | leymus\|gb166\|EG399451_P1 | 5365 | 9667 | 643 | 82.5 | globlastp |
| LAB796_H8 | wheat\|12v3\|BF484746_P1 | 5366 | 9668 | 643 | 82.5 | globlastp |
| LAB796_H7 | rice\|11v1\|BE229824 | 5367 | 9669 | 643 | 82.2 | globlastp |
| LAB796_H8 | wheat\|10v2\|BF484746 | 5368 | 9670 | 643 | 82.2 | globlastp |
| LAB796_H9 | millet\|10v1\|EVO454PM037711_P1 | 5369 | 9671 | 643 | 81.7 | globlastp |
| LAB796_H11 | wheat\|12v3\|BQ806352_P1 | 5370 | 9672 | 643 | 81.5 | globlastp |
| LAB796_H10 | rye\|12v1\|BF146028 | 5371 | 9673 | 643 | 80.7 | globlastp |
| LAB796_H11 | wheat\|10v2\|BQ806352 | 5372 | 9674 | 643 | 80.37 | glotblastn |
| LAB797_H1 | maize\|10v1\|AW267570_P1 | 5373 | 9675 | 644 | 96.5 | globlastp |
| LAB797_H2 | foxtail_millet\|11v3\|PHY7SI005771M_P1 | 5374 | 9676 | 644 | 95 | globlastp |
| LAB797_H5 | switchgrass\|12v1\|FL761828_P1 | 5375 | 9677 | 644 | 94.5 | globlastp |
| LAB797_H3 | brachypodium\|12v1\|BRADI1G52230_P1 | 5376 | 9678 | 644 | 89.2 | globlastp |
| LAB797_H4 | rice\|11v1\|BM418583 | 5377 | 9679 | 644 | 88.51 | glotblastn |
| LAB797_H6 | rye\|12v1\|DRR001012.283982_P1 | 5378 | 9680 | 644 | 80.8 | globlastp |
| LAB797_H7 | eucalyptus\|11v2\|SRR001659X105674_P1 | 5379 | 9681 | 644 | 80.5 | globlastp |
| LAB797_H8 | grape\|11v1\|GSVIVT01037437001_P1 | 5380 | 9682 | 644 | 80 | globlastp |
| LAB797_H9 | watermelon\|11v1\|VMEL00226737851839_P1 | 5381 | 9683 | 644 | 80 | globlastp |
| LAB798_H1 | maize\|10v1\|AI820398_P1 | 5382 | 9684 | 645 | 89.1 | globlastp |
| LAB798_H6 | switchgrass\|12v1\|FE646593_P1 | 5383 | 9685 | 645 | 88.1 | globlastp |
| LAB798_H2 | sugarcane\|10v1\|CA138369 | 5384 | 9686 | 645 | 86 | globlastp |
| LAB798_H3 | foxtail_millet\|11v3\|PHY7SI007347M_P1 | 5385 | 9687 | 645 | 84.9 | globlastp |
| LAB798_H4 | switchgrass\|gb167\|FE613718 | 5386 | 9688 | 645 | 84.2 | globlastp |
| LAB798_H4 | switchgrass\|12v1\|FE613718_P1 | 5387 | 9689 | 645 | 82.1 | globlastp |
| LAB798_H5 | millet\|10v1\|EVO454PM103080_P1 | 5388 | 9690 | 645 | 81.8 | globlastp |
| LAB798_H6 | switchgrass\|gb167\|FE646593 | 5389 | 9691 | 645 | 80.7 | globlastp |
| LAB799_H1 | sorghum\|12v1\|SB03G033410 | 5390 | 9692 | 646 | 95.2 | globlastp |
| LAB799_H2 | maize\|10v1\|AI978026_P1 | 5391 | 9693 | 646 | 88.8 | globlastp |
| LAB799_H4 | switchgrass\|12v1\|FE624429_P1 | 5392 | 9694 | 646 | 82.2 | globlastp |
| LAB799_H3 | foxtail_millet\|11v3\|PHY7SI021475M_P1 | 5393 | 9695 | 646 | 81.1 | globlastp |
| LAB799_H5 | switchgrass\|12v1\|FL868889_P1 | 5394 | 9696 | 646 | 80.7 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB800_H1 | pigeonpea\|11v1\|GW352087_P1 | 5395 | 9697 | 647 | 96.2 | globlastp |
| LAB800_H2 | soybean\|11v1\|GLYMA20G01930 | 5396 | 9698 | 647 | 94.9 | globlastp |
| LAB800_H2 | soybean\|12v1\|GLYMA20G01930_P1 | 5397 | 9698 | 647 | 94.9 | globlastp |
| LAB800_H3 | soybean\|11v1\|GLYMA06G05740 | 5398 | 9699 | 647 | 94.3 | globlastp |
| LAB800_H3 | soybean\|12v1\|GLYMA06G05740_P1 | 5399 | 9699 | 647 | 94.3 | globlastp |
| LAB800_H84 | bean\|12v2\|CA898282_P1 | 5400 | 9700 | 647 | 91.8 | globlastp |
| LAB800_H4 | bean\|12v1\|CA898282 | 5401 | 9700 | 647 | 91.8 | globlastp |
| LAB800_H5 | cowpea\|12v1\|FC460650_P1 | 5402 | 9701 | 647 | 91.1 | globlastp |
| LAB800_H5 | cowpea\|gb166\|FC460650 | 5403 | 9701 | 647 | 91.1 | globlastp |
| LAB800_H6 | trigonella\|11v1\|SRR066194X142200 | 5404 | 9702 | 647 | 88.1 | globlastp |
| LAB800_H7 | lotus\|09v1\|BW602763_P1 | 5405 | 9703 | 647 | 86.2 | globlastp |
| LAB800_H8 | peanut\|10v1\|DT044355_P1 | 5406 | 9704 | 647 | 85.6 | globlastp |
| LAB800_H9 | chickpea\|11v1\|FE672070 | 5407 | 9705 | 647 | 85.5 | globlastp |
| LAB800_H9 | chickpea\|13v2\|FE672070_P1 | 5408 | 9705 | 647 | 85.5 | globlastp |
| LAB800_H10 | medicago\|12v1\|BG450559_P1 | 5409 | 9706 | 647 | 85 | globlastp |
| LAB800_H11 | apple\|11v1\|CN868712_P1 | 5410 | 9707 | 647 | 84.8 | globlastp |
| LAB800_H12 | apple\|11v1\|CN994167_P1 | 5411 | 9707 | 647 | 84.8 | globlastp |
| LAB800_H13 | euonymus\|11v1\|SRR070038X104203_P1 | 5412 | 9708 | 647 | 84.8 | globlastp |
| LAB800_H14 | grape\|11v1\|GSVIVT01035429001_P1 | 5413 | 9709 | 647 | 84.8 | globlastp |
| LAB800_H15 | pea\|11v1\|PEAHSP177A_P1 | 5414 | 9710 | 647 | 84.3 | globlastp |
| LAB800_H16 | walnuts\|gb166\|CB303500 | 5415 | 9711 | 647 | 84.3 | globlastp |
| LAB800_H17 | apple\|11v1\|CN445232_P1 | 5416 | 9712 | 647 | 84.2 | globlastp |
| LAB800_H18 | hevea\|10v1\|EC603261_P1 | 5417 | 9713 | 647 | 84.2 | globlastp |
| LAB800_H19 | cowpea\|12v1\|FF400274_P1 | 5418 | 9714 | 647 | 83.9 | globlastp |
| LAB800_H19 | cowpea\|gb166\|FF400274 | 5419 | 9714 | 647 | 83.9 | globlastp |
| LAB800_H85 | nicotiana_benthamiana\|12v1\|EB431431_P1 | 5420 | 9715 | 647 | 83.6 | globlastp |
| LAB800_H86 | poplar\|13v1\|BU831700_P1 | 5421 | 9716 | 647 | 83.6 | globlastp |
| LAB800_H20 | jatropha\|09v1\|FM887248_P1 | 5422 | 9717 | 647 | 83.6 | globlastp |
| LAB800_H21 | apple\|11v1\|CN444285_P1 | 5423 | 9718 | 647 | 83.5 | globlastp |
| LAB800_H22 | euonymus\|11v1\|SRR070038X104955_P1 | 5424 | 9719 | 647 | 83.5 | globlastp |
| LAB800_H23 | prunus\|10v1\|AF159562 | 5425 | 9720 | 647 | 83.5 | globlastp |
| LAB800_H24 | strawberry\|11v1\|DY667157 | 5426 | 9721 | 647 | 83.5 | globlastp |
| LAB800_H25 | cannabis\|12v1\|SOLX00079782_P1 | 5427 | 9722 | 647 | 83.2 | globlastp |
| LAB800_H26, LAB800_H27 | castorbean\|12v1\|XM_002516059_T1 | 5428 | 9723 | 647 | 83.12 | glotblastn |
| LAB800_H87 | castorbean\|12v1\|RIC12V1CUFF9072T1_P1 | 5429 | 9724 | 647 | 83.1 | globlastp |
| LAB800_H88 | castorbean\|12v1\|XM_002516060_P1 | 5430 | 9724 | 647 | 83.1 | globlastp |
| LAB800_H27 | castorbean\|11v1\|XM_002516060 | 5431 | 9724 | 647 | 83.1 | globlastp |
| LAB800_H28 | catharanthus\|11v1\|AM232372_T1 | 5432 | 9725 | 647 | 83.02 | glotblastn |
| LAB800_H89 | nicotiana_benthamiana\|12v1\|BP748306_P1 | 5433 | 9726 | 647 | 83 | globlastp |
| LAB800_H29 | poplar\|10v1\|BU836876 | 5434 | 9727 | 647 | 83 | globlastp |
| LAB800_H30 | tobacco\|gb162\|AY329075 | 5435 | 9728 | 647 | 83 | globlastp |
| LAB800_H31 | tobacco\|gb162\|EB430311 | 5436 | 9729 | 647 | 83 | globlastp |
| LAB800_H32 | apple\|11v1\|CN868486_T1 | 5437 | 9730 | 647 | 82.91 | glotblastn |
| LAB800_H90 | prunus_mume\|13v1\|AF159562_P1 | 5438 | 9731 | 647 | 82.9 | globlastp |
| LAB800_H33 | beech\|11v1\|SRR006293.13479_P1 | 5439 | 9732 | 647 | 82.6 | globlastp |
| LAB800_H34 | pigeonpea\|11v1\|SRR054580X130347_P1 | 5440 | 9733 | 647 | 82.5 | globlastp |
| LAB800_H91 | nicotiana_benthamiana\|12v1\|EB430305_P1 | 5441 | 9734 | 647 | 82.4 | globlastp |
| LAB800_H92 | nicotiana_benthamiana\|12v1\|EB436662_P1 | 5442 | 9735 | 647 | 82.4 | globlastp |
| LAB800_H35 | rose\|12v1\|BQ104014 | 5443 | 9736 | 647 | 82.4 | globlastp |
| LAB800_H36 | tabernaemontana\|11v1\|SRR098689X11203 | 5444 | 9737 | 647 | 82.4 | globlastp |
| LAB800_H71 | nicotiana_benthamiana\|12v1\|EB451782_P1 | 5445 | 9738 | 647 | 82.4 | globlastp |
| LAB800_H37 | cacao\|10v1\|CA794569_P1 | 5446 | 9739 | 647 | 82.3 | globlastp |
| LAB800_H38 | cassava\|09v1\|DR084476_P1 | 5447 | 9740 | 647 | 82.3 | globlastp |
| LAB800_H39 | coffea\|10v1\|DV676785_P1 | 5448 | 9741 | 647 | 82.3 | globlastp |
| LAB800_H40 | grape\|11v1\|GSVIVT01035436001_P1 | 5449 | 9742 | 647 | 82.3 | globlastp |
| LAB800_H41 | nasturtium\|11v1\|SRR032558.100245_P1 | 5450 | 9743 | 647 | 82 | globlastp |
| LAB800_H42 | nasturtium\|11v1\|SRR032558.102872_P1 | 5451 | 9743 | 647 | 82 | globlastp |
| LAB800_H43 | humulus\|11v1\|EX521136_P1 | 5452 | 9744 | 647 | 81.9 | globlastp |
| LAB800_H93 | nicotiana_benthamiana\|12v1\|DV999708_P1 | 5453 | 9745 | 647 | 81.8 | globlastp |
| LAB800_H94 | nicotiana_benthamiana\|12v1\|EB430311_P1 | 5454 | 9746 | 647 | 81.8 | globlastp |
| LAB800_H95 | olea\|13v1\|SRR592583X103947D1_P1 | 5455 | 9747 | 647 | 81.8 | globlastp |
| LAB800_H44 | fraxinus\|11v1\|SRR058827.103419_T1 | 5456 | 9748 | 647 | 81.76 | glotblastn |
| LAB800_H45 | eucalyptus\|11v2\|SRR001659X280547_P1 | 5457 | 9749 | 647 | 81.6 | globlastp |
| LAB800_H46 | watermelon\|11v1\|CLICUGI11014604 | 5458 | 9750 | 647 | 81.6 | globlastp |
| LAB800_H47 | watermelon\|11v1\|DV632800 | 5459 | 9750 | 647 | 81.6 | globlastp |
| LAB800_H48 | lotus\|09v1\|CRPLJ032993_P1 | 5460 | 9751 | 647 | 81.2 | globlastp |
| LAB800_H49 | tomato\|11v1\|LEU72396 | 5461 | 9752 | 647 | 81.2 | globlastp |
| LAB800_H50 | monkeyflower\|12v1\|GR090120_T1 | 5462 | 9753 | 647 | 81.13 | glotblastn |
| LAB800_H96 | monkeyflower\|12v1\|GO980650_P1 | 5463 | 9754 | 647 | 81.1 | globlastp |
| LAB800_H97 | nicotiana_benthamiana\|12v1\|AY329075_P1 | 5464 | 9755 | 647 | 81.1 | globlastp |
| LAB800_H50 | monkeyflower\|10v1\|GO980649 | 5465 | 9754 | 647 | 81.1 | globlastp |
| LAB800_H51 | orobanche\|10v1\|SRR023189S0028578_P1 | 5466 | 9756 | 647 | 81.1 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB800_H52 | tobacco\|gb162\|DV999708 | 5467 | 9757 | 647 | 81.1 | globlastp |
| LAB800_H53 | tobacco\|gb162\|EB435563 | 5468 | 9758 | 647 | 81.1 | globlastp |
| LAB800_H54 | walnuts\|gb166\|EL894787 | 5469 | 9759 | 647 | 81.1 | globlastp |
| LAB800_H55 | cucurbita\|11v1\|SRR091276X219629_T1 | 5470 | 9760 | 647 | 81.01 | glotblastn |
| LAB800_H56 | eucalyptus\|11v2\|SRR001659X164791_P1 | 5471 | 9761 | 647 | 81 | globlastp |
| LAB800_H57 | grape\|11v1\|GSVIVT01035431001_P1 | 5472 | 9762 | 647 | 81 | globlastp |
| LAB800_H58 | nasturtium\|11v1\|GH164946_P1 | 5473 | 9763 | 647 | 80.9 | globlastp |
| LAB800_H59 | clementine\|11v1\|BQ624198_T1 | 5474 | 9764 | 647 | 80.86 | glotblastn |
| LAB800_H60 | orange\|11v1\|BQ624198_T1 | 5475 | 9765 | 647 | 80.86 | glotblastn |
| LAB800_H61 | nasturtium\|11v1\|SRR032558.103689_T1 | 5476 | 9766 | 647 | 80.75 | glotblastn |
| LAB800_H62 | beech\|11v1\|SRR006293.12941_P1 | 5477 | 9767 | 647 | 80.7 | globlastp |
| LAB800_H63 | lotus\|09v1\|CRPLJ008753_P1 | 5478 | 9768 | 647 | 80.7 | globlastp |
| LAB800_H64 | nasturtium\|11v1\|SRR032558.100084_P1 | 5479 | 9769 | 647 | 80.7 | globlastp |
| LAB800_H65 | soybean\|11v1\|GLYMA14G11420 | 5480 | 9770 | 647 | 80.7 | globlastp |
| LAB800_H65 | soybean\|12v1\|GLYMA14G11420_P1 | 5481 | 9770 | 647 | 80.7 | globlastp |
| LAB800_H98 | bean\|12v2\|CA906174_P1 | 5482 | 9771 | 647 | 80.6 | globlastp |
| LAB800_H99 | bean\|12v2\|CA906176_P1 | 5483 | 9772 | 647 | 80.6 | globlastp |
| LAB800_H66 | bean\|12v1\|CA906176 | 5484 | 9772 | 647 | 80.6 | globlastp |
| LAB800_H67 | euphorbia\|11v1\|DV120470_P1 | 5485 | 9773 | 647 | 80.6 | globlastp |
| LAB800_H68 | solanum_phureja\|09v1\|SPHAI776971 | 5486 | 9774 | 647 | 80.6 | globlastp |
| LAB800_H69 | spurge\|gb161\|DV120470 | 5487 | 9773 | 647 | 80.6 | globlastp |
| LAB800_H70 | amsonia\|11v1\|SRR098688X186168_P1 | 5488 | 9775 | 647 | 80.5 | globlastp |
| LAB800_H71 | nicotiana_benthamiana\|gb162\|ES886792 | 5489 | 9776 | 647 | 80.5 | glotblastn |
| LAB800_H72 | orobanche\|10v1\|SRR023189S0041905_P1 | 5490 | 9777 | 647 | 80.5 | globlastp |
| LAB800_H73 | papaya\|gb165\|AY242075_P1 | 5491 | 9778 | 647 | 80.5 | globlastp |
| LAB600_H14 | grape\|11v1\|GSVIVT01035433001_P1 | 5492 | 9779 | 647 | 80.4 | globlastp |
| LAB800_H74 | cotton\|11v1\|BE053976_P1 | 5493 | 9780 | 647 | 80.4 | globlastp |
| LAB800_H75 | cotton\|11v1\|CO080002_P1 | 5494 | 9781 | 647 | 80.4 | globlastp |
| LAB800_H76 | gossypium_raimondii\|12v1\|BE053976_P1 | 5495 | 9780 | 647 | 80.4 | globlastp |
| LAB800_H77 | grape\|11v1\|GSVIVT01035427001_T1 | 5496 | 9782 | 647 | 80.38 | glotblastn |
| LAB800_H78 | hornbeam\|12v1\|SRR364455.117533_T1 | 5497 | 9783 | 647 | 80.38 | glotblastn |
| LAB800_H79 | beech\|11v1\|SRR364434.174307_T1 | 5498 | 9784 | 647 | 80.12 | glotblastn |
| LAB800_H80 | oak\|10v1\|FP056783_T1 | 5499 | 9785 | 647 | 80.12 | glotblastn |
| LAB800_H81 | nasturtium\|11v1\|SRR032558.215294_P1 | 5500 | 9786 | 647 | 80.1 | globlastp |
| LAB800_H82 | soybean\|11v1\|GLYMA14G11430 | 5501 | 9787 | 647 | 80.1 | globlastp |
| LAB800_H82 | soybean\|12v1\|GLYMA14G11430_P1 | 5502 | 9787 | 647 | 80.1 | globlastp |
| LAB800_H100 | pepper\|12v1\|CA522182_P1 | 5503 | 9788 | 647 | 80 | globlastp |
| LAB800_H83 | solanum_phureja\|09v1\|SPHLEU72396 | 5504 | 9789 | 647 | 80 | globlastp |
| LAB801_H1 | soybean\|11v1\|GLYMA06G48220 | 5505 | 9790 | 648 | 91.8 | globlastp |
| LAB801_H1 | soybean\|12v1\|GLYMA06G48220_P1 | 5506 | 9790 | 648 | 91.8 | globlastp |
| LAB801_H2 | pigeonpea\|11v1\|SRR054580X100068_P1 | 5507 | 9791 | 648 | 86.9 | globlastp |
| LAB801_H3 | lotus\|09v1\|LLAW720413_P1 | 5508 | 9792 | 648 | 85.9 | globlastp |
| LAB801_H5 | bean\|12v2\|SRR001334.176028_P1 | 5509 | 9793 | 648 | 83.6 | globlastp |
| LAB801_H6 | chickpea\|13v2\|SRR133517.147443_P1 | 5510 | 9794 | 648 | 82.6 | globlastp |
| LAB802_H1 | soybean\|11v1\|GLYMA08G23980 | 5511 | 9795 | 649 | 94.9 | globlastp |
| LAB802_H1 | soybean\|12v1\|GLYMA08G23980_P1 | 5512 | 9795 | 649 | 94.9 | globlastp |
| LAB802_H2 | pigeonpea\|11v1\|SRR054580X104838_P1 | 5513 | 9796 | 649 | 89.7 | globlastp |
| LAB802_H13 | bean\|12v2\|CA900965_T1 | 5514 | 9797 | 649 | 89.05 | glotblastn |
| LAB802_H3 | bean\|12v1\|CA900965 | 5515 | 9798 | 649 | 89.05 | glotblastn |
| LAB802_H4 | chickpea\|11v1\|FE671183 | 5516 | 9799 | 649 | 87.6 | globlastp |
| LAB802_H4 | chickpea\|13v2\|FE671183_P1 | 5517 | 9799 | 649 | 87.6 | globlastp |
| LAB802_H5 | cowpea\|12v1\|FF384470_P1 | 5518 | 9800 | 649 | 87.6 | globlastp |
| LAB802_H5 | cowpea\|gb166\|FF384470 | 5519 | 9800 | 649 | 87.6 | globlastp |
| LAB802_H14 | chickpea\|13v2\|GR393338_T1 | 5520 | 9801 | 649 | 87.59 | glotblastn |
| LAB802_H6 | medicago\|12v1\|AL388023_P1 | 5521 | 9802 | 649 | 86.8 | globlastp |
| LAB802_H7 | trigonella\|11v1\|SRR066194X225634 | 5522 | 9803 | 649 | 86.8 | globlastp |
| LAB802_H8 | cyamopsis\|10v1\|EG975063_P1 | 5523 | 9804 | 649 | 85.5 | globlastp |
| LAB802_H9 | lotus\|09v1\|LLGO006934_P1 | 5524 | 9805 | 649 | 84.7 | globlastp |
| LAB802_H10 | peanut\|10v1\|SRR042421S0039205_P1 | 5525 | 9806 | 649 | 81.9 | globlastp |
| LAB802_H11 | peanut\|10v1\|GO330236_P1 | 5526 | 9807 | 649 | 80.4 | globlastp |
| LAB802_H12 | acacia\|10v1\|FS584980_P1 | 5527 | 9808 | 649 | 80.3 | globlastp |
| LAB803_H4 | bean\|12v2\|SRR001335.331401_P1 | 5528 | 9809 | 650 | 82.7 | globlastp |
| LAB803_H1 | bean\|12v1\|SRR001334.152314 | 5529 | 9809 | 650 | 82.7 | globlastp |
| LAB803_H2 | pigeonpea\|11v1\|SRR054580X100809_P1 | 5530 | 9810 | 650 | 80.7 | globlastp |
| LAB803_H3 | pigeonpea\|11v1\|SRR054580X214670_P1 | 5531 | 9811 | 650 | 80.3 | globlastp |
| LAB804_H26 | cyamopsis\|10v1\|EG983307_P1 | 5532 | 9812 | 651 | 97.6 | globlastp |
| LAB804_H27 | cowpea\|12v1\|FC458549_P1 | 5533 | 9813 | 651 | 97.1 | globlastp |
| LAB804_H27 | cowpea\|gb166\|FC458549 | 5534 | 9813 | 651 | 97.1 | globlastp |
| LAB804_H111 | bean\|12v2\|CA898997_P1 | 5535 | 9814 | 651 | 96.6 | globlastp |
| LAB804_H28 | bean\|12v1\|CA898997 | 5536 | 9814 | 651 | 96.6 | globlastp |
| LAB804_H29 | liquorice\|gb171\|FS243799_P1 | 5537 | 9815 | 651 | 91.8 | globlastp |
| LAB804_H30 | chickpea\|13v2\|FE671625_P1 | 5538 | 9816 | 651 | 90.4 | globlastp |
| LAB804_H30 | chickpea\|11v1\|FE671625 | 5539 | 9817 | 651 | 90.38 | glotblastn |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB804_H31 | lotus\|09v1\|LLAI967448_P1 | 5540 | 9818 | 651 | 89.9 | globlastp |
| LAB804_H32 | trigonella\|11v1\|SRR066194X125989 | 5541 | 9819 | 651 | 89.9 | globlastp |
| LAB804_H33 | medicago\|12v1\|BF519737_P1 | 5542 | 9820 | 651 | 89.4 | globlastp |
| LAB804_H34 | pea\|11v1\|GH720686_P1 | 5543 | 9821 | 651 | 88.9 | globlastp |
| LAB804_H35 | poplar\|10v1\|BU821970 | 5544 | 9822 | 651 | 88.5 | globlastp |
| LAB804_H35 | poplar\|13v1\|BU821970_P1 | 5545 | 9823 | 651 | 88.5 | globlastp |
| LAB804_H112 | prunus_mume\|13v1\|DY640902_P1 | 5546 | 9824 | 651 | 87.3 | globlastp |
| LAB804_H36 | castorbean\|12v1\|EE254317_P1 | 5547 | 9825 | 651 | 87.1 | globlastp |
| LAB804_H37 | prunus\|10v1\|CN496867 | 5548 | 9826 | 651 | 86.9 | globlastp |
| LAB804_H38 | cassava\|09v1\|DV449879_P1 | 5549 | 9827 | 651 | 86.6 | globlastp |
| LAB804_H39 | hevea\|10v1\|EC601072_P1 | 5550 | 9828 | 651 | 86.6 | globlastp |
| LAB804_H40 | scabiosa\|11v1\|SRR063723X1062 | 5551 | 9829 | 651 | 86.5 | globlastp |
| LAB804_H41 | apple\|11v1\|CN861796_P1 | 5552 | 9830 | 651 | 86.4 | globlastp |
| LAB804_H42 | rose\|12v1\|BQ105267 | 5553 | 9831 | 651 | 86.4 | globlastp |
| LAB804_H43 | centaurea\|gb166\|EH751391_P1 | 5554 | 9832 | 651 | 86.1 | globlastp |
| LAB804_H44 | flax\|11v1\|GW863971_T1 | 5555 | 9833 | 651 | 85.71 | glotblastn |
| LAB804_H45 | ambrosia\|11v1\|SRR346935.260059_P1 | 5556 | 9834 | 651 | 85.6 | globlastp |
| LAB804_H46 | ambrosia\|11v1\|SRR346943.100164_P1 | 5557 | 9834 | 651 | 85.6 | globlastp |
| LAB804_H47 | arnica\|11v1\|SRR099034X110457_P1 | 5558 | 9835 | 651 | 85.6 | globlastp |
| LAB804_H48 | cirsium\|11v1\|SRR346952.1004150_P1 | 5559 | 9836 | 651 | 85.6 | globlastp |
| LAB804_H49 | dandelion\|10v1\|DR400376_P1 | 5560 | 9837 | 651 | 85.6 | globlastp |
| LAB804_H50 | euphorbia\|11v1\|BP961242_P1 | 5561 | 9838 | 651 | 85.6 | globlastp |
| LAB804_H51 | euphorbia\|11v1\|DV113328_P1 | 5562 | 9839 | 651 | 85.6 | globlastp |
| LAB804_H52 | flaveria\|11v1\|SRR149229.43241_P1 | 5563 | 9840 | 651 | 85.6 | globlastp |
| LAB804_H53 | acacia\|10v1\|FS586585_P1 | 5564 | 9841 | 651 | 85.4 | globlastp |
| LAB804_H54 | cassava\|09v1\|CK646847_P1 | 5565 | 9842 | 651 | 85.2 | globlastp |
| LAB804_H55 | centaurea\|gb166\|EH724339_P1 | 5566 | 9843 | 651 | 85.1 | globlastp |
| LAB804_H56 | cichorium\|gb171\|EH699860_P1 | 5567 | 9844 | 651 | 85.1 | globlastp |
| LAB804_H57 | valeriana\|11v1\|SRR099039X118027 | 5568 | 9845 | 651 | 85.1 | glotblastn |
| LAB804_H58 | apple\|11v1\|CN496867_P1 | 5569 | 9846 | 651 | 85 | globlastp |
| LAB804_H59 | kiwi\|gb166\|FG435327_P1 | 5570 | 9847 | 651 | 85 | globlastp |
| LAB804_H113 | lettuce\|12v1\|DW055702_P1 | 5571 | 9848 | 651 | 84.6 | globlastp |
| LAB804_H60 | chestnut\|gb170\|SRR006295S0045248_P1 | 5572 | 9849 | 651 | 84.6 | globlastp |
| LAB804_H61 | flaveria\|11v1\|SRR149232.106461_P1 | 5573 | 9850 | 651 | 84.6 | globlastp |
| LAB804_H62 | lettuce\|10v1\|DW055702 | 5574 | 9848 | 651 | 84.6 | globlastp |
| LAB804_H63 | sunflower\|12v1\|CD849704 | 5575 | 9851 | 651 | 84.6 | globlastp |
| LAB804_H64 | euonymus\|11v1\|SRR070039X102276_P1 | 5576 | 9852 | 651 | 84.5 | globlastp |
| LAB804_H65 | valeriana\|11v1\|SRR099039X136746 | 5577 | 9853 | 651 | 84.13 | glotblastn |
| LAB804_H66 | beech\|11v1\|SRR006293.16331_P1 | 5578 | 9854 | 651 | 84.1 | globlastp |
| LAB804_H67 | cucurbita\|11v1\|SRR091276X100208_P1 | 5579 | 9855 | 651 | 84 | globlastp |
| LAB804_H68 | tabernaemontana\|11v1\|SRR098689X110632 | 5580 | 9856 | 651 | 84 | globlastp |
| LAB804_H69 | watermelon\|11v1\|AM718428 | 5581 | 9857 | 651 | 84 | globlastp |
| LAB804_H70 | tragopogon\|10v1\|SRR020205S0025271 | 5582 | 9858 | 651 | 83.7 | globlastp |
| LAB804_H71 | tea\|10v1\|CV013617 | 5583 | 9859 | 651 | 83.65 | glotblastn |
| LAB804_H72 | monkeyflower\|10v1\|DV209494 | 5584 | 9860 | 651 | 83.6 | globlastp |
| LAB804_H72 | monkeyflower\|12v1\|DV209494_P1 | 5585 | 9860 | 651 | 83.6 | globlastp |
| LAB804_H73 | strawberry\|11v1\|EX658292 | 5586 | 9861 | 651 | 83.6 | globlastp |
| LAB804_H114 | blueberry\|12v1\|SRR353282X10613D1_P1 | 5587 | 9862 | 651 | 83.5 | globlastp |
| LAB804_H74 | artemisia\|10v1\|GW328359_P1 | 5588 | 9863 | 651 | 83.2 | globlastp |
| LAB804_H75 | senecio\|gb170\|DY661167 | 5589 | 9864 | 651 | 83.2 | globlastp |
| LAB804_H115 | aquilegia\|10v2\|DR920468_P1 | 5590 | 9865 | 651 | 83.1 | globlastp |
| LAB804_H76 | amsonia\|11v1\|SRR098688X107893_P1 | 5591 | 9866 | 651 | 83.1 | globlastp |
| LAB804_H77 | aquilegia\|10v1\|DR920468 | 5592 | 9865 | 651 | 83.1 | globlastp |
| LAB804_H78 | basilicum\|10v1\|DY326359_P1 | 5593 | 9867 | 651 | 83.1 | globlastp |
| LAB804_H79 | catharanthus\|11v1\|EG561880_P1 | 5594 | 9868 | 651 | 83.1 | globlastp |
| LAB804_H80 | potato\|10v1\|BE923319_P1 | 5595 | 9869 | 651 | 83.1 | globlastp |
| LAB804_H81 | tomato\|11v1\|BG127204 | 5596 | 9869 | 651 | 83.1 | globlastp |
| LAB804_H82 | triphysaria\|10v1\|DR171477 | 5597 | 9870 | 651 | 83.1 | globlastp |
| LAB804_H83 | vinca\|11v1\|SRR098690X160393 | 5598 | 9871 | 651 | 82.7 | globlastp |
| LAB804_H116 | nicotiana_benthamiana\|12v1\|EB425761_P1 | 5599 | 9872 | 651 | 82.6 | globlastp |
| LAB804_H117 | sesame\|12v1\|JK082889_P1 | 5600 | 9873 | 651 | 82.6 | globlastp |
| LAB804_H84 | eggplant\|10v1\|FS020089_P1 | 5601 | 9874 | 651 | 82.6 | globlastp |
| LAB804_H85 | phyla\|11v2\|SRR099037X129737_P1 | 5602 | 9875 | 651 | 82.6 | globlastp |
| LAB804_H86 | solanum_phureja\|09v1\|SPHBG127204 | 5603 | 9876 | 651 | 82.6 | globlastp |
| LAB804_H87 | fagopyrum\|11v1\|SRR063689X12687_P1 | 5604 | 9877 | 651 | 82.3 | globlastp |
| LAB804_H88 | vinca\|11v1\|SRR098690X100316 | 5605 | 9878 | 651 | 82.3 | globlastp |
| LAB804_H89 | flaveria\|11v1\|SRR149241.124263_T1 | 5606 | 9879 | 651 | 82.21 | glotblastn |
| LAB804_H90 | guizotia\|10v1\|GE553427_T1 | 5607 | 9880 | 651 | 82.21 | glotblastn |
| LAB804_H118 | pepper\|12v1\|BM065058_P1 | 5608 | 9881 | 651 | 82.2 | globlastp |
| LAB804_H91 | fraxinus\|11v1\|SRR058827.102106_P1 | 5609 | 9882 | 651 | 82.2 | globlastp |
| LAB804_H92 | kiwi\|gb166\|FG408013_P1 | 5610 | 9883 | 651 | 82.2 | globlastp |
| LAB804_H93 | melon\|10v1\|AM718428_P1 | 5611 | 9884 | 651 | 82.2 | globlastp |
| LAB804_H94 | olea\|11v1\|SRR014463.31738 | 5612 | 9885 | 651 | 82.2 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB804_H94 | olea\|13v1\|SRR014463X31738D1_P1 | 5613 | 9885 | 651 | 82.2 | globlastp |
| LAB804_H95 | pepper\|gb171\|BM065058 | 5614 | 9881 | 651 | 82.2 | globlastp |
| LAB804_H96 | petunia\|gb171\|CV295360_P1 | 5615 | 9886 | 651 | 82.2 | globlastp |
| LAB804_H97 | antirrhinum\|gb166\|AJ797616_T1 | 5616 | 9887 | 651 | 82.16 | glotblastn |
| LAB804_H119 | nicotiana_benthamiana\|12v1\|DV158338_P1 | 5617 | 9888 | 651 | 81.7 | globlastp |
| LAB804_H98 | platanus\|11v1\|SRR096786X193192_P1 | 5618 | 9889 | 651 | 81.7 | globlastp |
| LAB804_H99 | salvia\|10v1\|FE536438 | 5619 | 9890 | 651 | 81.7 | globlastp |
| LAB804_H100 | tobacco\|gb162\|EB425761 | 5620 | 9891 | 651 | 81.7 | globlastp |
| LAB804_H101 | fagopyrum\|11v1\|SRR063703X119223_T1 | 5621 | 9892 | 651 | 81.34 | glotblastn |
| LAB804_H102 | arnica\|11v1\|SRR099034X119831_P1 | 5622 | 9893 | 651 | 81.2 | globlastp |
| LAB804_H103 | liriodendron\|gb166\|CK761525_P1 | 5623 | 9894 | 651 | 81.2 | globlastp |
| LAB804_H104 | silene\|11v1\|SRR096785X107416XX1 | 5624 | 9895 | 651 | 81.2 | globlastp |
| LAB804_H105 | utricularia\|11v1\|SRR094438.105376 | 5625 | 9896 | 651 | 81.2 | globlastp |
| LAB804_H106 | plantago\|11v2\|SRR066373X119026_T1 | 5626 | 9897 | 651 | 81.04 | glotblastn |
| LAB804_H107 | ipomoea_batatas\|10v1\|EE880037_P1 | 5627 | 9898 | 651 | 80.8 | globlastp |
| LAB804_H108 | chelidonium\|11v1\|SRR084752X105206_T1 | 5628 | 9899 | 651 | 80.75 | glotblastn |
| LAB804_H109 | coffea\|10v1\|DV665876_P1 | 5629 | 9900 | 651 | 80.6 | globlastp |
| LAB804_H120 | olea\|13v1\|SRR014463X10905D1_P1 | 5630 | 9901 | 651 | 80.3 | globlastp |
| LAB804_H110 | beet\|12v1\|EG551047_P1 | 5631 | 9902 | 651 | 80.1 | globlastp |
| LAB805_H1 | soybean\|11v1\|GLYMA13G20830 | 5632 | 9903 | 652 | 89.8 | globlastp |
| LAB805_H1 | soybean\|12v1\|GLYMA13G20830_P1 | 5633 | 9903 | 652 | 89.8 | globlastp |
| LAB805_H2 | pigeonpea\|11v1\|SRR054580X103638_P1 | 5634 | 9904 | 652 | 87.9 | globlastp |
| LAB807_H76 | soybean\|12v1\|GLYMA20G28900_P1 | 5635 | 9905 | 653 | 96.2 | globlastp |
| LAB807_H1 | soybean\|11v1\|GLYMA20G28900 | 5636 | 9905 | 653 | 96.2 | globlastp |
| LAB807_H2 | pigeonpea\|11v1\|SRR054580X125671_P1 | 5637 | 9906 | 653 | 94.3 | globlastp |
| LAB807_H77 | bean\|12v2\|CA898563_P1 | 5638 | 9907 | 653 | 92.9 | globlastp |
| LAB807_H3 | bean\|12v1\|CA898563 | 5639 | 9907 | 653 | 92.9 | globlastp |
| LAB807_H4 | cowpea\|12v1\|FF383219_P1 | 5640 | 9908 | 653 | 92.9 | globlastp |
| LAB807_H4 | cowpea\|gb166\|FF383219 | 5641 | 9908 | 653 | 92.9 | globlastp |
| LAB807_H5 | cyamopsis\|10v1\|EG975757_P1 | 5642 | 9909 | 653 | 92.9 | globlastp |
| LAB807_H6 | peanut\|10v1\|ES711872_P1 | 5643 | 9910 | 653 | 90.3 | globlastp |
| LAB807_H7 | medicago\|12v1\|AL372542_P1 | 5644 | 9911 | 653 | 88.7 | globlastp |
| LAB807_H8 | lotus\|09v1\|GO005260_P1 | 5645 | 9912 | 653 | 88.3 | globlastp |
| LAB807_H9 | chickpea\|11v1\|FE671026 | 5646 | 9913 | 653 | 87 | globlastp |
| LAB807_H9 | chickpea\|13v2\|FE671026_P1 | 5647 | 9913 | 653 | 87 | globlastp |
| LAB807_H10 | trigonella\|11v1\|SRR066194X10284XX1 | 5648 | 9914 | 653 | 86.6 | globlastp |
| LAB807_H11 | cannabis\|12v1\|SOLX00013949_P1 | 5649 | 9915 | 653 | 83.1 | globlastp |
| LAB807_H12 | cacao\|10v1\|CU519533_P1 | 5650 | 9916 | 653 | 83 | globlastp |
| LAB807_H13 | heritiera\|10v1\|SRR005795S0002179_P1 | 5651 | 9917 | 653 | 83 | globlastp |
| LAB807_H78 | poplar\|13v1\|BU818914_P1 | 5652 | 9918 | 653 | 82.9 | globlastp |
| LAB807_H14 | momordica\|10v1\|SRR071315S0002442_P1 | 5653 | 9919 | 653 | 82.9 | globlastp |
| LAB807_H15 | salvia\|10v1\|CV162575 | 5654 | 9920 | 653 | 82.86 | glotblastn |
| LAB807_H16 | beech\|11v1\|FR602378_P1 | 5655 | 9921 | 653 | 82.7 | globlastp |
| LAB807_H17 | chestnut\|gb170\|SRR006295S0010330_P1 | 5656 | 9922 | 653 | 82.6 | globlastp |
| LAB807_H18 | tabernaemontana\|11v1\|SRR098689X118501 | 5657 | 9923 | 653 | 82.55 | glotblastn |
| LAB807_H19 | monkeyflower\|10v1\|GR000157 | 5658 | 9924 | 653 | 82.46 | glotblastn |
| LAB807_H20 | cassava\|09v1\|DV441208_P1 | 5659 | 9925 | 653 | 82.4 | globlastp |
| LAB807_H21 | watermelon\|11v1\|VMEL00798506531714 | 5660 | 9926 | 653 | 82.4 | globlastp |
| LAB807_H22 | tripterygium\|11v1\|SRR098677X117580 | 5661 | 9927 | 653 | 82.16 | glotblastn |
| LAB807_H19 | monkeyflower\|12v1\|GR025444_T1 | 5662 | 9928 | 653 | 81.99 | glotblastn |
| LAB807_H23 | castorbean\|11v1\|EE254989 | 5663 | 9929 | 653 | 81.9 | globlastp |
| LAB807_H23 | castorbean\|12v1\|EE254989_P1 | 5664 | 9929 | 653 | 81.9 | globlastp |
| LAB807_H24 | papaya\|gb165\|EX267214_P1 | 5665 | 9930 | 653 | 81.9 | globlastp |
| LAB807_H25 | oak\|10v1\|CU657001_P1 | 5666 | 9931 | 653 | 81.7 | globlastp |
| LAB807_H26 | amsonia\|11v1\|SRR098688X124319_T1 | 5667 | 9932 | 653 | 81.6 | glotblastn |
| LAB807_H27 | b_rapa\|11v1\|L46438_T1 | 5668 | 9933 | 653 | 81.6 | glotblastn |
| LAB807_H28 | gerbera\|09v1\|AJ750112_P1 | 5669 | 9934 | 653 | 81.6 | globlastp |
| LAB807_H29 | vinca\|11v1\|SRR098690X100773 | 5670 | 9935 | 653 | 81.6 | glotblastn |
| LAB807_H79 | olea\|13v1\|SRR014464X39879D1_T1 | 5671 | 9936 | 653 | 81.43 | glotblastn |
| LAB807_H30 | rhizophora\|10v1\|SRR005792S0007617 | 5672 | 9937 | 653 | 81.43 | glotblastn |
| LAB807_H73 | olea\|13v1\|SRR014463X59571D1_T1 | 5673 | 9938 | 653 | 81.43 | glotblastn |
| LAB807_H31 | cleome_spinosa\|10v1\|GR932125_P1 | 5674 | 9939 | 653 | 81.4 | globlastp |
| LAB807_H32 | cucurbita\|11v1\|SRR091276X106181_P1 | 5675 | 9940 | 653 | 81.4 | globlastp |
| LAB807_H33 | cotton\|11v1\|AI727096_P1 | 5676 | 9941 | 653 | 81.2 | globlastp |
| LAB807_H34 | catharanthus\|11v1\|SRR098691X123316_T1 | 5677 | 9942 | 653 | 81.13 | glotblastn |
| LAB807_H35 | vinca\|11v1\|SRR098690X235482 | 5678 | 9943 | 653 | 81.13 | glotblastn |
| LAB807_H36 | flaveria\|11v1\|SRR149229.113015_P1 | 5679 | 9944 | 653 | 81.1 | globlastp |
| LAB807_H37 | ipomoea_batatas\|10v1\|CB330389_P1 | 5680 | 9945 | 653 | 81.1 | globlastp |
| LAB807_H38 | thellungiella_parvulum\|11v1\|BY807252 | 5681 | 9946 | 653 | 81.04 | glotblastn |
| LAB807_H39 | tragopogon\|10v1\|SRR020205S0017796 | 5682 | 9947 | 653 | 81.04 | glotblastn |
| LAB807_H40 | euphorbia\|11v1\|SRR098678X112186_P1 | 5683 | 9948 | 653 | 81 | globlastp |
| LAB807_H41 | valeriana\|11v1\|SRR099039X116893 | 5684 | 9949 | 653 | 80.95 | glotblastn |
| LAB807_H42 | antirrhinum\|gb166\|AJ559323_P1 | 5685 | 9950 | 653 | 80.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB807_H80 | sesame\|12v1\|SESI12V1373505_P1 | 5686 | 9951 | 653 | 80.7 | globlastp |
| LAB807_H43 | cynara\|gb167\|GE591023_P1 | 5687 | 9952 | 653 | 80.7 | globlastp |
| LAB807_H44 | orobanche\|10v1\|SRR023189S0007423_P1 | 5688 | 9953 | 653 | 80.7 | globlastp |
| LAB807_H45 | phyla\|11v2\|SRR099035X112372_P1 | 5689 | 9954 | 653 | 80.7 | globlastp |
| LAB807_H46 | cleome_spinosa\|10v1\|GR932545_P1 | 5690 | 9955 | 653 | 80.6 | globlastp |
| LAB807_H47 | poppy\|11v1\|FE964957_P1 | 5691 | 9956 | 653 | 80.6 | globlastp |
| LAB807_H48 | centaurea\|gb166\|EH716099_T1 | 5692 | 9957 | 653 | 80.57 | glotblastn |
| LAB807_H49 | centaurea\|gb166\|EH760760_T1 | 5693 | 9958 | 653 | 80.57 | glotblastn |
| LAB807_H50 | cichorium\|gb171\|EH678948_T1 | 5694 | 9959 | 653 | 80.57 | glotblastn |
| LAB807_H51 | cirsium\|11v1\|SRR346952.103242_T1 | 5695 | 9960 | 653 | 80.57 | glotblastn |
| LAB807_H52 | safflower\|gb162\|EL377033 | 5696 | 9961 | 653 | 80.57 | glotblastn |
| LAB807_H53 | melon\|10v1\|VMEL00061337043403_P1 | 5697 | 9962 | 653 | 80.5 | globlastp |
| LAB807_H54 | eschscholzia\|11v1\|SRR014116.12846_T1 | 5698 | 9963 | 653 | 80.48 | glotblastn |
| LAB807_H55 | fraxinus\|11v1\|SRR058827.109687_T1 | 5699 | 9964 | 653 | 80.48 | glotblastn |
| LAB807_H56 | rose\|12v1\|EC588505 | 5700 | 9965 | 653 | 80.48 | glotblastn |
| LAB807_H57 | ipomoea_nil\|10v1\|BJ560618_P1 | 5701 | 9966 | 653 | 80.3 | globlastp |
| LAB807_H58 | cirsium\|11v1\|SRR346952.1004278_P1 | 5702 | 9967 | 653 | 80.2 | globlastp |
| LAB807_H59 | cleome_gynandra\|10v1\|SRR015532S0016159_P1 | 5703 | 9968 | 653 | 80.2 | globlastp |
| LAB807_H60 | flaveria\|11v1\|SRR149229.266171_P1 | 5704 | 9969 | 653 | 80.2 | globlastp |
| LAB807_H61 | hornbeam\|12v1\|SRR364455.103918_P1 | 5705 | 9970 | 653 | 80.2 | globlastp |
| LAB807_H62 | sarracenia\|11v1\|SRR192669.133211 | 5706 | 9971 | 653 | 80.19 | glotblastn |
| LAB807_H63 | thellungiella_halophilum\|11v1\|BY807252 | 5707 | 9972 | 653 | 80.19 | glotblastn |
| LAB807_H64 | apple\|11v1\|CN908808_P1 | 5708 | 9973 | 653 | 80.1 | globlastp |
| LAB807_H65 | grape\|11v1\|GSVIVT01018049001_P1 | 5709 | 9974 | 653 | 80.1 | globlastp |
| LAB807_H81 | lettuce\|12v1\|DW051953_T1 | 5710 | 9975 | 653 | 80.09 | glotblastn |
| LAB807_H66 | blueberry\|10v1\|CF810446 | 5711 | 9976 | 653 | 80.09 | glotblastn |
| LAB807_H66 | blueberry\|12v1\|CF810446_T1 | 5712 | 9977 | 653 | 80.09 | glotblastn |
| LAB807_H67 | dandelion\|10v1\|DR399867_T1 | 5713 | 9978 | 653 | 80.09 | glotblastn |
| LAB807_H68 | lettuce\|10v1\|DW051953 | 5714 | 9975 | 653 | 80.09 | glotblastn |
| LAB807_H69 | cucumber\|09v1\|BGI454H0035161_P1 | 5715 | 9979 | 653 | 80 | globlastp |
| LAB807_H70 | euphorbia\|11v1\|DV131535_P1 | 5716 | 9980 | 653 | 80 | globlastp |
| LAB807_H71 | gossypium_raimondii\|12v1\|AI054902_T1 | 5717 | 9981 | 653 | 80 | glotblastn |
| LAB807_H72 | liriodendron\|gb166\|CK759320_T1 | 5718 | 9982 | 653 | 80 | glotblastn |
| LAB807_H73 | olea\|11v1\|SRR014463.59571 | 5719 | 9983 | 653 | 80 | globlastp |
| LAB807_H74 | platanus\|11v1\|SRR096786X104408_P1 | 5720 | 9984 | 653 | 80 | globlastp |
| LAB807_H75 | triphysaria\|10v1\|EY129212 | 5721 | 9985 | 653 | 80 | glotblastn |
| LAB809_H1 | cowpea\|12v1\|FF387716_P1 | 5722 | 9986 | 654 | 88.4 | globlastp |
| LAB809_H1 | cowpea\|gb166\|FF387716 | 5723 | 9986 | 654 | 88.4 | globlastp |
| LAB810_H3 | cowpea\|12v1\|FF393926_P1 | 5724 | 9987 | 655 | 89.6 | globlastp |
| LAB810_H1 | pigeonpea\|11v1\|SRR054580X149151_P1 | 5725 | 9988 | 655 | 88.5 | globlastp |
| LAB810_H4 | bean\|12v2\|CB539392_P1 | 5726 | 9989 | 655 | 88.4 | globlastp |
| LAB810_H2 | bean\|12v1\|CB539392 | 5727 | 9989 | 655 | 88.4 | globlastp |
| LAB810_H3 | cowpea\|gb166\|FF393926 | 5728 | 9990 | 655 | 83 | globlastp |
| LAB811_H3 | bean\|12v2\|HO779763_P1 | 5729 | 9991 | 656 | 83.7 | globlastp |
| LAB811_H2 | pigeonpea\|11v1\|SRR054580X120722_P1 | 5730 | 9992 | 656 | 83.2 | globlastp |
| LAB813_H2 | flaveria\|11v1\|SRR149232.58694_P1 | 5731 | 9993 | 657 | 86.5 | globlastp |
| LAB813_H3 | arnica\|11v1\|SRR099034X150573_P1 | 5732 | 9994 | 657 | 85.7 | globlastp |
| LAB813_H4 | flaveria\|11v1\|SRR149229.127958_P1 | 5733 | 9995 | 657 | 85 | globlastp |
| LAB813_H6 | flaveria\|11v1\|SRR149229.231209_P1 | 5734 | 9996 | 657 | 83.5 | globlastp |
| LAB813_H7 | cynara\|gb167\|GE586857_P1 | 5735 | 9997 | 657 | 82.7 | globlastp |
| LAB813_H8 | gerbera\|09v1\|AJ759966_P1 | 5736 | 9998 | 657 | 81.2 | globlastp |
| LAB815_H1 | ambrosia\|11v1\|SRR346935.371050XX1_P1 | 5737 | 9999 | 659 | 87.3 | globlastp |
| LAB815_H2 | ambrosia\|11v1\|SRR346935.371050XX2_P1 | 5738 | 9999 | 659 | 87.3 | globlastp |
| LAB815_H3 | flaveria\|11v1\|SRR149229.130401_P1 | 5739 | 10000 | 659 | 86.2 | globlastp |
| LAB815_H4 | flaveria\|11v1\|SRR149232.147918_P1 | 5740 | 10001 | 659 | 84.1 | globlastp |
| LAB817_H1 | parthenium\|10v1\|GW778454_P1 | 5741 | 10002 | 661 | 94.8 | globlastp |
| LAB817_H2 | guizotia\|10v1\|GE568746_T1 | 5742 | 10003 | 661 | 89.01 | glotblastn |
| LAB817_H3 | flaveria\|11v1\|SRR149229.111492_P1 | 5743 | 10004 | 661 | 86 | globlastp |
| LAB817_H4 | ambrosia\|11v1\|SRR346935.155079_P1 | 5744 | 10005 | 661 | 85.2 | globlastp |
| LAB820_H1 | ambrosia\|11v1\|SRR346935.102627XX2_P1 | 5745 | 10006 | 662 | 94.7 | globlastp |
| LAB820_H2 | ambrosia\|11v1\|SRR346935.102627XX1_P1 | 5746 | 10007 | 662 | 94.5 | globlastp |
| LAB820_H3 | arnica\|11v1\|SRR099034X107213_P1 | 5747 | 10008 | 662 | 92.8 | globlastp |
| LAB820_H4 | flaveria\|11v1\|SRR149232.208106_T1 | 5748 | 10009 | 662 | 91.87 | glotblastn |
| LAB820_H5 | flaveria\|11v1\|SRR149241.258488_P1 | 5749 | 10010 | 662 | 91.3 | globlastp |
| LAB820_H6 | flaveria\|11v1\|SRR149229.110735_P1 | 5750 | 10011 | 662 | 90.3 | globlastp |
| LAB820_H7 | cynara\|gb167\|GE580304_T1 | 5751 | 10012 | 662 | 88.14 | glotblastn |
| LAB820_H15 | lettuce\|12v1\|DW056285_P1 | 5752 | 10013 | 662 | 87.7 | globlastp |
| LAB820_H8 | centaurea\|gb166\|EH717678_P1 | 5753 | 10014 | 662 | 87.2 | globlastp |
| LAB820_H9 | cirsium\|11v1\|SRR346952.111862_P1 | 5754 | 10015 | 662 | 86.1 | globlastp |
| LAB820_H10 | cirsium\|11v1\|SRR346952.1094403_P1 | 5755 | 10016 | 662 | 85.2 | globlastp |
| LAB820_H11 | conyza\|10v1\|SRR035294S0002216_P1 | 5756 | 10017 | 662 | 85 | globlastp |
| LAB820_H12 | artemisia\|10v1\|EY072500_P1 | 5757 | 10018 | 662 | 83.8 | globlastp |
| LAB820_H13 | safflower\|gb162\|EL378890 | 5758 | 10019 | 662 | 82.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB820_H14 | cirsium|11v1|SRR346952.154085_P1 | 5759 | 10020 | 662 | 81.5 | globlastp |
| LAB824_H1 | potato|10v1|BE924463_P1 | 5760 | 10021 | 665 | 95.4 | globlastp |
| LAB824_H2 | solanum_phureja|09v1|SPHAI773686 | 5761 | 10022 | 665 | 95.1 | globlastp |
| LAB824_H3 | tobacco|gb162|CV018980 | 5762 | 10023 | 665 | 89.5 | globlastp |
| LAB824_H19 | nicotiana_benthamiana|12v1|EB425396_P1 | 5763 | 10024 | 665 | 88.8 | globlastp |
| LAB824_H20 | nicotiana_benthamiana|12v1|EB443773_P1 | 5764 | 10025 | 665 | 88.1 | globlastp |
| LAB824_H4 | tomato|11v1|AI484585 | 5765 | 10026 | 665 | 88.1 | globlastp |
| LAB824_H21 | pepper|12v1|CF270167_P1 | 5766 | 10027 | 665 | 87.4 | globlastp |
| LAB824_H5 | pepper|gb171|CF270167 | 5767 | 10028 | 665 | 87.4 | globlastp |
| LAB824_H6 | solanum_phureja|09v1|SPHAI484585 | 5768 | 10029 | 665 | 87.1 | globlastp |
| LAB824_H7 | catharanthus|11v1|SRR098691X111577XX2_P1 | 5769 | 10030 | 665 | 86.7 | globlastp |
| LAB824_H22 | nicotiana_benthamiana|12v1|FS406104_P1 | 5770 | 10031 | 665 | 86 | globlastp |
| LAB824_H23 | sesame|12v1|BU670215_P1 | 5771 | 10032 | 665 | 84.3 | globlastp |
| LAB824_H8 | monkeyflower|10v1|CV515460 | 5772 | 10033 | 665 | 83.9 | globlastp |
| LAB824_H8 | monkeyflower|12v1|CV515460_P1 | 5773 | 10033 | 665 | 83.9 | globlastp |
| LAB824_H9 | monkeyflower|12v1|GO959178_P1 | 5774 | 10034 | 665 | 83.2 | globlastp |
| LAB824_H9 | monkeyflower|10v1|GO955986 | 5775 | 10035 | 665 | 82.8 | globlastp |
| LAB824_H10 | plantago|11v2|SRR066373X11857_P1 | 5776 | 10036 | 665 | 82.8 | globlastp |
| LAB824_H11 | fraxinus|11v1|SRR058827.100103_P1 | 5777 | 10037 | 665 | 82.5 | globlastp |
| LAB824_H12 | tabernaemontana|11v1|SRR098689X124168 | 5778 | 10038 | 665 | 82.5 | globlastp |
| LAB824_H13 | amsonia|11v1|SRR098688X106403_P1 | 5779 | 10039 | 665 | 82.1 | globlastp |
| LAB824_H14 | ipomoea_nil|10v1|CJ750973_P1 | 5780 | 10040 | 665 | 81.8 | globlastp |
| LAB824_H15 | monkeyflower|10v1|SRR037228S0189464 | 5781 | 10041 | 665 | 81.4 | glotblastn |
| LAB824_H16 | phyla|11v2|SRR099035X100790_T1 | 5782 | 10042 | 665 | 81.12 | glotblastn |
| LAB824_H17 | triphysaria|10v1|EX988972 | 5783 | 10043 | 665 | 81.1 | globlastp |
| LAB824_H18 | fraxinus|11v1|SRR058827.101599_P1 | 5784 | 10044 | 665 | 80.4 | globlastp |
| LAB824_H24 | blueberry|12v1|CF811616_P1 | 5785 | 10045 | 665 | 80 | globlastp |
| LAB825_H1 | solanum_phureja|09v1|SPHAI778113 | 5786 | 10046 | 666 | 92 | globlastp |
| LAB825_H2 | pepper|gb171|BM063860 | 5787 | 10047 | 666 | 85.6 | globlastp |
| LAB825_H3 | nicotiana_benthamiana|12v11EB692345_P1 | 5788 | 10048 | 666 | 84.3 | globlastp |
| LAB825_H4 | pepper|12v1|BM063860_P1 | 5789 | 10049 | 666 | 84 | globlastp |
| LAB827_H1 | potato|10v1|BF052863_P1 | 5790 | 10050 | 667 | 90.2 | globlastp |
| LAB827_H2 | solanum_phureja|09v1|SPHAW035009 | 5791 | 10051 | 667 | 84.9 | globlastp |
| LAB829_H1 | solanum_phureja|09v1|SPHAW217661 | 5792 | 10052 | 668 | 99 | globlastp |
| LAB829_H2 | tobacco|gb162|DQ340760 | 5793 | 10053 | 668 | 90.8 | globlastp |
| LAB829_H7 | nicotiana_benthamiana|12v11DQ340760_P1 | 5794 | 10054 | 668 | 86.8 | globlastp |
| LAB829_H3 | phyla|11v2|SRR099035X15924_T1 | 5795 | 10055 | 668 | 83.99 | glotblastn |
| LAB829_H8 | monkeyflower|12v1|CV518813_P1 | 5796 | 10056 | 668 | 82.6 | globlastp |
| LAB829_H4 | amsonia|11v1|SRR098688X102695_P1 | 5797 | 10057 | 668 | 81.5 | globlastp |
| LAB829_H5 | orobanche|10v1|SRR023189S0012386_P1 | 5798 | 10058 | 668 | 80.4 | globlastp |
| LAB829_H6 | tabernaemontana|11v1|SRR098689X121124 | 5799 | 10059 | 668 | 80.33 | glotblastn |
| LAB830_H1 | solanum_phureja|09v1|SPHAW615872 | 5800 | 10060 | 669 | 96 | globlastp |
| LAB830_H2 | nicotiana_benthamiana|12v1|BP134056_P1 | 5801 | 10061 | 669 | 89.7 | globlastp |
| LAB830_H3 | nicotiana_benthamiana|12v1|FG636634_P1 | 5802 | 10062 | 669 | 88.7 | globlastp |
| LAB831_H1 | potato|10v1|BG589440_P1 | 5803 | 10063 | 670 | 97.1 | globlastp |
| LAB831_H2 | solanum_phureja|09v1|SPHBG125080 | 5804 | 10064 | 670 | 96.6 | globlastp |
| LAB831_H9 | nicotiana_benthamiana|12v1|FS391047_P1 | 5805 | 10065 | 670 | 93.8 | globlastp |
| LAB831_H10 | nicotiana_benthamiana|12v1|CN747454_P1 | 5806 | 10066 | 670 | 93.3 | globlastp |
| LAB831_H3 | tobacco|gb162|CV018371 | 5807 | 10066 | 670 | 93.3 | globlastp |
| LAB831_H4 | eggplant|10v1|FS011292_P1 | 5808 | 10067 | 670 | 88.9 | globlastp |
| LAB831_H11 | pepper|12v1|DQ677335_P1 | 5809 | 10068 | 670 | 88.5 | globlastp |
| LAB831_H6 | tobacco|gb162|EB102915 | 5810 | 10069 | 670 | 86.1 | globlastp |
| LAB831_H7 | potato|10v1|BQ516860_P1 | 5811 | 10070 | 670 | 85.1 | globlastp |
| LAB831_H8 | solanum_phureja|09v1|SPHBQ516860 | 5812 | 10071 | 670 | 84.6 | globlastp |
| LAB832_H2 | potato|10v1|BF153848_T1 | 5813 | 10072 | 671 | 87.17 | glotblastn |
| LAB832_H1 | solanum_phureja|09v1|SPHBG125441 | 5814 | 10073 | 671 | 86.84 | glotblastn |
| LAB832_H3 | potato|10v1|BE922162_T1 | 5815 | 10074 | 671 | 86.52 | glotblastn |
| LAB832_H5 | potato|10v1|BE920375_T1 | 5816 | 10075 | 671 | 84.96 | glotblastn |
| LAB833_H1 | solanum_phureja|09v1|SPHBG126165 | 5817 | 10076 | 672 | 94.6 | globlastp |
| LAB833_H2 | nicotiana_benthamiana|12v1|DV999481_P1 | 5818 | 10077 | 672 | 83.7 | globlastp |
| LAB833_H3 | pepper|12v1|SRR203275X36332D1_P1 | 5819 | 10078 | 672 | 82 | globlastp |
| LAB834_H1 | solanum_phureja|09v1|SPHBG128255 | 5820 | 10079 | 673 | 92.6 | globlastp |
| LAB834_H2 | potato|10v1|BF053452_T1 | 5821 | 10080 | 673 | 83.62 | glotblastn |
| LAB834_H3 | eggplant|10v1|FS086065_T1 | 5822 | 10081 | 673 | 82.39 | glotblastn |
| LAB835_H1 | potato|10v1|BG597496_P1 | 5823 | 10082 | 674 | 97.9 | globlastp |
| LAB835_H2 | solanum_phureja|09v1|SPHBG128279 | 5824 | 10082 | 674 | 97.9 | globlastp |
| LAB835_H3 | eggplant|10v1|FS015792_P1 | 5825 | 10083 | 674 | 92.8 | globlastp |
| LAB835_H4 | tobacco|gb162|AJ717989 | 5826 | 10084 | 674 | 90.8 | globlastp |
| LAB835_H6 | nicotiana_benthamiana|12v1|BP750228_P1 | 5827 | 10085 | 674 | 90.3 | globlastp |
| LAB835_H5 | petunia|gb171|DY395411_P1 | 5828 | 10086 | 674 | 85.6 | globlastp |
| LAB836_H1 | potato|10v1|CK720403_P1 | 5829 | 10087 | 675 | 99.3 | globlastp |
| LAB836_H2 | solanum_phureja|09v1|SPHBG132326 | 5830 | 10087 | 675 | 99.3 | globlastp |
| LAB836_H3 | eggplant|10v1|FS003483_P1 | 5831 | 10088 | 675 | 97.8 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB836_H12 | pepper\|12v1\|BM062380_P1 | 5832 | 10089 | 675 | 96.3 | globlastp |
| LAB836_H4 | pepper\|gb171\|BM062380 | 5833 | 10089 | 675 | 96.3 | globlastp |
| LAB836_H13 | nicotiana_benthamiana\|12v1\|BP131040_P1 | 5834 | 10090 | 675 | 92.6 | globlastp |
| LAB836_H5 | tobacco\|gb162\|BP192508 | 5835 | 10091 | 675 | 91.9 | globlastp |
| LAB836_H14 | nicotiana_benthamiana\|12v1\|EB429839_P1 | 5836 | 10092 | 675 | 91.1 | globlastp |
| LAB836_H6 | petunia\|gb171\|FN008026_T1 | 5837 | 10093 | 675 | 89.71 | glotblastn |
| LAB836_H7 | ipomoea_nil\|10v1\|BJ574118_P1 | 5838 | 10094 | 675 | 83.7 | globlastp |
| LAB836_H8 | amsonia\|11v1\|SRR098688X159842_P1 | 5839 | 10095 | 675 | 82.2 | globlastp |
| LAB836_H9 | ipomoea_batatas\|10v1\|EE882586_P1 | 5840 | 10096 | 675 | 82.2 | globlastp |
| LAB836_H10 | catharanthus\|11v1\|SRR098691X209596XX2_T1 | 5841 | 10097 | 675 | 80.15 | glotblastn |
| LAB836_H11 | castorbean\|12v1\|XM_002519258_T1 | 5842 | 10098 | 675 | 80 | glotblastn |
| LAB837_H1 | potato\|10v1\|BF154003_P1 | 5843 | 10099 | 676 | 96 | globlastp |
| LAB837_H2 | solanum_phureja\|09v1\|SPHBG626094 | 5844 | 10099 | 676 | 96 | globlastp |
| LAB837_H5 | pepper\|12v1\|CA518431_P1 | 5845 | 10100 | 676 | 90.8 | globlastp |
| LAB837_H3 | pepper\|gb171\|CA518431 | 5846 | 10100 | 676 | 90.8 | globlastp |
| LAB837_H6 | nicotiana_benthamiana\|12v1\|EB695326_P1 | 5847 | 10101 | 676 | 89.6 | globlastp |
| LAB837_H7 | nicotiana_benthamiana\|12v1\|AF124370_P1 | 5848 | 10102 | 676 | 88.5 | globlastp |
| LAB837_H4 | solanum_phureja\|09v1\|SPHBF187055 | 5849 | 10103 | 676 | 81.7 | globlastp |
| LAB839_H1 | solanum_phureja\|09v1\|SPHBG629779 | 5850 | 10104 | 677 | 92.6 | globlastp |
| LAB839_H2 | potato\|10v1\|BQ509981_P1 | 5851 | 10105 | 677 | 92.3 | globlastp |
| LAB840_H1 | solanum_phureja\|09v1\|SPHAW092358 | 5852 | 10106 | 678 | 97.4 | globlastp |
| LAB840_H2 | potato\|10v1\|BQ515444_P1 | 5853 | 10107 | 678 | 91 | globlastp |
| LAB840_H4 | nicotiana_benthamiana\|12v1\|EB678287_P1 | 5854 | 10108 | 678 | 88.4 | globlastp |
| LAB840_H3 | tobacco\|gb162\|EB678029 | 5855 | 10109 | 678 | 82.5 | globlastp |
| LAB841_H1 | solanum_phureja\|09v1\|SPHBG734916 | 5856 | 10110 | 679 | 98.5 | globlastp |
| LAB841_H3 | pepper\|12v1\|CA521776_P1 | 5857 | 10111 | 679 | 92.6 | globlastp |
| LAB841_H2 | pepper\|gb171\|CA521776 | 5858 | 10111 | 679 | 92.6 | globlastp |
| LAB841_H4 | nicotiana_benthamiana\|12v1\|CK281783_P1 | 5859 | 10112 | 679 | 88.7 | globlastp |
| LAB842_H1 | potato\|10v1\|BQ512667_P1 | 5860 | 10113 | 680 | 96.9 | globlastp |
| LAB842_H2 | solanum_phureja\|09v1\|SPHBQ512667 | 5861 | 10114 | 680 | 95.4 | globlastp |
| LAB842_H3 | eggplant\|10v1\|FS052532_P1 | 5862 | 10115 | 680 | 90.8 | globlastp |
| LAB842_H10 | pepper\|12v1\|GD067875_P1 | 5863 | 10116 | 680 | 84.6 | globlastp |
| LAB842_H11 | nicotiana_benthamiana\|12v1\|EB695138_P1 | 5864 | 10117 | 680 | 83.8 | globlastp |
| LAB842_H12 | nicotiana_benthamiana\|12v1\|EB690970_T1 | 5865 | 10118 | 680 | 83.08 | glotblastn |
| LAB842_H4 | tobacco\|gb162\|EB432004 | 5866 | 10119 | 680 | 82.31 | glotblastn |
| LAB842_H5 | pepper\|gb171\|GD067875 | 5867 | 10120 | 680 | 81.5 | globlastp |
| LAB842_H13 | olea\|13v1\|SRR014463X38844D1_T1 | 5868 | 10121 | 680 | 80.77 | glotblastn |
| LAB842_H6 | grape\|11v1\|GSVIVT01028462001_T1 | 5869 | 10122 | 680 | 80.77 | glotblastn |
| LAB842_H7 | olea\|11v1\|SRR014464.23049 | 5870 | 10123 | 680 | 80.77 | glotblastn |
| LAB842_H8 | antirrhinum\|gb166\|AJ559242_T1 | 5871 | 10124 | 680 | 80 | glotblastn |
| LAB842_H9 | oak\|10v1\|FP050868_T1 | 5872 | 10125 | 680 | 80 | glotblastn |
| LAB843_H1 | solanum_phureja\|09v1\|SPHCO751611 | 5873 | 10126 | 681 | 96 | globlastp |
| LAB843_H2 | solanum_phureja\|09v1\|SPHAM908029_P1 | 5874 | 10127 | 681 | 80.3 | globlastp |
| LAB844_H5 | oat\|11v1\|GR358375_T1 | 5875 | 10128 | 682 | 85.78 | glotblastn |
| LAB844_H6 | rye\|12v1\|DRR001012.119017 | 5876 | 10129 | 682 | 85 | globlastp |
| LAB844_H15 | switchgrass\|12v1\|SRR187765.432740_P1 | 5877 | 10130 | 682 | 82.4 | globlastp |
| LAB845_H4 | wheat\|12v3\|BF201349_T1 | 5878 | 10131 | 683 | 96.97 | glotblastn |
| LAB845_H2 | oat\|11v1\|CN815375_T1 | 5879 | 10132 | 683 | 86.25 | glotblastn |
| LAB845_H3 | brachypodium\|12v1\|BRADI5G24290_P1 | 5880 | 10133 | 683 | 85.7 | globlastp |
| LAB847_H1 | rye\|12v1\|BE493992 | 5881 | 10134 | 684 | 96.5 | globlastp |
| LAB847_H2 | brachypodium\|12v1\|BRADI1G35477_P1 | 5882 | 10135 | 684 | 83.8 | globlastp |
| LAB850_H1 | rye\|12v1\|DRR001012.107924 | 5883 | 10136 | 687 | 98.5 | globlastp |
| LAB850_H6 | sorghum\|12v1\|SB07G023430 | 5884 | 10137 | 687 | 81.1 | globlastp |
| LAB621_H11 | wheat\|12v3\|BE638019_T1 | 5885 | 10138 | 691 | 97.23 | glotblastn |
| LAB621_H12 | wheat\|12v3\|CD918539_T1 | 5886 | 10139 | 691 | 97.23 | glotblastn |
| LAB621_H3 | rye\|12v1\|DRR001012.108778 | 5887 | 10140 | 691 | 96.44 | glotblastn |
| LAB621_H13 | switchgrass\|12v1\|FL697470_P1 | 5888 | 10141 | 691 | 83.4 | globlastp |
| LAB621_H5 | foxtail_millet\|11v3\|PHY7SI005901M_T1 | 5889 | 10142 | 691 | 83.4 | glotblastn |
| LAB621_H6 | sorghum\|12v1\|SB10G000870P1 | 5890 | 10143 | 691 | 83.4 | glotblastn |
| LAB621_H7 | switchgrass\|gb167\|FL697470 | 5891 | 10144 | 691 | 83.4 | glotblastn |
| LAB621_H8 | millet\|10v1\|EVO454PM019414_T1 | 5892 | 10145 | 691 | 83 | glotblastn |
| LAB621_H7 | switchgrass\|12v1\|FL802319_T1 | 5893 | 10146 | 691 | 82.21 | glotblastn |
| LAB621_H9 | maize\|10v1\|BG841651_T1 | 5894 | 10147 | 691 | 82.21 | glotblastn |
| LAB621_H10 | maize\|10v1\|AI586625_T1 | 5895 | 10148 | 691 | 81.82 | glotblastn |
| LAB621_H14 | switchgrass\|12v1\|GD006220_T1 | 5896 | 10149 | 691 | 81.5 | glotblastn |
| LAB621_H15 | switchgrass\|12v1\|FL821514_P1 | 5897 | 10150 | 691 | 81.4 | globlastp |
| LAB624_H1 | rye\|12v1\|DRR001012.115387 | 5898 | 10151 | 692 | 96.85 | glotblastn |
| LAB624_H2 | wheat\|10v2\|BE500006 | 5899 | 10152 | 692 | 96.85 | glotblastn |
| LAB627_H1 | rye\|12v1\|DRR001012.207497 | 5900 | 10153 | 693 | 99.38 | glotblastn |
| LAB627_H6 | switchgrass\|gb167\|FE614553 | 5901 | 10154 | 693 | 93.44 | glotblastn |
| LAB627_H8 | millet\|10v1\|EVO454PM030766_T1 | 5902 | 10155 | 693 | 93.12 | glotblastn |
| LAB627_H10 | rye\|12v1\|DRR001012.287479 | 5903 | 10156 | 693 | 88.8 | globlastp |
| LAB627_H32 | switchgrass\|12v1\|FE614553_P1 | 5904 | 10157 | 693 | 86.9 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB627_H13 | orange\|11v1\|CK701542_T1 | 5905 | 10158 | 693 | 82.24 | glotblastn |
| LAB627_H14 | poppy\|11v1\|SRR030259.150482_T1 | 5906 | 10159 | 693 | 82.24 | glotblastn |
| LAB627_H15 | poppy\|11v1\|FE966907_T1 | 5907 | 10160 | 693 | 81.93 | glotblastn |
| LYD577_H7 | eucalyptus\|11v2\|CD668107_T1 | 5908 | 10161 | 693 | 81.62 | glotblastn |
| LYD577_H13 | clementine\|11v1\|CK701542_T1 | 5909 | 10162 | 693 | 81.62 | glotblastn |
| LAB627_H16 | amsonia\|11v1\|SRR098688X103406_T1 | 5910 | 10163 | 693 | 81.56 | glotblastn |
| LAB627_H17 | solanum_phureja\|09v1\|SPHAW160103 | 5911 | 10164 | 693 | 81.56 | glotblastn |
| LAB627_H18 | tomato\|11v1\|AW160103 | 5912 | 10165 | 693 | 81.56 | glotblastn |
| LAB627_H19 | beet\|12v1\|BQ584887_T1 | 5913 | 10166 | 693 | 81 | glotblastn |
| LAB627_H20 | artemisia\|10v1\|EY073341_T1 | 5914 | 10167 | 693 | 80.69 | glotblastn |
| LAB627_H21 | cirsium\|11v1\|SRR346952.115416XX1JT1 | 5915 | 10168 | 693 | 80.69 | glotblastn |
| LAB627_H22 | euonymus\|11v1\|SRR070038X198354_T1 | 5916 | 10169 | 693 | 80.69 | glotblastn |
| LAB627_H23 | silene\|11v1\|SRR096785X103972 | 5917 | 10170 | 693 | 80.69 | glotblastn |
| LYD577_H14 | valeriana\|11v1\|SRR099039X110137 | 5918 | 10171 | 693 | 80.62 | glotblastn |
| LAB627_H24 | aristolochia\|10v1\|SRR039082S0042321_P1 | 5919 | 10172 | 693 | 80.4 | globlastp |
| LAB627_H25 | euonymus\|11v1\|SRR070038X108931_T1 | 5920 | 10173 | 693 | 80.37 | glotblastn |
| LAB627_H26 | sunflower\|12v1\|DY906340 | 5921 | 10174 | 693 | 80.37 | glotblastn |
| LAB627_H27 | thellungiella_parvulum\|11v1\|BY808300 | 5922 | 10175 | 693 | 80.37 | glotblastn |
| LYD577_H16 | thellungiella_halophilum\|11v1\|BY808300 | 5923 | 10176 | 693 | 80.37 | glotblastn |
| LAB627_H28 | ambrosia\|11v1\|SRR346935.10122_T1 | 5924 | 10177 | 693 | 80.06 | glotblastn |
| LAB627_H29 | fagopyrum\|11v1\|SRR063689X204788_T1 | 5925 | 10178 | 693 | 80.06 | glotblastn |
| LAB627_H30 | tripterygium\|11v1\|SRR098677X106452 | 5926 | 10179 | 693 | 80.06 | glotblastn |
| LYD577_H1 | soybean\|11v1\|GLYMA04G39980 | 5927 | 10180 | 693 | 80.06 | glotblastn |
| LYD577_H1 | soybean\|12v1\|GLYMA04G39980_T1 | 5928 | 10181 | 693 | 80.06 | glotblastn |
| LYD577_H5 | apple\|11v1\|CN911043_T1 | 5929 | 10182 | 693 | 80.06 | glotblastn |
| LAB627_H33 | nicotiana_benthamiana\|12v1\|EB691614_T1 | 5930 | 10183 | 693 | 80 | glotblastn |
| LAB627_H31 | vinca\|11v1\|SRR098690X120606 | 5931 | 10184 | 693 | 80 | glotblastn |
| LAB641_H6 | millet\|10v1\|EVO454PM016078_T1 | 5932 | 10185 | 694 | 85.86 | glotblastn |
| LAB641_H22 | wheat\|12v3\|CA677082_P1 | 5933 | 10186 | 694 | 84.8 | globlastp |
| LAB641_H9 | sugarcane\|10v1\|CA080518 | 5934 | 10187 | 694 | 82.2 | globlastp |
| LAB641_H23 | switchgrass\|12v1\|FL754120_T1 | 5935 | 10188 | 694 | 81.44 | glotblastn |
| LAB641_H11 | millet\|10v1\|EVO454PM010906_T1 | 5936 | 10189 | 694 | 81.44 | glotblastn |
| LAB641_H24 | switchgrass\|12v1\|FL710156_T1 | 5937 | 10190 | 694 | 81.19 | glotblastn |
| LAB641_H12 | sugarcane\|10v1\|CA078774 | 5938 | 10191 | 694 | 80.94 | glotblastn |
| LAB641_H13 | switchgrass\|gb167\|FL710156 | 5939 | 10192 | 694 | 80.94 | glotblastn |
| LAB641_H16 | barley\|10v2\|BG417194 | 5940 | 10193 | 694 | 80.15 | glotblastn |
| LAB641_H16 | barley\|12v1\|BG417194_T1 | 5941 | 10194 | 694 | 80.15 | glotblastn |
| LAB644_H3 | wheat\|12v3\|GH725267_T1 | 5942 | 10195 | 695 | 86.97 | glotblastn |
| LAB644_H1 | rye\|12v1\|DRR001012.45195 | 5943 | 10196 | 695 | 86.55 | glotblastn |
| LAB644_H4 | wheat\|12v3\|SRR400828X433857D1_P1 | 5944 | 10197 | 695 | 85.7 | globlastp |
| LAB644_H2 | rye\|12v1\|BE637332 | 5945 | 10198 | 695 | 83.61 | glotblastn |
| LAB645_H1 | wheat\|10v2\|BE400082 | 5946 | 10199 | 696 | 85.31 | glotblastn |
| LAB645_H1 | wheat\|12v3\|BE400082_T1 | 5947 | 10200 | 696 | 85.31 | glotblastn |
| LAB645_H2 | rye\|12v1\|DRR001012.27223 | 5948 | 10201 | 696 | 83.41 | glotblastn |
| LAB647_H1 | rye\|12v1\|DRR001012.248065 | 5949 | 10202 | 697 | 97.75 | glotblastn |
| LAB647_H2 | brachypodium\|12v1\|BRADI2G02320_T1 | 5950 | 10203 | 697 | 91.01 | glotblastn |
| LAB647_H3 | rice\|11v1\|BI805418 | 5951 | 10204 | 697 | 85.39 | glotblastn |
| LAB647_H4 | foxtail_millet\|11v3\|PHY7SI000630M_T1 | 5952 | 10205 | 697 | 84.27 | glotblastn |
| LAB647_H5 | millet\|10v1\|PMSLX0290525_T1 | 5953 | 10206 | 697 | 84.27 | glotblastn |
| LAB647_H8 | switchgrass\|12v1\|FE639638_T1 | 5954 | 10207 | 697 | 83.15 | glotblastn |
| LAB647_H6 | switchgrass\|gb167\|FE639637 | 5955 | 10208 | 697 | 83.15 | glotblastn |
| LAB647_H6 | switchgrass\|12v1\|FL746877_T1 | 5956 | 10209 | 697 | 82.02 | glotblastn |
| LAB647_H7 | sorghum\|12v1\|SB03G006950 | 5957 | 10210 | 697 | 82.02 | glotblastn |
| LAB676_H1 | sorghum\|12v1\|SB01G034220 | 5958 | 10211 | 699 | 89.6 | globlastp |
| LAB676_H2 | foxtail_millet\|11v3\|PHY7SI036429M_P1 | 5959 | 10212 | 699 | 86.8 | globlastp |
| LAB676_H4 | millet\|10v1\|EVO454PM003738_P1 | 5960 | 10213 | 699 | 83.1 | globlastp |
| LAB711_H1 | sugarcane\|10v1\|CA071910 | 5961 | 10214 | 700 | 88.26 | glotblastn |
| LAB773_H1 | maize\|10v1\|AI629496_P1 | 5962 | 10215 | 704 | 93.4 | globlastp |
| LAB773_H2 | foxtail_millet\|11v3\|PHY7SI016120M_P1 | 5963 | 10216 | 704 | 88.6 | globlastp |
| LAB821_H1 | ambrosia\|11v1\|SRR346935.101779_P1 | 5964 | 10217 | 707 | 93.9 | globlastp |
| LAB821_H2 | flaveria\|11v1\|SRR149232.116790_T1 | 5965 | 10218 | 707 | 85.47 | globlastp |
| LAB821_H7 | lettuce\|12v1\|DW045432_P1 | 5966 | 10219 | 707 | 84.5 | globlastp |
| LAB821_H3 | artemisia\|10v1\|EY110784_T1 | 5967 | 10220 | 707 | 83.72 | glotblastn |
| LAB821_H4 | cirsium\|11v1\|SRR346952.1172833_T1 | 5968 | 10221 | 707 | 82.16 | glotblastn |
| LAB821_H5 | cirsium\|11v1\|SRR346952.221629_T1 | 5969 | 10222 | 707 | 82.16 | glotblastn |
| LAB821_H6 | flaveria\|11v1\|SRR149229.280972_P1 | 5970 | 10223 | 707 | 81.5 | globlastp |
| LAB843_H3 | nicotiana_benthamiana\|12v1\|BP748932_P1 | 5971 | 10224 | 709 | 90 | globlastp |
| LAB848, LAB848_H4, LAB848_H8 | wheat\|12v3\|BE401010_P1 | 5972 | 10225 | 710 | 96.3 | globlastp |
| LAB848_H1 | rye\|12v1\|DRR001012.562753 | 5973 | 10226 | 710 | 95.6 | globlastp |
| LAB848_H2 | rye\|12v1\|DRR001012.507278 | 5974 | 10227 | 710 | 94.9 | globlastp |
| LAB848_H3 | rye\|12v1\|DRR001016.182526 | 5975 | 10228 | 710 | 93.4 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB850_H8 | barley|12v1|BE214655_T1 | 5976 | 10229 | 711 | 98.38 | glotblastn |
| LAB850_H2 | brachypodium|12v1|BRADI3G12830T2_T1 | 5977 | 10230 | 711 | 93.52 | glotblastn |
| LAB850_H3 | oat|11v1|GR341709_T1 | 5978 | 10231 | 711 | 91.53 | glotblastn |
| LAB850_H5 | switchgrass|gb167|FL703371 | 5979 | 10232 | 711 | 89.47 | glotblastn |
| LAB850_H9 | switchgrass|12v1|FL703371_T1 | 5980 | 10233 | 711 | 88.8 | glotblastn |
| LAB850_H7 | maize|10v1|AI629577_T1 | 5981 | 10234 | 711 | 86 | glotblastn |
| LAB619_H1 | arabidopsis_lyrata|09v1|JGIAL024115_P1 | 5982 | 10235 | 712 | 96.5 | globlastp |
| LAB619_H2 | thellungiella_parvulum|11v1|DN773103 | 5983 | 10236 | 712 | 89.8 | globlastp |
| LAB619_H3 | thellungiella_halophilum|11v1|DN773103 | 5984 | 10237 | 712 | 88.7 | globlastp |
| LAB622_H1 | rye|12v1|DRR001012.343588 | 5985 | 10238 | 713 | 98 | globlastp |
| LAB622_H2 | rye|12v1|DRR001012.34592 | 5986 | 10239 | 713 | 97.64 | glotblastn |
| LAB622_H3 | wheat|10v2|BE424934 | 5987 | 10240 | 713 | 97.2 | globlastp |
| LAB622_H3 | wheat|12v3|BE424934_P1 | 5988 | 10240 | 713 | 97.2 | globlastp |
| LAB622_H4 | pseudoroegneria|gb167|FF349085 | 5989 | 10241 | 713 | 95.74 | glotblastn |
| LAB622_H5 | leymus|gb166|EG384339_P1 | 5990 | 10242 | 713 | 95.7 | globlastp |
| LAB622_H6 | oat|11v1|GO593206_P1 | 5991 | 10243 | 713 | 93.7 | globlastp |
| LAB622_H7 | brachypodium|12v1|BRADI5G01430_P1 | 5992 | 10244 | 713 | 88.9 | globlastp |
| LAB622_H9 | rye|12v1|DRR001013.143989 | 5993 | 10245 | 713 | 83.33 | glotblastn |
| LAB627_H34 | wheat|12v3|BJ269172_P1 | 5994 | 10246 | 714 | 99.3 | globlastp |
| LAB627_H2 | wheat|10v2|BM136409 | 5995 | 10247 | 714 | 99.3 | globlastp |
| LAB627_H3 | brachypodium|12v1|BRADI1G76480_P1 | 5996 | 10248 | 714 | 96.4 | globlastp |
| LAB627_H4 | sorghum|12v1|SB01G048480 | 5997 | 10249 | 714 | 92 | globlastp |
| LAB627_H5 | rice|11v1|AU068209 | 5998 | 10250 | 714 | 91.6 | globlastp |
| LAB627_H9 | foxtail_millet|11v3|PHY7SI034117M_P1 | 5999 | 10251 | 714 | 91.2 | globlastp |
| LAB627_H7 | maize|10v1|AI966896_P1 | 6000 | 10252 | 714 | 91.1 | globlastp |
| LAB627_H11 | oil_palm|11v1|EY396859_P1 | 6001 | 10253 | 714 | 84 | globlastp |
| LAB627_H35 | barley|12v1|BLYBJ_P1 | 6002 | 10254 | 714 | 83.3 | globlastp |
| LAB627_H36 | banana|12v1|MAGEN2012003843_P1 | 6003 | 10255 | 714 | 81.5 | globlastp |
| LYD577_H11 | aquilegia|10v2|DR932473_P1 | 6004 | 10256 | 714 | 81 | globlastp |
| LAB627_H12 | phalaenopsis|11v1|SRR125771.1005010_P1 | 6005 | 10257 | 714 | 80.9 | globlastp |
| LYD577_H4 | grape|11v1|GSVIVT01022300001_P1 | 6006 | 10258 | 714 | 80.3 | globlastp |
| LAB639_H6 | wheat|12v3|CA606398_P1 | 6007 | 10259 | 716 | 93.8 | globlastp |
| LAB639_H1 | wheat|10v2|BE499292 | 6008 | 10260 | 716 | 92.48 | glotblastn |
| LAB639_H2 | rye|12v1|DRR001012.193437 | 6009 | 10261 | 716 | 90.85 | glotblastn |
| LAB639_H3 | brachypodium|12v1|BRADI2G28000_P1 | 6010 | 10262 | 716 | 84.3 | globlastp |
| LAB639_H5 | rye|12v1|DRR001012.345503 | 6011 | 10263 | 716 | 83.3 | globlastp |
| LAB651_H4 | maize|10v1|AI861682_P1 | 6012 | 10264 | 720 | 82.9 | globlastp |
| LAB656_H2 | switchgrass|12v1|FL745052_P1 | 6013 | 10265 | 721 | 91.8 | globlastp |
| LAB656_H1 | maize|10v1|AW231879_P1 | 6014 | 10266 | 721 | 84.9 | globlastp |
| LAB656_H3 | maize|10v1|AI974917_T1 | 6015 | 10267 | 721 | 80.89 | glotblastn |
| LAB680_H1 | switchgrass|gb167|DN142749 | 6016 | 10268 | 725 | 96.6 | globlastp |
| LAB680_H2 | sugarcane|10v1|CA082081 | 6017 | 10269 | 725 | 96.3 | globlastp |
| LAB680_H3 | maize|10v1|AI973393_P1 | 6018 | 10270 | 725 | 96 | globlastp |
| LAB680_H4 | foxtail_millet|11v3|PHY7SI017764M_P1 | 6019 | 10271 | 725 | 95.7 | globlastp |
| LAB680_H5 | millet|10v1|EVO454PM018261_P1 | 6020 | 10272 | 725 | 95.1 | globlastp |
| LAB680_H6 | sorghum|12v1|SB04G029970 | 6021 | 10273 | 725 | 94.3 | globlastp |
| LAB680_H8 | brachypodium|12v1|BRADI3G53290_P1 | 6022 | 10274 | 725 | 90.5 | globlastp |
| LAB680_H9 | cenchrus|gb166|EB652422_P1 | 6023 | 10275 | 725 | 89.2 | globlastp |
| LAB680_H10 | leymus|gb166|EG375031_P1 | 6024 | 10276 | 725 | 87.5 | globlastp |
| LAB680_H11 | barley|10v2|BE411574 | 6025 | 10277 | 725 | 87.2 | globlastp |
| LAB680_H12 | wheat|10v2|BE428977 | 6026 | 10278 | 725 | 87 | globlastp |
| LAB680_H12 | wheat|12v3|BE637717_P1 | 6027 | 10278 | 725 | 87 | globlastp |
| LAB680_H11 | barley|12v1|BE411574_P1 | 6028 | 10279 | 725 | 86.9 | globlastp |
| LAB680_H13 | rye|12v1|DRR001012.106309 | 6029 | 10280 | 725 | 86.4 | globlastp |
| LAB680_H19 | switchgrass|12v1|DN142749_P1 | 6030 | 10281 | 725 | 84.3 | globlastp |
| LAB680_H15 | ginger|gb164|DY377432_P1 | 6031 | 10282 | 725 | 83.1 | globlastp |
| LAB680_H20 | banana|12v1|MAGEN2012012892_P1 | 6032 | 10283 | 725 | 82.8 | globlastp |
| LAB680_H21 | switchgrass|12v1|FE603214_T1 | 6033 | 10284 | 725 | 80.92 | glotblastn |
| LAB681_H18 | banana|12v1|MAGEN2012033734_P1 | 6034 | 10285 | 726 | 80 | globlastp |
| LAB691_H1 | sorghum|12v1|SB08G016990 | 6035 | 10286 | 730 | 87.9 | globlastp |
| LAB691_H2 | sugarcane|10v1|CA078344 | 6036 | 10287 | 730 | 87.1 | globlastp |
| LAB707_H1 | sorghum|12v1|SB03G029230 | 6037 | 10288 | 735 | 96.8 | globlastp |
| LAB707_H2 | foxtail_millet|11v3|PHY7SI001649M_P1 | 6038 | 10289 | 735 | 88.4 | globlastp |
| LAB707_H4 | rice|11v1|CF277431 | 6039 | 10290 | 735 | 83.5 | globlastp |
| LAB710_H1 | sorghum|12v1|SB06G017090 | 6040 | 10291 | 736 | 87.6 | globlastp |
| LAB713_H2 | sorghum|12v1|SB02G041680 | 6041 | 10292 | 737 | 82.6 | globlastp |
| LAB727_H11 | switchgrass|12v1|FL978719_P1 | 6042 | 10293 | 741 | 87.4 | globlastp |
| LAB727_H2 | wheat|10v2|CA729536 | 6043 | 10294 | 741 | 85.2 | globlastp |
| LAB727_H4 | millet|10v1|EVO454PM029944_P1 | 6044 | 10295 | 741 | 85 | globlastp |
| LAB727_H5 | brachypodium|12v1|BRADI2G62280_P1 | 6045 | 10296 | 741 | 84.8 | globlastp |
| LAB727_H6 | sorghum|12v1|SB03G047400 | 6046 | 10297 | 741 | 84.5 | globlastp |
| LAB727_H7 | wheat|10v2|BE415712 | 6047 | 10298 | 741 | 84.4 | globlastp |
| LAB727_H7 | wheat|12v3|BE415712_P1 | 6048 | 10298 | 741 | 84.4 | globlastp |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB727_H8 | barley|10v2|BF623281 | 6049 | 10299 | 741 | 84.1 | globlastp |
| LAB727_H8 | barley|12v1|BF623281_P1 | 6050 | 10299 | 741 | 84.1 | globlastp |
| LAB727_H9 | rye|12v1|DRR001012.128753 | 6051 | 10300 | 741 | 84.1 | globlastp |
| LAB727_H10 | rye|12v1|DRR001012.206796 | 6052 | 10301 | 741 | 82.1 | globlastp |
| LAB736_H466 | cowpea|12v1|FF383571_P1 | 6053 | 10302 | 743 | 85.2 | globlastp |
| LAB736_H467 | flaveria|11v1|SRR149229.136186_P1 | 6054 | 10303 | 743 | 83.5 | globlastp |
| LAB736_H468 | potato|10v1|AJ489132_P1 | 6055 | 10304 | 743 | 82 | globlastp |
| LAB736_H469 | tomato|11v1|BG131735_P1 | 6056 | 10304 | 743 | 82 | globlastp |
| LAB736_H470 | pepper|12v1|CA516335_P1 | 6057 | 10305 | 743 | 80.5 | globlastp |
| LAB736_H471 | marchantia|gb166|AU081872_P1 | 6058 | 10306 | 743 | 80.3 | globlastp |
| LAB742_H1 | maize|10v1|AI947648_P1 | 6059 | 10307 | 744 | 88.1 | globlastp |
| LAB742_H2 | maize|10v1|BG320342_T1 | 6060 | 10308 | 744 | 85.27 | glotblastn |
| LAB742_H4 | switchgrass|12v1|FL874193_P1 | 6061 | 10309 | 744 | 82.1 | globlastp |
| LAB742_H3 | foxtail_millet|11v3|PHY7SI009776M_P1 | 6062 | 10310 | 744 | 81.6 | globlastp |
| LAB749_H1 | maize|10v1|BI361262_P1 | 6063 | 10311 | 745 | 84.7 | globlastp |
| LAB749_H3 | switchgrass|12v1|SRR187766.246857_P1 | 6064 | 10312 | 745 | 81.7 | globlastp |
| LAB750_H1 | foxtail_millet|11v3|PHY7SI036012M_P1 | 6065 | 10313 | 746 | 88 | globlastp |
| LAB750_H2 | maize|10v1|AI861360_P1 | 6066 | 10314 | 746 | 87.5 | globlastp |
| LAB750_H5 | switchgrass|12v1|FE618981_P1 | 6067 | 10315 | 746 | 87.2 | globlastp |
| LAB750_H4 | foxtail_millet|11v3|PHY7SI035943M_P1 | 6068 | 10316 | 746 | 83 | globlastp |
| LAB750_H5 | switchgrass|gb167|FE618981 | 6069 | 10317 | 746 | 82.8 | globlastp |
| LAB750_H6 | brachypodium|12v1|BRADI3G20810_P1 | 6070 | 10318 | 746 | 82.3 | globlastp |
| LAB750_H7 | pseudoroegneria|gb167|FF342468 | 6071 | 10319 | 746 | 81.8 | globlastp |
| LAB750_H8 | barley|10v2|AV833391 | 6072 | 10320 | 746 | 81.5 | globlastp |
| LAB750_H9 | sorghum|12v1|SB01G025580 | 6073 | 10321 | 746 | 81.2 | globlastp |
| LAB750_H13, LAB750_H14 | wheat|12v3|BQ578674_P1 | 6074 | 10322 | 746 | 81.2 | globlastp |
| LAB750_H18 | wheat|12v3|CA610088_P1 | 6075 | 10323 | 746 | 81 | globlastp |
| LAB750_H10 | rye|12v1|BE586383 | 6076 | 10324 | 746 | 81 | globlastp |
| LAB750_H11 | rye|12v1|DRR001012.193313 | 6077 | 10325 | 746 | 80.75 | glotblastn |
| LAB750_H19 | wheat|12v3|CA598769_P1 | 6078 | 10326 | 746 | 80.5 | globlastp |
| LAB750_H12 | rye|12v1|DRR001014.529135 | 6079 | 10327 | 746 | 80.5 | globlastp |
| LAB750_H13 | wheat|10v2|BG908748XX2 | 6080 | 10328 | 746 | 80.5 | globlastp |
| LAB750_H14 | wheat|10v2|BQ578674 | 6081 | 10329 | 746 | 80.5 | globlastp |
| LAB750_H15 | rice|11v1|U38132 | 6082 | 10330 | 746 | 80.4 | globlastp |
| LAB750_H16 | leymus|gb166|EG394412_P1 | 6083 | 10331 | 746 | 80.2 | globlastp |
| LAB750_H17 | rye|12v1|DRR001014.492971 | 6084 | 10332 | 746 | 80.2 | globlastp |
| LAB751_H1 | foxtail_millet|11v3|PHY7SI035965M_P1 | 6085 | 10333 | 747 | 86.9 | globlastp |
| LAB751_H2 | foxtail_millet|11v3|SICRP057625_P1 | 6086 | 10333 | 747 | 86.9 | globlastp |
| LAB751_H3 | maize|10v1|CD439407_P1 | 6087 | 10334 | 747 | 85.2 | globlastp |
| LAB751_H4 | switchgrass|12v1|FE619135_P1 | 6088 | 10335 | 747 | 80 | globlastp |
| LAB753_H1 | maize|10v1|AW927437_P1 | 6089 | 10336 | 748 | 84.3 | globlastp |
| LAB754_H1 | maize|10v1|CX129591_T1 | 6090 | 10337 | 749 | 86.3 | glotblastn |
| LAB757_H2 | foxtail_millet|11v3|PHY7SI030463M_P1 | 6091 | 10338 | 750 | 88 | globlastp |
| LAB757_H3 | rice|11v1|CI075004 | 6092 | 10339 | 750 | 85.3 | globlastp |
| LAB757_H5 | barley|12v1|BQ471173_P1 | 6093 | 10340 | 750 | 82 | globlastp |
| LAB764_H23 | barley|12v1|BG368747_P1 | 6094 | 10341 | 751 | 84.3 | globlastp |
| LAB764_H18 | wheat|12v3|BQ903096_P1 | 6095 | 10342 | 751 | 83.4 | globlastp |
| LAB764_H18 | wheat|10v2|BQ903096 | 6096 | 10343 | 751 | 80.28 | glotblastn |
| LAB789_H1 | maize|10v1|AW061708_P1 | 6097 | 10344 | 752 | 95.8 | globlastp |
| LAB789_H2 | foxtail_millet|11v3|PHY7SI009435M_P1 | 6098 | 10345 | 752 | 90.7 | globlastp |
| LAB789_H3 | brachypodium|12v1|BRADI4G41137_P1 | 6099 | 10346 | 752 | 85.1 | globlastp |
| LAB789_H5 | wheat|12v3|BE400988_P1 | 6100 | 10347 | 752 | 83.6 | globlastp |
| LAB789_H4 | rice|11v1|BM421752 | 6101 | 10348 | 752 | 83.51 | glotblastn |
| LAB790_H1 | sugarcane|10v1|CA275434 | 6102 | 10349 | 753 | 82 | globlastp |
| LAB809_H1 | pigeonpea|11v1|SRR054580X171437_P1 | 6103 | 10350 | 754 | 88.4 | globlastp |
| LAB809_H5 | bean|12v2|FE898175_P1 | 6104 | 10351 | 754 | 85.8 | globlastp |
| LAB809_H3 | bean|12v1|FE898175 | 6105 | 10351 | 754 | 85.8 | globlastp |
| LAB809_H4 | pigeonpea|11v1|SRR054580X112350_P1 | 6106 | 10352 | 754 | 84.1 | globlastp |
| LAB809_H6 | medicago|12v1|AW288006_T1 | 6107 | 10353 | 754 | 80.09 | glotblastn |
| LAB813_H1 | sunflower|12v1|CF084564 | 6108 | — | 755 | 98.46 | glotblastn |
| LAB813_H5 | flaveria|11v1|SRR149239.6193_P1 | 6109 | 10354 | 755 | 85.5 | globlastp |
| LAB813_H9 | ambrosia|11v1|SRR346943.103968_T1 | 6110 | 10355 | 755 | 81.2 | glotblastn |
| LAB813_H10 | lettuce|10v1|DW057004 | 6111 | 10356 | 755 | 80.5 | globlastp |
| LAB814_H1 | ambrosia|11v1|SRR346935.147078_P1 | 6112 | 10357 | 756 | 96.3 | globlastp |
| LAB814_H2 | flaveria|11v1|SRR149229.104448_P1 | 6113 | 10358 | 756 | 92 | globlastp |
| LAB814_H3 | cirsium|11v1|SRR346952.135881XX1_P1 | 6114 | 10359 | 756 | 86.9 | globlastp |
| LAB814_H4 | cirsium|11v1|SRR346952.1008592_P1 | 6115 | 10360 | 756 | 86.7 | globlastp |
| LAB814_H5 | centaurea|gb166|EH721858_P1 | 6116 | 10361 | 756 | 86.4 | globlastp |
| LAB814_H6 | arnica|11v1|SRR099034X13953_P1 | 6117 | 10362 | 756 | 85.5 | globlastp |
| LAB814_H8 | artemisia|10v1|EY087660_P1 | 6118 | 10363 | 756 | 85.3 | globlastp |
| LAB814_H7 | ambrosia|11v1|SRR346935.35133_T1 | 6119 | 10364 | 756 | 85.06 | glotblastn |
| LAB814_H9 | sunflower|12v1|DY904337 | 6120 | 10365 | 756 | 81.29 | glotblastn |

TABLE 152-continued

Homologues of the identified genes/polypeptides for increasing abiotic stress tolerance, water use efficiency, yield, growth rate, vigor, oil content, biomass, growth rate, nitrogen use efficiency and fertilizer use efficiency of a plant

| Homologue Name | Cluster name | Polyn. SEQ ID NO: | Polyp. SEQ ID NO: | Hom. to SEQ ID NO: | % Glob. Ident. | Algor. |
|---|---|---|---|---|---|---|
| LAB814_H10 | cichorium\|gb171\|EH673207_T1 | 6121 | 10366 | 756 | 80.76 | glotblastn |
| LAB814_H11 | flaveria\|11v1\|SRR149229.114421_T1 | 6122 | 10367 | 756 | 80.53 | glotblastn |
| LAB814_H12 | flaveria\|11v1\|SRR149229.334922_T1 | 6123 | 10368 | 756 | 80.35 | glotblastn |
| LAB816_H1 | sunflower\|12v1\|EE616901 | 6124 | 10369 | 757 | 99.3 | globlastp |
| LAB816_H2 | sunflower\|12v1\|EL413033 | 6125 | 10370 | 757 | 95.6 | globlastp |
| LAB816_H3 | ambrosia\|11v1\|SRR346935.154181_T1 | 6126 | 10371 | 757 | 86.54 | glotblastn |
| LAB816_H4 | ambrosia\|11v1\|SRR346935.133162_T1 | 6127 | 10372 | 757 | 85.15 | glotblastn |
| LAB816_H6 | flaveria\|11v1\|SRR149232.324073_P1 | 6128 | 10373 | 757 | 84.5 | globlastp |
| LAB816_H5 | ambrosia\|11v1\|SRR346935.186086_T1 | 6129 | 10374 | 757 | 84.49 | glotblastn |
| LAB816_H7 | ambrosia\|11v1\|SRR346935.15882_T1 | 6130 | 10375 | 757 | 80.65 | glotblastn |
| LAB823_H1 | ambrosia\|11v1\|SRR346935.111608_T1 | 6131 | 10376 | 760 | 84.13 | glotblastn |
| LAB832_H4 | solanum_phureja\|09v1\|SPHBG132941 | 6132 | 10377 | 762 | 87.5 | globlastp |
| LAB832_H6 | eggplant\|10v1\|FS008181_P1 | 6133 | 10378 | 762 | 85.3 | globlastp |
| LAB832_H7 | eggplant\|10v1\|FS031703_P1 | 6134 | 10379 | 762 | 84.5 | globlastp |
| LAB832_H8 | tobacco\|gb1621\|AJ632902_P1 | 6135 | 10380 | 762 | 81.4 | globlastp |
| LAB837_H8 | blueberry\|12v1\|SRR353282X2808D1_P1 | 6136 | 10381 | 763 | 80.7 | globlastp |
| LAB844_H1 | rye\|12v1\|DRR001012.234482 | 6137 | 10382 | 765 | 97.3 | globlastp |
| LAB844_H2 | barley\|10v2\|BI951883 | 6138 | 10383 | 765 | 95.6 | globlastp |
| LAB844_H2 | barley\|12v1\|BI946897_P1 | 6139 | 10383 | 765 | 95.6 | globlastp |
| LAB844_H3 | rye\|12v1\|BE586821 | 6140 | 10384 | 765 | 91.1 | globlastp |
| LAB844_H4 | pseudoroegneria\|gb167\|FF364452 | 6141 | 10385 | 765 | 86.7 | globlastp |
| LAB844_H8 | barley\|10v2\|BI947264 | 6142 | 10386 | 765 | 84.9 | globlastp |
| LAB844_H16 | barley\|12v1\|BI947264_P1 | 6143 | 10387 | 765 | 84.4 | globlastp |
| LAB844_H7 | millet\|10v1\|CD726687_P1 | 6144 | 10388 | 765 | 84.1 | globlastp |
| LAB844_H10 | wheat\|12v3\|BE401102_P1 | 6145 | 10389 | 765 | 84.1 | globlastp |
| LAB844_H9 | wheat\|10v2\|BE401102 | 6146 | 10390 | 765 | 83.6 | globlastp |
| LAB844_H10 | wheat\|10v2\|BG908694 | 6147 | 10391 | 765 | 82.74 | glotblastn |
| LAB844_H12 | sorghum\|12v1\|SB01G018490 | 6148 | 10392 | 765 | 82.3 | globlastp |
| LAB844_H13 | brachypodium\|12v1\|BRADI3G29710_P1 | 6149 | 10393 | 765 | 81.3 | globlastp |
| LAB844_H14 | maize\|10v1\|AW355832_P1 | 6150 | 10394 | 765 | 80.7 | globlastp |
| LAB844_H11 | foxtail_millet\|11v3\|PHY7SI039939M_P1 | 6151 | 10395 | 765 | 80.2 | globlastp |
| LAB845_H1 | barley\|10v2\|BE194359 | 6152 | 10396 | 766 | 92.8 | globlastp |
| LAB851, LAB845_H1 | barley\|12v1\|BE194359_P1 | 6153 | 10397 | 766 | 92.8 | globlastp |
| LAB852 | barley\|12v1\|AV836427_P1 | 6154 | 10398 | 767 | 95.4 | globlastp |
| LAB848_H4 | wheat\|10v2\|BE446148 | 6155 | 10399 | 768 | 94 | globlastp |
| LAB848_H5 | barley\|10v2\|BI954458 | 6156 | 10400 | 768 | 91 | globlastp |
| LAB848_H6 | barley\|10v2\|BF258149 | 6157 | 10401 | 768 | 90.4 | globlastp |
| LAB848_H7 | rye\|12v1\|DRR001012.120131 | 6158 | 10402 | 768 | 87.6 | globlastp |
| LAB848_H8 | wheat\|10v2\|BE401010 | 6159 | 10403 | 768 | 86.6 | globlastp |
| LAB848_H9 | oat\|11v1\|CN815872_P1 | 6160 | 10404 | 768 | 85.4 | globlastp |
| LAB848_H10 | oat\|11v1\|CN817079_P1 | 6161 | 10405 | 768 | 84.7 | globlastp |
| LAB848_H11 | brachypodium\|12v1\|BRADI3G42650_P1 | 6162 | 10406 | 768 | 83.2 | globlastp |
| LAB848_H12 | rice\|11v1\|AA749628_T1 | 6163 | — | 768 | 80.74 | glotblastn |
| LAB849 | wheat\|12v3\|BG604521_P1 | 6164 | 10407 | 769 | 98.7 | globlastp |
| LAB849_H9 | wheat\|12v3\|HX128100_P1 | 6165 | 10408 | 769 | 97 | globlastp |
| LAB849_H1 | barley\|12v1\|BJ478174_P1 | 6166 | 10409 | 769 | 95.4 | globlastp |
| LAB849_H1 | barley\|10v2\|BJ478174 | 6167 | 10410 | 769 | 94.7 | globlastp |
| LAB849_H2 | leymus\|gb166\|EG380222_P1 | 6168 | 10411 | 769 | 94.4 | globlastp |
| LAB849_H3 | brachypodium\|12v1\|BRADI1G52180_P1 | 6169 | 10412 | 769 | 89.1 | globlastp |
| LAB849_H4 | foxtail_millet\|11v3\|PHY7SI006989M_P1 | 6170 | 10413 | 769 | 86.4 | globlastp |
| LAB849_H5 | rice\|11v1\|CK034673 | 6171 | 10414 | 769 | 86.4 | globlastp |
| LAB849_H6 | sorghum\|12v1\|SB10G000450 | 6172 | 10415 | 769 | 85.1 | globlastp |
| LAB849_H7 | switchgrass\|12v1\|FL717341_P1 | 6173 | 10416 | 769 | 84.8 | globlastp |
| LAB849_H7 | switchgrass\|gb167\|FL717341 | 6174 | 10417 | 769 | 84.77 | glotblastn |
| LAB849_H8 | switchgrass\|gb167\|FE621912 | 6175 | 10418 | 769 | 84.44 | glotblastn |
| LAB849_H8 | switchgrass\|12v1\|FE621912_P1 | 6176 | 10419 | 769 | 84.4 | globlastp |
| LAB850_H5 | switchgrass\|12v1\|FE656940_P1 | 6177 | 10420 | 770 | 86.6 | globlastp |
| LAB850_H4 | foxtail_millet\|11v3\|PHY7SI013129M_P1 | 6178 | 10421 | 770 | 85.3 | globlastp |

Table 152: Provided are the homologous polypeptides (polyp.) and polynucleotides (polyn.) of the genes for increasing abiotic stress tolerance, yield, growth rate, vigor, oil content, fiber yield, fiber quality, biomass, nitrogen use efficiency, water use efficiency and fertilizer use efficiency genes of a plant which are listed in Table 151 above. Homology was calculated as % of identity over the aligned sequences. The query sequences were polynucleotide and polypeptides depicted in Table 151 above, and the subject sequences are protein and polynucleotide sequences identified in the database based on greater than 80% global identity to the query nucleotide and/or polypeptide sequences. Hom. = Homology; Glob. = Global; Algor. = Algorithm.

The output of the functional genomics approach described herein is a set of genes highly predicted to improve ABST, yield and/or other agronomic important traits such as growth rate, vigor, biomass, growth rate, oil content, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 20

Gene Cloning and Generation of Binary Vectors for Plant Expression

To validate their role in improving yield, selected genes were over-expressed in plants, as follows.

Cloning Strategy

Selected genes from those presented in Examples 1-19 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York.) which are well known to those skilled in the art. PCR products were purified using PCR purification kit (Qiagen).

Usually, 2 sets of primers were prepared for the amplification of each gene, via nested PCR (if required). Both sets of primers were used for amplification on cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested products and the linearized plasmid vector were ligated using T4 DNA ligase enzyme (Roche, Switzerland).

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc) and the NOS terminator (SEQ ID NO: 10457) via digestion with appropriate restriction endonucleases.

Several DNA sequences of the selected genes were synthesized by GeneArt (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQYN_6669, pQNa_RP, pQFYN or pQXNc) is a modified version of the pGI vector in which the cassette is inverted between the left and right borders so the gene and its corresponding promoter are close to the right border and the NPTII gene is close to the left border.

At6669, the new *Arabidopsis thaliana* promoter sequence (SEQ ID NO:10446) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

In case genomic DNA was cloned, the genes were amplified by direct PCR on genomic DNA extracted from leaf tissue using the DNAeasy kit (Qiagen Cat. No. 69104).

Selected genes cloned by the present inventors are provided in Table 153 below.

TABLE 153

| Gene Name | High copy plasmid | Organism | Primers used SEQ ID NOs: | Polynucleotide SEQ ID NO: | Polypeptide SEQ ID NO: |
|---|---|---|---|---|---|
| LAB616 | pUC19c_LAB616 | arabidopsis | 11010, 11055, 10978, 11062 | 263 | 475 |
| LAB617 | pQFNc_LAB617 | arabidopsis | 10583, 10862, 10583, 10862 | 264 | 476 |
| LAB618 | pMA-T_LAB618_GA | arabidopsis | | 265 | 477 |
| LAB619 | pQFNc_LAB619 | arabidopsis | 10780, 10874, 10691, 10876 | 266 | 712 |
| LAB620 | pUC19c_LAB620 | barley | 10721, 10833, 10709, 10872 | 267 | 479 |
| LAB622 | pQFNc_LAB622 | barley | 11002, 10537, 11002, 10537 | 268 | 713 |
| LAB623 | pUC19c_LAB623 | barley | 10642, 10940, 10643, 10948 | 269 | 482 |
| LAB624 | pQFNc_LAB624 | barley | 10706, 10881, 10699, 10917 | 270 | 483 |
| LAB625 | pUC19c_LAB625 | barley | 11001, 10501, 11001, 10501 | 271 | 484 |
| LAB626 | pQFNc_LAB626 | barley | 11017, 10550, 11017, 10550 | 272 | 485 |
| LAB627 | pUC19c_LAB627 | barley | 10483, 11065, 10483, 11065 | 273 | 714 |
| LAB628 | pUC19_LAB628 | barley | 10977, 10539, 11025, 10535 | 274 | 487 |
| LAB629 | pUC19c_LAB629 | barley | 11030, 10458, 11011, 10465 | 275 | 488 |
| LAB630 | pMA-RQ_LAB630_GA | barley | | 276 | 489 |

TABLE 153-continued

| Gene Name | High copy plasmid | Organism | Primers used SEQ ID NOs: | Polynucleotide SEQ ID NO: | Polypeptide SEQ ID NO: |
|---|---|---|---|---|---|
| LAB631 | pQFNc_LAB631 | barley | 11003, 10526, 11007, 10531 | 277 | 490 |
| LAB632 | pQFNc_LAB632 | barley | 10686, 10858, 10632, 10866 | 278 | 491 |
| LAB633 | pQFNc_LAB633 | barley | 10646, 10893, 10646, 10893 | 279 | 492 |
| LAB634 | pUC19c_LAB634 | barley | 10594, 10813, 10594, 10813 | 280 | 493 |
| LAB635 | TopoB_LAB635 | barley | 10994, 10534, 11005, 10534 | 281 | 715 |
| LAB636 | pUC19c_LAB636 | barley | 10983, 10795, 10991, 10961 | 282 | 495 |
| LAB637 | pUC19c_LAB637 | barley | 10741, 10935, 10741, 10935 | 283 | 496 |
| LAB638 | pUC19c_LAB638 | barley | 10694, 11080, 10694, 11080 | 284 | 497 |
| LAB639 | pUC19c_LAB639 | barley | 10753, 10942, 10667, 10789 | 285 | 716 |
| LAB640 | pQFNc_LAB640 | barley | 10484, 10517, 10484, 10517 | 286 | 499 |
| LAB641 | TopoB_LAB641 | barley | 11009, 10564, 11038, 10560 | 287 | 500 |
| LAB642 | pUC19c_LAB642 | barley | 10522, 10474, 10515, 10480 | 288 | 717 |
| LAB645 | pQFNc_LAB645 | barley | 10558, 11056, 10558, 11056 | 289 | 718 |
| LAB647 | pMA_LAB647_GA | barley | | 290 | 504 |
| LAB649 | pQFNc_LAB649 | canola | 11018, 10538, 11018, 10538 | 291 | 505 |
| LAB650 | pUC19c_LAB650 | cotton | 10782, 10915, 10598, 10834 | 292 | 719 |
| LAB651 | pUC19c_LAB651 | foxtail_millet | 10972, 10460, 10972, 10460 | 293 | 720 |
| LAB652 | pQFNc_LAB652 | foxtail_millet | 10688, 10939, 10739, 10934 | 294 | 508 |
| LAB653 | pUC19c_LAB653 | foxtail_millet | 10700, 10528, 10700, 10528 | 295 | 509 |
| LAB654 | pUC19c_LAB654 | foxtail_millet | 10735, 11084, 10670, 11083 | 296 | 510 |
| LAB655 | pUC19c_LAB655 | foxtail_millet | 10714, 10845, 11044, 10788 | 297 | 511 |
| LAB656 | pQFNc_LAB656 | foxtail_millet | 10740, 10836, 10740, 10836 | 298 | 721 |
| LAB657 | pQFNc_LAB657 | foxtail_millet | 10690, 10849, 10593, 10873 | 299 | 513 |
| LAB659 | pQFNc_LAB659 | foxtail_millet | 10703, 10949, 10681, 10906 | 300 | 514 |
| LAB660 | pUC19c_LAB660 | foxtail_millet | 11050, 10812, 10719, 10884 | 301 | 515 |
| LAB661 | pUC19c_LAB661 | foxtail_millet | 10997, 10595, 10963, 10581 | 302 | 516 |
| LAB662 | pQFNc_LAB662 | foxtail_millet | 10713, 10901, 10713, 10891 | 303 | 517 |
| LAB663 | pUC19_LAB663 | foxtail_millet | 10498, 10556, 10485, 10548 | 304 | 518 |
| LAB664 | pQFNc_LAB664 | foxtail_millet | 10623, 10796, 10623, 10925 | 305 | 519 |
| LAB665 | pQFNc_LAB665 | foxtail_millet | 10968, 10678, 10967, 10674 | 306 | 520 |
| LAB666 | pQFNc_LAB666 | foxtail_millet | 11032, 10608, 11008, 10738 | 307 | 521 |
| LAB667 | pUC19c_LAB667 | foxtail_millet | 10981, 10756, 10981, 10756 | 308 | 522 |
| LAB668 | pQFNc_LAB668 | foxtail_millet | 11037, 10462, 11092, 10472 | 309 | 523 |
| LAB669_H7 | pMA-RQ_LAB669_H7_GA | rice | | 470 | 688 |
| LAB670 | pQFNc_LAB670 | foxtail_millet | 10654, 10883, 10635, 10931 | 310 | 525 |
| LAB671 | pUC19c_LAB671 | foxtail_millet | 11021, 10640, 11021, 10640 | 311 | 526 |
| LAB672 | pUC19c_LAB672 | gossypium_raimondii | 10995, 10459, 11016, 10467 | 312 | 722 |
| LAB673 | pQFNc_LAB673 | maize | 10591, 10829, 10591, 10829 | 313 | 723 |
| LAB675 | pQFNc_LAB675 | maize | 10503, 11061, 10544, 11042 | 314 | 529 |
| LAB676 | pMA-T_LAB676_GA | maize | | 315 | 530 |
| LAB677 | pQFNc_LAB677 | maize | 10494, 10466, 10493, 10473 | 316 | 724 |
| LAB678 | pMA-RQ_LAB678_GA | maize | | 317 | 532 |
| LAB679 | pQFNc_LAB679 | maize | 10572, 10547, 10572, 10547 | 318 | 533 |
| LAB680 | pQFNc_LAB680 | maize | 11013, 11067, 11013, 11067 | 319 | 725 |
| LAB681 | pUC19_LAB681 | maize | 10701, 10842, 10701, 10842 | 320 | 726 |
| LAB682 | TopoB_LAB682 | maize | 10971, 10570, 10971, 10565 | 321 | 727 |
| LAB683 | pQFNc_LAB683 | maize | 10610, 10800, 10758, 10912 | 322 | 537 |
| LAB684 | pUC19c_LAB684 | maize | 10614, 11047, 11051, 10807 | 323 | 538 |
| LAB685 | pMA-RQ_LAB685_GA | maize | | 324 | 539 |
| LAB686 | pUC19d_LAB686 | maize | 10974, 10573, 10990, 10574 | 325 | 728 |
| LAB687 | pQFNc_LAB687 | maize | 11045, 10897, 10661, 10863 | 326 | 541 |
| LAB688 | pQFNc_LAB688 | maize | 10553, 11064, 10553, 11064 | 327 | 729 |
| LAB689 | pQFNc_LAB689 | maize | 10668, 10817, 10600, 10932 | 328 | 543 |
| LAB690 | pMA-RQ_LAB690_GA | maize | | 329 | 544 |
| LAB691 | pQFNc_LAB691 | maize | 10621, 10952, 11043, 11052 | 330 | 730 |
| LAB692 | pUC19c_LAB692 | maize | 10586, 10848, 10586, 10848 | 331 | 546 |
| LAB693 | pQFNc_LAB693 | maize | 10757, 10919, 10720, 10841 | 332 | 547 |
| LAB694 | pQFNc_LAB694 | maize | 10712, 10885, 10606, 10910 | 333 | 548 |
| LAB695 | pQFNc_LAB695 | maize | 10618, 10823, 10648, 10889 | 334 | 549 |
| LAB696 | pUC19c_LAB696 | maize | 10984, 10476, 11015, 10479 | 335 | 550 |
| LAB697 | pQFNc_LAB697 | maize | 10630, 10888, 10616, 10854 | 336 | 551 |
| LAB698 | TopoB_LAB698 | maize | 11033, 10748, 11033, 10765 | 337 | 731 |
| LAB700 | TopoB_LAB700 | maize | 10609, 10951, 10734, 10846 | 338 | 732 |
| LAB701 | pUC19c_LAB701 | maize | 10659, 10859, 10620, 10922 | 339 | 554 |
| LAB702 | pMA-RQ_LAB702_GA | maize | | 340 | 555 |
| LAB703 | pUC19c_LAB703 | maize | 10577, 10832, 10592, 10843 | 341 | 733 |
| LAB704 | pUC19c_LAB704 | maize | 10781, 10916, 10677, 10824 | 342 | 557 |
| LAB705 | pQFNc_LAB705 | maize | 10987, 10563, 10987, 10519 | 343 | 734 |
| LAB706 | pQFNc_LAB706 | maize | 10736, 10929, 10578, 10895 | 344 | 559 |
| LAB707 | pUC19c_LAB707 | maize | 10965, 10554, 10970, 10506 | 345 | 735 |
| LAB708 | pUC19c_LAB708 | maize | 10551, 10477, 10551, 10477 | 346 | 561 |
| LAB709 | pUC19_LAB709 | maize | 10727, 10827, 10687, 10875 | 347 | 562 |
| LAB710 | pQFNc_LAB710 | maize | 10976, 10742, 10976, 10742 | 348 | 736 |
| LAB711 | pUC19c_LAB711 | maize | 10724, 10937, 10726, 11090 | 349 | 564 |
| LAB712 | pUC19c_LAB712 | maize | 11004, 10549, 10979, 10541 | 350 | 565 |
| LAB713 | pQFNc_LAB713 | maize | 10530, 11059, 10530, 11059 | 351 | 737 |

TABLE 153-continued

| Gene Name | High copy plasmid | Organism | Primers used SEQ ID NOs: | Polynucleotide SEQ ID NO: | Polypeptide SEQ ID NO: |
|---|---|---|---|---|---|
| LAB714 | pUC19c_LAB714 | maize | 10613, 10899, 10658, 10867 | 352 | 567 |
| LAB716 | pMA-T_LAB716_GA | poplar | | 353 | 568 |
| LAB717 | pMA-RQ_LAB717_GA | poplar | | 354 | 569 |
| LAB718 | pMA-RQ_LAB718_GA | poplar | | 355 | 570 |
| LAB719 | pQFNc_LAB719 | rice | 10680, 10902, 10666, 10831 | 356 | 571 |
| LAB721 | pUC19c_LAB721 | rice | 10973, 10559, 11026, 10540 | 357 | 738 |
| LAB722 | pUC19c_LAB722 | rice | 10486, 10513, 10486, 10513 | 358 | 739 |
| LAB723 | pMA-T_LAB723_GA | rice | | 359 | 575 |
| LAB724 | pUC19c_LAB724 | rice | 10619, 10892, 10619, 10930 | 360 | 576 |
| LAB725 | pUC19c_LAB725 | rice | 11020, 10612, 11040, 10672 | 361 | 740 |
| LAB726 | pQFNc_LAB726 | rice | 10641, 10927, 10603, 10953 | 362 | 578 |
| LAB727 | pQFNc_LAB727 | rice | 10496, 10524, 10496, 10524 | 363 | 741 |
| LAB728 | pUC19c_LAB728 | rice | 11034, 10746, 11027, 10584 | 364 | 580 |
| LAB729 | pQFNc_LAB729 | rice | 11041, 11058, 10998, 11057 | 365 | 742 |
| LAB730 | pUC19c_LAB730 | rice | 10745, 10908, 10750, 10880 | 366 | 582 |
| LAB731 | pUC19c_LAB731 | rice | 11036, 10557, 11036, 10557 | 367 | 583 |
| LAB732 | pQFNc_LAB732 | rice | 10512, 10469, 10546, 10463 | 368 | 584 |
| LAB733 | pUC19c_LAB733 | rice | 10692, 10959, 10647, 10814 | 369 | 585 |
| LAB734 | pMA-RQ_LAB734_GA | rice | | 370 | 586 |
| LAB735 | pQFNc_LAB735 | rice | 10500, 11071, 10500, 11071 | 371 | 587 |
| LAB736 | pQFNc_LAB736 | rice | 10492, 10552, 10492, 10552 | 372 | 743 |
| LAB738 | pUC19c_LAB738 | rice | 10771, 10837, 10749, 10815 | 373 | 589 |
| LAB739 | pUC19_LAB739 | rice | 10760, 10805, 10760, 10805 | 374 | 590 |
| LAB740 | pUC19c_LAB740 | sorghum | 10665, 11066, 10779, 11073 | 375 | 591 |
| LAB741 | pUC19_LAB741 | sorghum | 11000, 11053, 11000, 11053 | 376 | 592 |
| LAB742 | pUC19c_LAB742 | sorghum | 10705, 10533, 10705, 10533 | 377 | 744 |
| LAB744_H1 | pMA-RQ_LAB744_H1_GA | maize | | 471 | 689 |
| LAB745 | pQFNc_LAB745p | sorghum | 10986, 11072, 10986, 11072 | 473 | — |
| LAB746 | pUC19_LAB746 | sorghum | 10585, 10962, 10585, 10962 | 378 | 595 |
| LAB747 | pQFNc_LAB747 | sorghum | 10980, 10523, 10980, 10523 | 474 | — |
| LAB748 | pQFNc_LAB748 | sorghum | 10722, 10921, 10722, 10946 | 379 | 596 |
| LAB749 | pQFNc_LAB749 | sorghum | 10571, 10529, 10571, 10529 | 380 | 745 |
| LAB750 | pUC19c_LAB750 | sorghum | 10491, 10536, 10491, 10536 | 381 | 746 |
| LAB751 | pUC19_LAB751 | sorghum | 10982, 10509, 10982, 10509 | 382 | 747 |
| LAB752 | pUC19c_LAB752 | sorghum | 10652, 10525, 10693, 10521 | 383 | 600 |
| LAB753 | pUC19c_LAB753 | sorghum | 10644, 10804, 10639, 10907 | 384 | 748 |
| LAB754 | TopoB_LAB754 | sorghum | 10587, 10938, 10707, 10793 | 385 | 749 |
| LAB755 | pUC19c_LAB755 | sorghum | 10684, 10809, 10683, 10943 | 386 | 603 |
| LAB756_H3 | pMA-RQ_LAB756_H3_GA | rice | | 472 | 690 |
| LAB757 | pQFNc_LAB757 | sorghum | 10673, 10818, 10673, 10818 | 387 | 750 |
| LAB758 | TopoB_LAB758 | sorghum | 10964, 10543, 11039, 10543 | 388 | 606 |
| LAB759 | pQFNc_LAB759 | sorghum | 10725, 10944, 10766, 10882 | 389 | 607 |
| LAB760 | pUC19c_LAB760 | sorghum | 10645, 10924, 10611, 10816 | 390 | 608 |
| LAB761 | pMA-RQ_LAB761_GA | sorghum | | 391 | 609 |
| LAB762 | pUC19c_LAB762 | sorghum | 10489, 10514, 10495, 10542 | 392 | 610 |
| LAB763 | pQFNc_LAB763 | sorghum | 10596, 10505, 10596, 10505 | 393 | 611 |
| LAB764 | pUC19c_LAB764 | sorghum | 10487, 10516, 10487, 10508 | 394 | 751 |
| LAB765 | pUC19c_LAB765 | sorghum | 10597, 10890, 10597, 10869 | 395 | 613 |
| LAB767 | pMA-RQ_LAB767_GA | sorghum | | 396 | 614 |
| LAB768 | pQFNc_LAB768 | sorghum | 10698, 10838, 10698, 10955 | 397 | 615 |
| LAB769 | pQFNc_LAB769 | sorghum | | 398 | 616 |
| LAB770 | pQFNc_LAB770 | sorghum | 11046, 11081, 11046, 11081 | 399 | 617 |
| LAB771 | pUC19c_LAB771 | sorghum | 10988, 10729, 11006, 11049 | 400 | 618 |
| LAB772 | pQFNc_LAB772 | sorghum | 10777, 10797, 10626, 10790 | 401 | 619 |
| LAB773 | TopoB_LAB773 | sorghum | 10481, 10602, 10482, 10607 | 402 | 620 |
| LAB774 | pQFNc_LAB774 | sorghum | 10629, 11079, 10629, 11079 | 403 | 621 |
| LAB775 | pUC19c_LAB775 | sorghum | 10511, 11060, 10511, 11060 | 404 | 622 |
| LAB776 | pQFNc_LAB776 | sorghum | 10787, 11070, 10773, 11068 | 405 | 623 |
| LAB777 | pQFNc_LAB777 | sorghum | 10624, 10840, 10624, 10840 | 406 | 624 |
| LAB778 | pQFNc_LAB778 | sorghum | 11023, 11076, 11023, 11076 | 407 | 625 |
| LAB779 | pQFNc_LAB779 | sorghum | 10579, 10896, 10697, 10914 | 408 | 626 |
| LAB780 | pQFNc_LAB780 | sorghum | 10996, 10650, 10996, 10675 | 409 | 627 |
| LAB781 | pQFNc_LAB781 | sorghum | 10993, 10676, 11031, 10679 | 410 | 628 |
| LAB782 | pUC19c_LAB782 | sorghum | 10702, 11074, 10759, 11069 | 411 | 629 |
| LAB783 | TopoB_LAB783 | sorghum | | 412 | 630 |
| LAB784 | pUC19c_LAB784 | sorghum | 10628, 10464, 10628, 10464 | 413 | 631 |
| LAB785 | pMA_LAB785_GA | sorghum | | 414 | 632 |
| LAB786 | pQFNc_LAB786 | sorghum | 11024, 10723, 11024, 10622 | 415 | 633 |
| LAB787 | pUC19c_LAB787 | sorghum | 10718, 10850, 10747, 10920 | 416 | 634 |
| LAB788 | pQFNc_LAB788 | sorghum | 10768, 10886, 10730, 10894 | 417 | 635 |
| LAB789 | pUC19c_LAB789 | sorghum | 10704, 10851, 10786, 10839 | 418 | 752 |
| LAB790 | pQFNc_LAB790 | sorghum | 11012, 10561, 10969, 10532 | 419 | 753 |
| LAB791 | pQFNc_LAB791 | sorghum | 10625, 10798, 10663, 10958 | 420 | 638 |
| LAB792 | pUC19c_LAB792 | sorghum | 10655, 10954, 10637, 10819 | 421 | 639 |
| LAB793 | pQFNc_LAB793 | sorghum | 10774, 10909, 10716, 10801 | 422 | 640 |

TABLE 153-continued

| Gene Name | High copy plasmid | Organism | Primers used SEQ ID NOs: | Polynucleotide SEQ ID NO: | Polypeptide SEQ ID NO: |
|---|---|---|---|---|---|
| LAB794 | pUC19c_LAB794 | sorghum | 10651, 10926, 10649, 10855 | 423 | 641 |
| LAB795 | pUC19c_LAB795 | sorghum | 10497, 10567, 10490, 10569 | 424 | 642 |
| LAB796 | pQFNc_LAB796 | sorghum | 10769, 10900, 10633, 10830 | 425 | 643 |
| LAB797 | TopoB_LAB797 | sorghum | 10568, 10821, 10566, 10957 | 426 | 644 |
| LAB798 | pQFNc_LAB798 | sorghum | 10615, 10828, 10682, 11085 | 427 | 645 |
| LAB799 | pUC19c_LAB799 | sorghum | 10527, 10475, 10518, 10478 | 428 | 646 |
| LAB800 | pQFNc_LAB800 | soybean | 10767, 10868, 10669, 10864 | 429 | 647 |
| LAB801 | pUC19c_LAB801 | soybean | 10733, 10847, 10775, 10960 | 430 | 648 |
| LAB802 | TopoB_LAB802 | soybean | 10770, 10904, 10653, 10825 | 431 | 649 |
| LAB803 | pUC19c_LAB803 | soybean | 10732, 10947, 10590, 10905 | 432 | 650 |
| LAB804 | pQFNc_LAB804 | soybean | 10784, 10956, 10631, 10808 | 433 | 651 |
| LAB805 | pUC19c_LAB805 | soybean | 10627, 10933, 10599, 10860 | 434 | 652 |
| LAB807 | pQFNc_LAB807 | soybean | 10695, 10806, 10638, 10870 | 435 | 653 |
| LAB809 | pQFNc_LAB809 | soybean | 10772, 10791, 10580, 10887 | 436 | 754 |
| LAB810 | pQFNc_LAB810 | soybean | 10783, 10844, 10634, 10826 | 437 | 655 |
| LAB811 | pQFNc_LAB811 | soybean | 10715, 10950, 10576, 10941 | 438 | 656 |
| LAB813 | pQFNc_LAB813 | sunflower | 10617, 10852, 10778, 10903 | 439 | 755 |
| LAB814 | TopoB_LAB814 | sunflower | 11035, 10545, 11029, 10545 | 440 | 756 |
| LAB815 | pQFNc_LAB815 | sunflower | 10985, 10755, 11091, 11077 | 441 | 659 |
| LAB816 | pQFNc_LAB816 | sunflower | 10582, 10856, 10717, 10857 | 442 | 757 |
| LAB817 | pQFNc_LAB817 | sunflower | 10710, 10810, 10710, 10835 | 443 | 661 |
| LAB820 | pUC19c_LAB820 | sunflower | 10499, 10504, 10499, 10555 | 444 | 758 |
| LAB821 | pQFNc_LAB821 | sunflower | 10761, 10911, 10761, 10911 | 445 | 759 |
| LAB823 | pUC19c_LAB823 | sunflower | 10989, 10471, 11019, 10470 | 446 | 760 |
| LAB824 | pQFNc_LAB824 | tomato | 11048, 11087, 11075, 10923 | 447 | 665 |
| LAB825 | pQFNc_LAB825 | tomato | 10696, 10913, 10751, 10820 | 448 | 761 |
| LAB827 | pUC19_LAB827 | tomato | 10601, 10865, 10601, 10865 | 449 | 667 |
| LAB829 | pUC19c_LAB829 | tomato | 11093, 10744, 10975, 10776 | 450 | 668 |
| LAB830 | pQFNc_LAB830 | tomato | 10662, 10802, 10656, 10898 | 451 | 669 |
| LAB831 | pQFNc_LAB831 | tomato | 10588, 10803, 10588, 11086 | 452 | 670 |
| LAB832 | pQFNc_LAB832 | tomato | 10689, 10799, 10689, 10799 | 453 | 762 |
| LAB833 | pQFNc_LAB833 | tomato | 10731, 10792, 10737, 10871 | 454 | 672 |
| LAB834 | pUC19c_LAB834 | tomato | 10657, 10877, 10636, 10861 | 455 | 673 |
| LAB835 | pUC19c_LAB835 | tomato | 10752, 10879, 10754, 10878 | 456 | 674 |
| LAB836 | pUC19c_LAB836 | tomato | 10785, 10928, 10671, 10936 | 457 | 675 |
| LAB837 | pQFNc_LAB837 | tomato | 10708, 10794, 10589, 10822 | 458 | 763 |
| LAB839 | pQFNc_LAB839 | tomato | 11028, 10664, 10966, 10763 | 459 | 677 |
| LAB840 | pQFNc_LAB840 | tomato | 10762, 11054, 10711, 10918 | 460 | 678 |
| LAB841 | pQFNc_LAB841 | tomato | 10999, 10562, 11014, 10510 | 461 | 764 |
| LAB842 | pQFNc_LAB842 | tomato | 10575, 11088, 10743, 11089 | 462 | 680 |
| LAB843 | TopoB_LAB843 | tomato | 10764, 10945, 10764, 10945 | 463 | 681 |
| LAB844 | pQFNc_LAB844 | wheat | 10685, 10811, 10685, 10811 | 464 | 765 |
| LAB845 | pQFNc_LAB845 | wheat | 10604, 11082, 10604, 11082 | 465 | 766 |
| LAB847 | pQFNc_LAB847 | wheat | 11022, 11078, 11022, 11078 | 466 | 767 |
| LAB848 | pQFNc_LAB848 | wheat | 10728, 10853, 10728, 10853 | 467 | 768 |
| LAB849 | pQFNc_LAB849 | wheat | 10605, 10461, 10660, 10468 | 468 | 769 |
| LAB850 | pUC19c_LAB850 | wheat | 10507, 11063, 10507, 11063 | 469 | 770 |

Table 153: Provided are the sequence identifiers of the cloned genes, the primers used for cloning, genes' names, vectors used for cloning, and the plant species from which the genes were cloned.

Example 21

Transforming *Agrobacterium tumefaciens* Cells with Binary Vectors Harboring the Polynucleotides of the Invention Each of the binary vectors described in Example 20 above was used to transform *Agrobacterium* cells. Two additional binary constructs, having only the At6669 or the 35S promoter or no additional promoter were used as negative controls.

The binary vectors were introduced to *Agrobacterium tumefaciens* GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Agrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention are properly introduced to the *Agrobacterium* cells.

Example 22

Transformation of *Arabidopsis thaliana* Plants with the Polynucleotides of the Invention

*Arabidopsis thaliana* Columbia plants (To plants) were transformed using the Floral Dip procedure described by Clough and Bent, 1998 (Floral dip: a simplified method for *Agrobacterium*-mediated transformation of *Arabidopsis thaliana*. Plant J 16:735-43) and by Desfeux et al., 2000 (Female Reproductive Tissues Are the Primary Target of *Agrobacterium*-Mediated Transformation by the *Arabidopsis* Floral-Dip Method. Plant Physiol, July 2000, Vol. 123, pp. 895-904), with minor modifications. Briefly, To Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hour light/dark cycles. The T0 plants were ready for transformation six days before anthesis.

Single colonies of Agrobacterium carrying the binary constructs were generated as described in Example 21 above. Colonies were cultured in LB medium supplemented with kanamycin (50 mg/L) and gentamycin (50 mg/L). The cultures were incubated at 28° C. for 48 hours under vigorous shaking and then centrifuged at 4000 rpm for 5 minutes. The pellets comprising the Agrobacterium cells were re-suspended in a transformation medium containing half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an Agrobacterium suspension, such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours, to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry. Seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochloride and 0.05% triton for 5 minutes. The surface-sterilized seeds are thoroughly washed in sterile distilled water then placed on culture plates containing half-strength Murashige-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ Arabidopsis plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 23

Evaluation of Transgenic Arabidopsis Abst, Yield and Plant Growth Rate Under Abiotic Stress as Well as Under Standard Growth Conditions in Greenhouse Assay (GH-SM Assays)

Assay 1—ABST Measured Until Seed Yield (Seed Maturation Assay)

Seed yield, plant biomass and plant growth rate under drought conditions and standard growth conditions in greenhouse experiments—This assay follows seed yield production, the biomass formation and the rosette area growth of plants grown in the greenhouse under drought conditions and under standard growth conditions. Transgenic Arabidopsis seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress. All plants were grown in the greenhouse until seeds maturation. Seeds were harvested, extracted and weighted. The remaining plant biomass (the above ground tissue) was also harvested, and weighted immediately or following drying in oven at 50° C. for 24 hours.

Each construct was validated at its $T_2$ generation (under the control of the At6669 promoter, SEQ ID NO:10446). Transgenic plants transformed with a construct conformed by an empty vector carrying the At6669 (SEQ ID NO:10446) promoter and the selectable marker was used as control.

The plants were analyzed for their overall size, growth rate, flowering, seed yield, 1,000-seed weight, dry matter and harvest index (HI— seed yield/dry matter). Transgenic plants performance was compared to control plants grown in parallel under the same conditions. Mock-transgenic plants with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) is used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area, Petiole Relative Area and leaf petiole length.

Vegetative growth rate: the relative growth rate (RGR) of leaf number [formula XXI (described above)], rosette area (Formula XXII, above), plot coverage (Formula XXIV, above) and harvest index (Formula IV) was calculated with the indicated formulas.

Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr.). 1000 seed weight (the weight of 1000 seeds) (gr.).

The harvest index (HI) was calculated using Formula IV as described above.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 154-163 summarize the observed phenotypes of transgenic plants exogenously expressing the gene constructs using the greenhouse seed maturation (GH-SM) assays standard growth conditions (Tables 154-158) conditions or under drought conditions (Tables 159-163). Transgenic plants expressing these genes exhibit higher biomass (Tables 154, 155, 157, 159, 160, 162), yield (Tables 157, 158, 162, 163), vigor and growth rate (Table 154, 156, 159 and 161), and flowering time (Tables 154 and 159) as compared to control plants grown under identical growth conditions. In addition, the increased of plant performance under drought stress, as compared to control plants, indicated increased tolerance to an abiotic stress condition such as drought. The evaluation of each gene was performed by testing the performance of different number of events. Event with p-value<0.1 was considered statistically significant. It should be noted that a negative increment (in percentages) when found in flowering or inflorescence emergence indicates drought avoidance of the plant.

TABLE 154

Genes showing improved plant performance at normal growth conditions under regulation of At6669 promoter

| Gene Name | Event # | Dry Weight [mg] | | | Flowering (days) | | | Inflorescence Emergence (days) | | |
|---|---|---|---|---|---|---|---|---|---|---|
| | | Ave. | P-Val. | % Incr. | Ave. | P-Val. | % Incr. | Ave. | P-Val. | % Incr. |
| LAB759 | 74848.1 | — | — | — | — | — | — | 17.2 | 0.09 | −5 |
| LAB759 | 74850.1 | — | — | — | 21.5 | 0.09 | −3 | — | — | — |
| LAB748 | 74976.2 | — | — | — | — | — | — | 17.3 | 0.20 | −4 |
| LAB719 | 74804.1 | — | — | — | 21.5 | 0.09 | −3 | — | — | — |
| LAB719 | 74805.2 | — | — | — | 21.7 | 0.28 | −2 | 17.0 | L | −6 |
| LAB719 | 74807.2 | — | — | — | 21.5 | 0.09 | −3 | 17.7 | 0.26 | −2 |
| LAB706 | 74800.2 | — | — | — | 21.7 | 0.28 | −2 | 17.3 | 0.20 | −4 |
| LAB706 | 74803.4 | — | — | — | 21.7 | 0.28 | −2 | 17.7 | 0.26 | −2 |
| LAB697 | 74949.1 | — | — | — | 21.5 | 0.09 | −3 | — | — | — |
| LAB697 | 74949.3 | — | — | — | 21.5 | 0.09 | −3 | — | — | — |
| LAB695 | 74796.1 | — | — | — | 21.5 | 0.09 | −3 | — | — | — |
| LAB693 | 74787.3 | — | — | — | 21.7 | 0.28 | −2 | — | — | — |
| LAB689 | 74756.3 | — | — | — | 21.5 | 0.09 | −3 | 17.6 | 0.27 | −3 |
| LAB689 | 74760.1 | — | — | — | 21.0 | 0.20 | −5 | 16.2 | L | −10 |
| LAB683 | 74874.1 | — | — | — | 21.7 | 0.28 | −2 | — | — | — |
| LAB675 | 74750.3 | — | — | — | 21.7 | 0.28 | −2 | — | — | — |
| LAB659 | 74835.1 | — | — | — | 21.2 | 0.14 | −4 | 16.9 | 0.20 | −7 |
| LAB659 | 74836.1 | — | — | — | 21.7 | 0.28 | −2 | — | — | — |
| LAB659 | 74838.1 | — | — | — | — | — | — | 17.5 | 0.12 | −3 |
| LAB652 | 74859.2 | — | — | — | 21.5 | 0.09 | −3 | 16.2 | L | −10 |
| LAB652 | 74861.1 | — | — | — | 21.5 | 0.09 | −3 | 16.7 | 0.04 | −8 |
| LAB652 | 74863.1 | — | — | — | 21.5 | 0.09 | −3 | — | — | — |
| LAB626 | 74771.1 | — | — | — | 21.7 | 0.28 | −2 | — | — | — |
| CONT. | — | — | — | — | 22.1 | — | — | 18.1 | — | — |
| LAB759 | 74846.1 | — | — | — | 23.5 | 0.26 | −1 | — | — | — |
| LAB759 | 74850.1 | — | — | — | 23.5 | 0.26 | −1 | — | — | — |
| LAB748 | 74972.1 | — | — | — | 23.5 | 0.26 | −1 | — | — | — |
| LAB748 | 74974.1 | 1250.9 | 0.15 | 8 | — | — | — | — | — | — |
| LAB748 | 74976.2 | 1365.2 | 0.05 | 18 | — | — | — | — | — | — |
| LAB748 | 74977.3 | — | — | — | 23.5 | 0.26 | −1 | — | — | — |
| LAB732 | 74966.2 | — | — | — | 23.2 | 0.26 | −2 | — | — | — |
| LAB719 | 74804.1 | — | — | — | 22.7 | 0.03 | −4 | — | — | — |
| LAB719 | 74805.1 | 1212.5 | 0.20 | 5 | — | — | — | — | — | — |
| LAB719 | 74805.2 | — | — | — | 22.9 | L | −3 | — | — | — |
| LAB706 | 74800.2 | — | — | — | 23.1 | 0.05 | −3 | — | — | — |
| LAB695 | 74793.1 | — | — | — | 23.2 | 0.26 | −2 | — | — | — |
| LAB694 | 74762.1 | — | — | — | 23.2 | 0.27 | −2 | — | — | — |
| LAB694 | 74764.3 | 1444.8 | 0.13 | 25 | — | — | — | — | — | — |
| LAB693 | 74786.3 | — | — | — | 23.5 | 0.26 | −1 | — | — | — |
| LAB693 | 74787.1 | — | — | — | 23.2 | 0.27 | −2 | — | — | — |
| LAB693 | 74787.3 | — | — | — | 23.2 | 0.26 | −2 | — | — | — |
| LAB689 | 74756.2 | — | — | — | — | — | — | 16.4 | L | −11 |
| LAB689 | 74759.2 | — | — | — | 22.8 | 0.07 | −4 | 16.3 | L | −11 |

TABLE 154-continued

Genes showing improved plant performance at normal growth conditions under regulation of At6669 promoter

| Gene Name | Event # | Dry Weight [mg] | | | Flowering (days) | | | Inflorescence Emergence (days) | | |
|---|---|---|---|---|---|---|---|---|---|---|
| | | Ave. | P-Val. | % Incr. | Ave. | P-Val. | % Incr. | Ave. | P-Val. | % Incr. |
| LAB689 | 74760.1 | — | — | — | 21.7 | 0.24 | −9 | 16.0 | L | −13 |
| LAB683 | 74871.3 | 1492.8 | 0.17 | 29 | — | — | — | — | — | — |
| LAB680 | 74775.1 | 1307.1 | 0.30 | 13 | — | — | — | 16.2 | L | −12 |
| LAB668 | 74864.2 | — | — | — | 23.5 | 0.26 | −1 | — | — | — |
| LAB668 | 74865.1 | — | — | — | 22.5 | L | −5 | 16.2 | L | −12 |
| LAB668 | 74867.3 | 1255.0 | 0.17 | 9 | 23.3 | 0.22 | −2 | — | — | — |
| LAB666 | 74840.2 | — | — | — | — | — | — | 15.9 | L | −14 |
| LAB659 | 74839.1 | 1259.1 | 0.07 | 9 | — | — | — | — | — | — |
| LAB626 | 74771.1 | 1483.6 | 0.08 | 29 | — | — | — | 16.0 | L | −13 |
| LAB626 | 74771.3 | — | — | — | 23.5 | 0.26 | −1 | — | — | — |
| CONT. | — | 1153.9 | — | — | 23.7 | — | — | 18.4 | — | — |

Table 154. "CONT."—Control; "Ave."—Average; "% Incr." = % increment; "p-val."—p-value, L—p < 0.01.

TABLE 155

Genes showing improved plant performance at normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB748 | 74972.1 | — | — | — | 11.5 | 0.07 | 5 | 88.0 | 0.24 | 7 |
| LAB748 | 74976.2 | 1.49 | 0.06 | 10 | — | — | — | 87.7 | 0.3 | 6 |
| LAB732 | 74969.1 | 1.47 | 0.11 | 9 | — | — | — | 91.5 | 0.05 | 11 |
| LAB697 | 74948.1 | 1.42 | 0.3 | 5 | — | — | — | — | — | — |
| LAB689 | 74760.1 | 1.49 | 0.14 | 10 | — | — | — | — | — | — |
| LAB675 | 74750.3 | — | — | — | — | — | — | 88.6 | 0.17 | 7 |
| LAB659 | 74835.1 | 1.44 | 0.28 | 6 | — | — | — | — | — | — |
| LAB659 | 74838.1 | 1.55 | 0.01 | 15 | — | — | — | 93.0 | 0.19 | 13 |
| LAB652 | 74861.1 | 1.46 | 0.11 | 8 | — | — | — | 91.6 | 0.04 | 11 |
| LAB652 | 74863.1 | 1.69 | 0.06 | 25 | — | — | — | 98.5 | L | 19 |
| CONT. | — | 1.35 | — | — | 11.0 | — | — | 82.6 | — | — |
| LAB759 | 74846.1 | 1.59 | 0.2 | 5 | 10.9 | 0.08 | 4 | 91.9 | 0.05 | 12 |
| LAB759 | 74850.1 | — | — | — | 11.2 | L | 7 | — | — | — |
| LAB748 | 74972.1 | — | — | — | 10.9 | 0.13 | 4 | — | — | — |
| LAB748 | 74977.2 | 1.59 | 0.22 | 5 | — | — | — | 88.6 | 0.16 | 8 |
| LAB732 | 74966.1 | — | — | — | 11.1 | 0.16 | 6 | — | — | — |
| LAB732 | 74966.2 | — | — | — | 10.9 | 0.08 | 4 | — | — | — |
| LAB732 | 74967.1 | — | — | — | — | — | — | 87.0 | 0.28 | 6 |
| LAB732 | 74971.1 | — | — | — | 11.1 | 0.02 | 6 | — | — | — |
| LAB719 | 74804.1 | — | — | — | — | — | — | 90.6 | 0.08 | 11 |
| LAB697 | 74950.2 | — | — | — | 11.1 | 0.03 | 6 | 88.1 | 0.18 | 8 |
| LAB697 | 74951.1 | 1.66 | 0.03 | 10 | — | — | — | 89.1 | 0.22 | 9 |
| LAB695 | 74792.3 | — | — | — | 10.8 | 0.28 | 3 | — | — | — |
| LAB695 | 74796.1 | — | — | — | 10.9 | 0.05 | 4 | — | — | — |
| LAB694 | 74767.2 | 1.69 | 0.02 | 12 | — | — | — | 92.9 | 0.04 | 13 |
| LAB693 | 74787.3 | — | — | — | 10.8 | 0.29 | 3 | — | — | — |
| LAB689 | 74756.2 | — | — | — | — | — | — | 90.4 | 0.09 | 10 |
| LAB689 | 74759.2 | 1.72 | 0.29 | 14 | — | — | — | 92.4 | 0.15 | 13 |
| LAB689 | 74760.1 | 1.68 | 0.07 | 12 | 11.4 | L | 9 | 95.1 | 0.02 | 16 |
| LAB683 | 74874.1 | — | — | — | 10.9 | 0.08 | 4 | — | — | — |
| LAB680 | 74775.1 | 1.83 | 0.09 | 21 | 11.0 | 0.07 | 5 | — | — | — |
| LAB675 | 74750.3 | 1.61 | 0.28 | 7 | — | — | — | 91.4 | 0.08 | 12 |
| LAB668 | 74864.2 | 1.58 | 0.25 | 5 | — | — | — | — | — | — |
| LAB668 | 74865.1 | 1.70 | 0.19 | 13 | — | — | — | 93.1 | 0.27 | 14 |
| LAB668 | 74867.3 | — | — | — | 11.4 | 0.03 | 9 | — | — | — |
| LAB666 | 74840.2 | 1.79 | 0.08 | 19 | 10.8 | 0.29 | 3 | 99.2 | 0.12 | 21 |
| LAB652 | 74860.2 | — | — | — | 10.8 | 0.2 | 3 | — | — | — |
| LAB626 | 74771.1 | 1.61 | 0.24 | 7 | — | — | — | — | — | — |
| CONT. | — | 1.51 | — | — | 10.5 | — | — | 82.0 | — | — |

Table 155. "CONT."—Control; "Ave."—Average; "% Incr." = % increment; "p-val."—p-value, L—p < 0.01.

TABLE 156

Genes showing improved plant performance at normal growth conditions under regulation of At6669 promoter

| Gene Name | Event # | RGR Of Leaf Number (number per day) | | | RGR Of Plot Coverage (cm² per day) | | | RGR Of Rosette Diameter (cm per day) | | |
|---|---|---|---|---|---|---|---|---|---|---|
| | | Ave. | P-Val. | % Incr. | Ave. | P-Val. | % Incr. | Ave. | P-Val. | % Incr. |
| LAB748 | 74972.1 | 0.84 | 0.29 | 15 | — | — | — | — | — | — |
| LAB689 | 74760.1 | — | — | — | 13.2 | 0.25 | 15 | 0.56 | 0.27 | 11 |
| LAB659 | 74838.1 | — | — | — | — | — | — | 0.57 | 0.24 | 11 |
| LAB652 | 74863.1 | — | — | — | 13.9 | 0.1 | 21 | 0.57 | 0.19 | 12 |
| CONT. | — | 0.73 | — | — | 11.5 | — | — | 0.51 | — | — |
| LAB759 | 74850.1 | 0.66 | 0.27 | 18 | — | — | — | — | — | — |
| LAB732 | 74966.1 | 0.68 | 0.12 | 22 | — | — | — | — | — | — |
| LAB732 | 74966.2 | — | — | — | — | — | — | 0.56 | 0.28 | 12 |
| LAB732 | 74971.1 | 0.68 | 0.14 | 21 | — | — | — | — | — | — |
| LAB719 | 74805.1 | 0.64 | 0.27 | 14 | — | — | — | — | — | — |
| LAB719 | 74807.2 | 0.68 | 0.15 | 21 | — | — | — | — | — | — |
| LAB697 | 74951.1 | — | — | — | — | — | — | 0.57 | 0.22 | 13 |
| LAB695 | 74796.1 | 0.65 | 0.24 | 16 | — | — | — | — | — | — |
| LAB689 | 74756.2 | 0.64 | 0.27 | 15 | — | — | — | — | — | — |
| LAB689 | 74759.2 | — | — | — | 13.0 | 0.29 | 14 | — | — | — |
| LAB689 | 74760.1 | 0.70 | 0.1 | 24 | 13.5 | 0.18 | 18 | — | — | — |
| LAB683 | 74874.1 | 0.68 | 0.12 | 22 | — | — | — | — | — | — |
| LAB680 | 74775.1 | — | — | — | 13.3 | 0.26 | 16 | 0.57 | 0.22 | 13 |
| LAB668 | 74864.2 | 0.66 | 0.28 | 18 | — | — | — | — | — | — |
| LAB668 | 74865.1 | — | — | — | 13.2 | 0.25 | 15 | — | — | — |
| LAB668 | 74867.3 | 0.68 | 0.14 | 21 | — | — | — | — | — | — |
| LAB666 | 74840.2 | — | — | — | 14.1 | 0.09 | 23 | 0.59 | 0.08 | 19 |
| LAB666 | 74841.2 | 0.74 | 0.04 | 32 | — | — | — | — | — | — |
| LAB666 | 74844.3 | 0.69 | 0.14 | 23 | — | — | — | — | — | — |
| LAB659 | 74836.2 | 0.66 | 0.22 | 18 | — | — | — | — | — | — |
| LAB652 | 74859.1 | 0.66 | 0.25 | 18 | — | — | — | — | — | — |
| CONT. | — | 0.56 | — | — | 11.5 | — | — | 0.50 | — | — |

Table 156. "CONT."—Control; "Ave."—Average; "% Incr." = % increment; "p-val."—p-value, L—p < 0.01.

TABLE 157

Genes showing improved plant performance at normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB748 | 74972.1 | — | — | — | 11.0 | 0.24 | 7 | — | — | — |
| LAB748 | 74976.2 | — | — | — | 11.0 | 0.3 | 6 | 5.5 | 0.21 | 4 |
| LAB732 | 74969.1 | — | — | — | 11.4 | 0.05 | 11 | 5.6 | 0.14 | 6 |
| LAB697 | 74948.1 | — | — | — | — | — | — | 5.5 | 0.29 | 3 |
| LAB675 | 74750.3 | — | — | — | 11.1 | 0.17 | 7 | — | — | — |
| LAB659 | 74835.1 | — | — | — | — | — | — | 5.5 | 0.28 | 4 |
| LAB659 | 74838.1 | — | — | — | 11.6 | 0.19 | 13 | 5.8 | 0.07 | 9 |
| LAB652 | 74861.1 | — | — | — | 11.5 | 0.04 | 11 | 5.6 | 0.05 | 6 |
| LAB652 | 74863.1 | — | — | — | 12.3 | L | 19 | 5.9 | L | 12 |
| CONT. | — | — | — | — | 10.3 | — | — | 5.3 | — | — |
| LAB759 | 74846.1 | — | — | — | 11.5 | 0.05 | 12 | 5.6 | 0.05 | 6 |
| LAB759 | 74850.1 | 0.50 | 0.14 | 12 | — | — | — | — | — | — |
| LAB748 | 74972.1 | 0.50 | 0.03 | 13 | — | — | — | — | — | — |
| LAB748 | 74977.2 | 0.53 | L | 18 | 11.1 | 0.16 | 8 | — | — | — |
| LAB732 | 74966.2 | 0.52 | 0.02 | 17 | — | — | — | 5.5 | 0.27 | 4 |
| LAB732 | 74967.1 | — | — | — | 10.9 | 0.28 | 6 | — | — | — |
| LAB719 | 74804.1 | 0.53 | 0.07 | 19 | 11.3 | 0.08 | 11 | 5.5 | 0.12 | 4 |
| LAB719 | 74807.2 | 0.50 | 0.27 | 13 | — | — | — | — | — | — |
| LAB706 | 74803.4 | 0.48 | 0.2 | 7 | — | — | — | — | — | — |
| LAB697 | 74949.1 | 0.48 | 0.25 | 7 | — | — | — | — | — | — |
| LAB697 | 74950.2 | 0.50 | 0.03 | 13 | 11.0 | 0.18 | 8 | 5.5 | 0.28 | 3 |
| LAB697 | 74951.1 | — | — | — | 11.1 | 0.22 | 9 | 5.7 | 0.03 | 8 |
| LAB695 | 74792.3 | 0.48 | 0.26 | 8 | — | — | — | — | — | — |
| LAB695 | 74793.1 | 0.49 | 0.06 | 11 | — | — | — | — | — | — |
| LAB695 | 74796.1 | 0.51 | 0.07 | 14 | — | — | — | — | — | — |

TABLE 157-continued

Genes showing improved plant performance at normal growth conditions under regulation of At6669 promoter

| Gene Name | Event # | Harvest Index Ave. | P-Val. | % Incr. | Rosette Area [cm$^2$] Ave. | P-Val. | % Incr. | Rosette Diameter [cm] Ave. | P-Val. | % Incr. |
|---|---|---|---|---|---|---|---|---|---|---|
| LAB695 | 74797.4 | 0.48 | 0.16 | 7 | — | — | — | — | — | — |
| LAB694 | 74767.1 | 0.53 | 0.07 | 18 | — | — | — | — | — | — |
| LAB694 | 74767.2 | 0.48 | 0.29 | 7 | 11.6 | 0.04 | 13 | 5.5 | 0.11 | 4 |
| LAB689 | 74756.2 | — | — | — | 11.3 | 0.09 | 10 | 5.6 | 0.09 | 5 |
| LAB689 | 74756.3 | 0.49 | 0.07 | 11 | — | — | — | — | — | — |
| LAB689 | 74759.2 | — | — | — | 11.6 | 0.15 | 13 | 5.7 | 0.06 | 7 |
| LAB689 | 74760.1 | — | — | — | 11.9 | 0.02 | 16 | 5.7 | 0.03 | 7 |
| LAB683 | 74872.3 | 0.53 | L | 18 | — | — | — | — | — | — |
| LAB683 | 74873.1 | 0.53 | L | 20 | — | — | — | — | — | — |
| LAB680 | 74774.1 | 0.49 | 0.08 | 10 | — | — | — | — | — | — |
| LAB680 | 74775.1 | — | — | — | 12.8 | 0.12 | 25 | 5.9 | 0.1 | 10 |
| LAB680 | 74779.1 | 0.49 | 0.2 | 10 | — | — | — | — | — | — |
| LAB675 | 74750.3 | — | — | — | 11.4 | 0.08 | 12 | 5.5 | 0.13 | 4 |
| LAB675 | 74751.4 | 0.54 | 0.1 | 21 | — | — | — | — | — | — |
| LAB668 | 74864.2 | — | — | — | 11.2 | 0.13 | 9 | — | — | — |
| LAB668 | 74865.1 | 0.49 | 0.23 | 9 | 11.6 | 0.27 | 14 | 5.7 | 0.1 | 7 |
| LAB666 | 74840.2 | — | — | — | 12.4 | 0.12 | 21 | 5.9 | 0.04 | 11 |
| LAB666 | 74840.3 | 0.51 | 0.09 | 15 | — | — | — | — | — | — |
| LAB666 | 74844.3 | 0.50 | 0.18 | 13 | — | — | — | — | — | — |
| LAB659 | 74836.1 | 0.49 | 0.21 | 10 | — | — | — | — | — | — |
| LAB659 | 74838.1 | — | — | — | — | — | — | 5.5 | 0.28 | 4 |
| LAB626 | 74770.2 | 0.49 | 0.15 | 10 | — | — | — | — | — | — |
| LAB626 | 74771.2 | 0.53 | 0.11 | 20 | — | — | — | — | — | — |
| CONT. | — | 0.44 | — | — | 10.2 | — | — | 5.3 | — | — |

Table 157. "CONT."—Control; "Ave."—Average; "% Incr." = % increment; "p-val."—p-value, L—p < 0.01.

TABLE 158

Genes showing improved plant performance at normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LAB748 | 74972.1 | 563.2 | 0.07 | 11 | — | — | — |
| LAB748 | 74976.2 | — | — | — | 27.2 | 0.04 | 11 |
| LAB732 | 74966.2 | 587.1 | 0.04 | 15 | — | — | — |
| LAB719 | 74804.1 | 535.1 | 0.27 | 5 | — | — | — |
| LAB719 | 74805.1 | — | — | — | 27.2 | 0.02 | 11 |
| LAB719 | 74805.2 | — | — | — | 28.2 | 0.02 | 15 |
| LAB719 | 74808.1 | — | — | — | 28.9 | L | 18 |
| LAB706 | 74801.4 | 676.9 | 0.10 | 33 | — | — | — |
| LAB695 | 74796.1 | 617.2 | 0.23 | 21 | — | — | — |
| LAB694 | 74764.3 | — | — | — | 28.2 | 0.21 | 15 |
| LAB689 | 74756.3 | 538.9 | 0.16 | 6 | — | — | — |
| LAB683 | 74871.3 | — | — | — | 32.0 | L | 31 |
| LAB683 | 74872.3 | 558.1 | 0.06 | 10 | — | — | — |
| LAB683 | 74873.1 | 610.9 | 0.16 | 20 | — | — | — |
| LAB680 | 74777.1 | — | — | — | 25.6 | 0.20 | 5 |
| LAB680 | 74777.2 | — | — | — | 28.2 | L | 15 |
| LAB675 | 74750.3 | 541.4 | 0.13 | 6 | — | — | — |
| LAB675 | 74751.4 | 608.9 | L | 20 | — | — | — |
| LAB668 | 74864.1 | 564.4 | 0.03 | 11 | — | — | — |
| LAB668 | 74865.1 | 583.0 | 0.14 | 14 | — | — | — |
| LAB668 | 74867.3 | 540.8 | 0.13 | 6 | — | — | — |
| LAB668 | 74867.6 | 547.2 | 0.16 | 7 | — | — | — |
| LAB666 | 74840.3 | 586.5 | L | 15 | — | — | — |
| LAB659 | 74835.1 | — | — | — | 26.3 | 0.01 | 7 |
| LAB659 | 74836.2 | 568.4 | 0.02 | 12 | — | — | — |
| LAB652 | 74859.1 | — | — | — | 26.3 | 0.01 | 7 |
| LAB652 | 74861.1 | — | — | — | 26.2 | 0.22 | 7 |
| LAB652 | 74863.1 | — | — | — | 27.2 | L | 11 |
| LAB626 | 74771.1 | — | — | — | 28.2 | 0.15 | 15 |
| LAB626 | 74771.2 | 594.1 | L | 17 | — | — | — |
| CONT. | — | 509.3 | — | — | 24.5 | — | — |

Table 158. "CONT."—Control; "Ave."—Average; "% Incr." = % increment; "p-val."—p-value, L—p < 0.01.

TABLE 159

Genes showing improved plant performance at drought growth conditions under regulation of At6669 promoter

| Gene Name | Event # | Dry Weight [mg] Ave. | P-Val. | % Incr. | Flowering (days) Ave. | P-Val. | % Incr. | Inflorescence Emergence (days) Ave. | P-Val. | % Incr. |
|---|---|---|---|---|---|---|---|---|---|---|
| LAB759 | 74848.1 | — | — | — | — | — | — | 17.7 | 0.09 | −5 |
| LAB759 | 74850.1 | — | — | — | — | — | — | 18.0 | 0.13 | −4 |

TABLE 159-continued

Genes showing improved plant performance at drought growth conditions under regulation of At6669 promoter

| Gene Name | Event # | Dry Weight [mg] | | | Flowering (days) | | | Inflorescence Emergence (days) | | |
|---|---|---|---|---|---|---|---|---|---|---|
| | | Ave. | P-Val. | % Incr. | Ave. | P-Val. | % Incr. | Ave. | P-Val. | % Incr. |
| LAB719 | 74804.1 | — | — | — | — | — | — | 17.7 | 0.10 | −5 |
| LAB719 | 74805.2 | — | — | — | — | — | — | 17.7 | 0.10 | −5 |
| LAB706 | 74800.2 | — | — | — | — | — | — | 17.7 | 0.04 | −5 |
| LAB697 | 74949.3 | — | — | — | — | — | — | 18.1 | 0.21 | −3 |
| LAB695 | 74793.1 | — | — | — | — | — | — | 18.1 | 0.17 | −3 |
| LAB695 | 74796.1 | — | — | — | — | — | — | 17.7 | 0.10 | −5 |
| LAB693 | 74787.1 | — | — | — | — | — | — | 18.0 | 0.13 | −4 |
| LAB693 | 74787.3 | — | — | — | — | — | — | 17.9 | 0.14 | −4 |
| LAB689 | 74756.2 | — | — | — | — | — | — | 18.0 | 0.13 | −4 |
| LAB689 | 74759.2 | — | — | — | — | — | — | 17.6 | 0.04 | −6 |
| LAB689 | 74760.1 | — | — | — | 20.8 | L | −7 | 16.4 | 0.10 | −12 |
| LAB683 | 74872.3 | — | — | — | — | — | — | 18.1 | 0.17 | −3 |
| LAB683 | 74874.1 | — | — | — | — | — | — | 18.1 | 0.20 | −3 |
| LAB680 | 74775.1 | — | — | — | 21.2 | 0.09 | −5 | 17.3 | 0.05 | −7 |
| LAB675 | 74751.3 | — | — | — | 21.5 | 0.03 | −4 | 17.0 | 0.16 | −9 |
| LAB668 | 74864.1 | — | — | — | — | — | — | 18.1 | 0.17 | −3 |
| LAB668 | 74864.2 | — | — | — | — | — | — | 18.1 | 0.17 | −3 |
| LAB659 | 74835.1 | — | — | — | 21.7 | 0.11 | −3 | 17.2 | 0.02 | −8 |
| LAB652 | 74861.1 | — | — | — | — | — | — | 18.1 | 0.17 | −3 |
| LAB652 | 74863.1 | — | — | — | — | — | — | 17.9 | 0.23 | −4 |
| CONT. | — | — | — | — | 22.3 | — | — | 18.7 | — | — |
| LAB759 | 74846.3 | 874.4 | 0.29 | 5 | — | — | — | — | — | — |
| LAB759 | 74848.4 | 896.9 | 0.03 | 7 | — | — | — | — | — | — |
| LAB719 | 74805.1 | 906.8 | 0.02 | 8 | — | — | — | — | — | — |
| LAB719 | 74805.2 | 996.2 | 0.20 | 19 | — | — | — | — | — | — |
| LAB719 | 74807.2 | — | — | — | — | — | — | 19.2 | 0.17 | −3 |
| LAB706 | 74801.2 | 995.9 | 0.01 | 19 | 23.7 | 0.04 | −2 | — | — | — |
| LAB706 | 74801.4 | 886.2 | 0.25 | 6 | — | — | — | — | — | — |
| LAB706 | 74802.2 | 879.4 | 0.19 | 5 | — | — | — | — | — | — |
| LAB697 | 74951.1 | 956.9 | 0.28 | 14 | — | — | — | — | — | — |
| LAB695 | 74792.3 | — | — | — | — | — | — | 18.9 | 0.27 | −5 |
| LAB695 | 74797.4 | 881.2 | 0.17 | 5 | — | — | — | — | — | — |
| LAB694 | 74762.1 | 899.4 | 0.24 | 8 | 23.5 | L | −3 | 19.1 | L | −4 |
| LAB694 | 74767.2 | — | — | — | 23.4 | 0.01 | −3 | 18.7 | 0.10 | −5 |
| LAB693 | 74786.3 | 891.2 | 0.15 | 7 | — | — | — | — | — | — |
| LAB693 | 74786.4 | 891.9 | 0.05 | 7 | — | — | — | — | — | — |
| LAB693 | 74787.3 | — | — | — | 23.5 | 0.10 | −3 | — | — | — |
| LAB689 | 74759.2 | — | — | — | 22.9 | 0.09 | −5 | — | — | — |
| LAB689 | 74760.1 | — | — | — | 23.2 | 0.10 | −4 | 16.4 | L | −17 |
| LAB683 | 74871.3 | 1045.6 | 0.05 | 25 | — | — | — | — | — | — |
| LAB680 | 74775.1 | 1039.8 | 0.06 | 24 | 23.7 | 0.04 | −2 | — | — | — |
| LAB680 | 74777.2 | 948.8 | 0.14 | 14 | — | — | — | 19.0 | 0.20 | −4 |
| LAB680 | 74779.1 | 883.8 | 0.21 | 6 | — | — | — | — | — | — |
| LAB675 | 74750.2 | 1046.2 | 0.08 | 25 | — | — | — | — | — | — |
| LAB675 | 74751.3 | — | — | — | 23.1 | L | −5 | 18.6 | 0.02 | −6 |
| LAB675 | 74751.4 | 878.1 | 0.10 | 5 | — | — | — | — | — | — |
| LAB668 | 74867.3 | 905.6 | 0.27 | 8 | — | — | — | — | — | — |
| LAB666 | 74840.2 | 885.6 | 0.06 | 6 | 22.9 | 0.24 | −5 | 16.3 | L | −17 |
| LAB666 | 74844.3 | — | — | — | — | — | — | 19.1 | 0.23 | −3 |
| LAB659 | 74835.1 | 1028.8 | 0.05 | 23 | — | — | — | — | — | — |
| LAB659 | 74836.1 | 906.2 | 0.02 | 8 | — | — | — | — | — | — |
| LAB659 | 74839.1 | 1023.3 | L | 22 | — | — | — | — | — | — |
| LAB652 | 74859.1 | 1109.2 | 0.24 | 33 | — | — | — | — | — | — |
| LAB652 | 74861.1 | 1050.5 | 0.01 | 26 | — | — | — | 18.8 | 0.30 | −5 |
| LAB652 | 74863.1 | 953.1 | L | 14 | — | — | — | — | — | — |
| LAB626 | 74770.2 | — | — | — | 23.7 | 0.04 | −2 | — | — | — |
| LAB626 | 74771.1 | 1108.1 | L | 33 | — | — | — | — | — | — |
| LAB626 | 74771.2 | 882.2 | 0.07 | 6 | — | — | — | — | — | — |
| LAB626 | 74773.1 | 909.4 | 0.29 | 9 | — | — | — | — | — | — |
| CONT. | — | 835.9 | — | — | 24.2 | — | — | 19.8 | — | — |

Table 159. "CONT."—Control; "Ave."—Average; "% Incr." = % increment; "p-val."—p-value, L—p < 0.01.

TABLE 160

Genes showing improved plant performance at drought growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LAB759 | 74848.1 | — | — | — | 11.5 | L | 9 | — | — | — |
| LAB732 | 74966.2 | — | — | — | 10.9 | 0.09 | 3 | — | — | — |
| LAB732 | 74969.1 | — | — | — | 11.3 | 0.06 | 7 | — | — | — |
| LAB719 | 74805.2 | — | — | — | 11.1 | 0.02 | 5 | — | — | — |
| LAB706 | 74800.2 | 1.51 | L | 27 | 12.2 | 0.19 | 15 | 93.1 | 0.01 | 30 |
| LAB706 | 74803.4 | — | — | — | 11.1 | 0.2 | 5 | — | — | — |
| LAB695 | 74793.1 | 1.24 | 0.24 | 5 | — | — | — | — | — | — |
| LAB695 | 74796.1 | 1.28 | 0.22 | 8 | — | — | — | — | — | — |
| LAB693 | 74787.1 | — | — | — | 11.3 | 0.2 | 7 | 76.0 | 0.3 | 6 |
| LAB693 | 74787.3 | 1.29 | 0.17 | 9 | 10.8 | 0.24 | 2 | — | — | — |
| LAB689 | 74756.1 | — | — | — | 10.8 | 0.24 | 2 | — | — | — |
| LAB689 | 74759.2 | — | — | — | 11.0 | 0.1 | 4 | — | — | — |
| LAB683 | 74874.1 | 1.37 | 0.19 | 15 | 11.1 | 0.04 | 5 | 84.7 | 0.16 | 18 |
| LAB675 | 74751.3 | — | — | — | — | — | — | 74.6 | 0.29 | 4 |
| LAB668 | 74864.2 | 1.27 | 0.12 | 7 | — | — | — | 74.9 | 0.24 | 4 |
| LAB659 | 74835.1 | 1.28 | 0.08 | 8 | — | — | — | 81.0 | 0.01 | 13 |
| LAB652 | 74861.1 | 1.41 | 0.04 | 19 | — | — | — | — | — | — |
| LAB652 | 74863.1 | — | — | — | 11.4 | 0.01 | 8 | 74.8 | 0.26 | 4 |
| CONT. | — | 1.19 | — | — | 10.6 | — | — | 71.9 | — | — |
| LAB759 | 74848.4 | — | — | — | — | — | — | 80.9 | 0.04 | 16 |
| LAB759 | 74850.1 | — | — | — | — | — | — | 76.2 | 0.17 | 9 |
| LAB748 | 74972.1 | — | — | — | — | — | — | 75.6 | 0.28 | 8 |
| LAB732 | 74966.1 | — | — | — | — | — | — | 77.6 | 0.17 | 11 |
| LAB732 | 74967.1 | — | — | — | 11.1 | 0.17 | 6 | — | — | — |
| LAB719 | 74804.1 | — | — | — | 11.1 | 0.09 | 6 | — | — | — |
| LAB706 | 74800.2 | 1.38 | 0.2 | 7 | — | — | — | 76.0 | 0.29 | 9 |
| LAB695 | 74797.4 | 1.39 | 0.21 | 7 | — | — | — | — | — | — |
| LAB694 | 74762.1 | — | — | — | 10.9 | 0.19 | 4 | — | — | — |
| LAB694 | 74767.2 | 1.46 | 0.07 | 13 | — | — | — | 81.7 | 0.25 | 17 |
| LAB693 | 74786.3 | 1.42 | 0.09 | 10 | — | — | — | — | — | — |
| LAB693 | 74787.1 | — | — | — | 11.2 | 0.06 | 7 | — | — | — |
| LAB689 | 74756.2 | 1.43 | 0.21 | 11 | 11.1 | 0.11 | 6 | 86.3 | 0.02 | 23 |
| LAB689 | 74756.3 | 1.48 | 0.1 | 14 | — | — | — | 80.7 | 0.06 | 15 |
| LAB689 | 74759.2 | 1.43 | 0.12 | 11 | — | — | — | 77.2 | 0.14 | 10 |
| LAB689 | 74760.1 | 1.39 | 0.3 | 8 | — | — | — | 75.0 | 0.3 | 7 |
| LAB683 | 74874.1 | — | — | — | 11.2 | 0.06 | 7 | 77.5 | 0.2 | 11 |
| LAB675 | 74751.3 | — | — | — | 11.4 | 0.03 | 9 | — | — | — |
| LAB668 | 74864.2 | — | — | — | 10.9 | 0.27 | 4 | — | — | — |
| LAB668 | 74865.1 | 1.54 | L | 19 | — | — | — | 83.5 | 0.02 | 19 |
| LAB666 | 74840.2 | 1.52 | 0.01 | 18 | — | — | — | 84.8 | 0.01 | 21 |
| LAB666 | 74840.3 | — | — | — | 11.2 | 0.2 | 7 | — | — | — |
| LAB666 | 74841.2 | — | — | — | 11.1 | 0.17 | 6 | 79.3 | 0.07 | 13 |
| CONT. | — | 1.29 | — | — | 10.5 | — | — | 69.9 | — | — |

Table 160. "CONT."—Control; "Ave."—Average; "% Incr." = % increment; "p-val."—p-value, L—p < 0.01.

TABLE 161

Genes showing improved plant performance at drought growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB759 | 74848.1 | — | — | — | 11.7 | 0.13 | 17 | 0.505 | 0.14 | 11 |
| LAB732 | 74969.1 | — | — | — | — | — | — | 0.508 | 0.13 | 11 |
| LAB706 | 74800.2 | — | — | — | 12.9 | L | 29 | 0.518 | 0.06 | 14 |
| LAB693 | 74787.1 | 0.8 | 0.15 | 21 | — | — | — | — | — | — |
| LAB693 | 74787.3 | — | — | — | — | — | — | 0.496 | 0.21 | 9 |
| LAB683 | 74874.1 | — | — | — | 11.7 | 0.11 | 17 | — | — | — |
| LAB659 | 74835.1 | — | — | — | 11.3 | 0.18 | 14 | — | — | — |
| LAB652 | 74861.1 | — | — | — | 11.7 | 0.14 | 17 | — | — | — |
| CONT. | — | 0.7 | — | — | 10.0 | — | — | 0.456 | — | — |

TABLE 161-continued

Genes showing improved plant performance at drought growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB759 | 74848.4 | — | — | — | 11.3 | 0.16 | 19 | — | — | — |
| LAB694 | 74767.2 | — | — | — | 11.3 | 0.17 | 19 | — | — | — |
| LAB689 | 74756.2 | — | — | — | 11.8 | 0.08 | 24 | — | — | — |
| LAB689 | 74756.3 | — | — | — | 10.8 | 0.29 | 14 | — | — | — |
| LAB675 | 74751.3 | 0.7 | 0.13 | 31 | — | — | — | — | — | — |
| LAB668 | 74864.2 | 0.7 | 0.23 | 24 | — | — | — | — | — | — |
| LAB668 | 74865.1 | — | — | — | 11.2 | 0.20 | 17 | — | — | — |
| LAB666 | 74840.2 | — | — | — | 11.6 | 0.10 | 23 | — | — | — |
| LAB666 | 74841.2 | 0.7 | 0.29 | 21 | 10.9 | 0.26 | 15 | — | — | — |
| CONT. | — | 0.6 | — | — | 9.5 | — | — | — | — | — |

Table 161. "CONT."—Control; "Ave."—Average; "% Incr." = % increment; "p-val."—p-value, L—p < 0.01.

TABLE 162

Genes showing improved plant performance at drought growth conditions under regulation of At6669 promoter

| Gene Name | Event # | Harvest Index | | | Rosette Area [cm2] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB732 | 74969.1 | — | — | — | — | — | — | 5.35 | 0.25 | 8 |
| LAB706 | 74800.2 | — | — | — | 11.6 | 0.01 | 30 | 5.69 | L | 15 |
| LAB693 | 74787.1 | — | — | — | 9.5 | 0.3 | 6 | 5.05 | 0.3 | 2 |
| LAB689 | 74759.2 | — | — | — | — | — | — | 5.10 | 0.21 | 3 |
| LAB683 | 74874.1 | — | — | — | 10.6 | 0.16 | 18 | 5.32 | 0.03 | 7 |
| LAB675 | 74751.3 | — | — | — | 9.3 | 0.29 | 4 | — | — | — |
| LAB668 | 74864.2 | — | — | — | 9.4 | 0.24 | 4 | 5.16 | 0.25 | 4 |
| LAB659 | 74835.1 | — | — | — | 10.1 | 0.01 | 13 | 5.24 | 0.13 | 6 |
| LAB652 | 74863.1 | — | — | — | 9.3 | 0.26 | 4 | — | — | — |
| CONT. | — | — | — | — | 9.0 | — | — | 4.96 | — | — |
| LAB759 | 74846.1 | — | — | — | — | — | — | 5.14 | 0.24 | 4 |
| LAB759 | 74847.1 | 0.46 | 0.15 | 21 | — | — | — | — | — | — |
| LAB759 | 74848.4 | — | — | — | 10.1 | 0.04 | 16 | 5.13 | 0.26 | 4 |
| LAB759 | 74850.1 | 0.48 | 0.14 | 25 | 9.5 | 0.17 | 9 | — | — | — |
| LAB748 | 74972.1 | — | — | — | 9.5 | 0.28 | 8 | — | — | — |
| LAB748 | 74977.2 | 0.44 | 0.21 | 16 | — | — | — | — | — | — |
| LAB748 | 74977.3 | 0.53 | 0.01 | 40 | — | — | — | — | — | — |
| LAB732 | 74966.1 | — | — | — | 9.7 | 0.17 | 11 | 5.12 | 0.3 | 3 |
| LAB732 | 74967.1 | 0.47 | L | 23 | — | — | — | — | — | — |
| LAB706 | 74800.2 | — | — | — | 9.5 | 0.29 | 9 | — | — | — |
| LAB697 | 74949.1 | 0.43 | 0.08 | 13 | — | — | — | — | — | — |
| LAB697 | 74949.3 | 0.43 | 0.27 | 12 | — | — | — | — | — | — |
| LAB695 | 74796.1 | 0.42 | 0.23 | 9 | — | — | — | — | — | — |
| LAB695 | 74797.4 | 0.43 | 0.03 | 13 | — | — | — | — | — | — |
| LAB694 | 74767.2 | — | — | — | 10.2 | 0.25 | 17 | 5.32 | 0.28 | 7 |
| LAB693 | 74786.3 | — | — | — | — | — | — | 5.19 | 0.28 | 5 |
| LAB689 | 74756.1 | 0.47 | 0.25 | 22 | — | — | — | — | — | — |
| LAB689 | 74756.2 | 0.40 | 0.28 | 6 | 10.8 | 0.02 | 23 | 5.45 | 0.03 | 10 |
| LAB689 | 74756.3 | — | — | — | 10.1 | 0.06 | 15 | 5.25 | 0.25 | 6 |
| LAB689 | 74759.2 | — | — | — | 9.6 | 0.14 | 10 | — | — | — |
| LAB689 | 74760.1 | 0.46 | 0.04 | 20 | 9.4 | 0.3 | 7 | — | — | — |
| LAB683 | 74874.1 | — | — | — | 9.7 | 0.2 | 11 | — | — | — |
| LAB680 | 74774.1 | 0.42 | 0.19 | 10 | — | — | — | — | — | — |
| LAB675 | 74750.2 | — | — | — | — | — | — | 5.17 | 0.2 | 4 |
| LAB675 | 74750.3 | 0.43 | 0.19 | 12 | — | — | — | — | — | — |
| LAB675 | 74751.4 | 0.42 | 0.04 | 10 | — | — | — | — | — | — |
| LAB675 | 74753.1 | 0.43 | 0.07 | 13 | — | — | — | — | — | — |
| LAB668 | 74865.1 | — | — | — | 10.4 | 0.02 | 19 | 5.20 | 0.17 | 5 |
| LAB666 | 74840.2 | 0.42 | 0.08 | 9 | 10.6 | 0.01 | 21 | 5.29 | 0.06 | 7 |
| LAB666 | 74841.2 | — | — | — | 9.9 | 0.07 | 13 | — | — | — |
| LAB626 | 74771.3 | 0.42 | 0.11 | 11 | — | — | — | — | — | — |
| CONT. | — | 0.38 | — | — | 8.7 | — | — | 4.95 | — | — |

Table 162. "CONT."—Control; "Ave."—Average; "% Incr." = % increment; "p-val."—p-value, L—p < 0.01.

TABLE 163

Genes showing improved plant performance at drought growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LAB759 | 74847.1 | 363.3 | 0.06 | 14 | — | — | — |
| LAB759 | 74850.1 | 397.4 | 0.16 | 24 | — | — | — |
| LAB748 | 74977.3 | 414.7 | 0.05 | 30 | — | — | — |
| LAB732 | 74967.1 | 371.5 | L | 16 | — | — | — |
| LAB719 | 74805.2 | — | — | — | 27.9 | 0.15 | 17 |
| LAB719 | 74807.2 | 377.4 | 0.04 | 18 | — | — | — |
| LAB697 | 74949.1 | 367.0 | L | 15 | — | — | — |
| LAB697 | 74949.3 | 362.1 | 0.26 | 13 | — | — | — |
| LAB695 | 74795.1 | — | — | — | 24.8 | 0.15 | 4 |
| LAB695 | 74796.1 | 345.7 | 0.11 | 8 | — | — | — |
| LAB695 | 74797.4 | 380.6 | 0.06 | 19 | — | — | — |
| LAB694 | 74762.1 | — | — | — | 26.3 | L | 10 |
| LAB694 | 74764.3 | — | — | — | 26.8 | 0.21 | 13 |
| LAB689 | 74760.1 | 377.7 | 0.08 | 18 | — | — | — |
| LAB683 | 74871.3 | — | — | — | 29.4 | 0.14 | 23 |
| LAB680 | 74775.1 | — | — | — | 28.5 | 0.04 | 19 |
| LAB680 | 74777.2 | — | — | — | 26.5 | L | 11 |
| LAB675 | 74750.3 | 379.1 | L | 19 | — | — | — |
| LAB675 | 74751.3 | — | — | — | 26.5 | 0.26 | 11 |
| LAB675 | 74751.4 | 370.2 | L | 16 | — | — | — |
| LAB675 | 74753.1 | 360.2 | 0.06 | 13 | — | — | — |
| LAB668 | 74864.1 | 376.4 | 0.14 | 18 | — | — | — |
| LAB668 | 74865.1 | 378.2 | 0.18 | 18 | — | — | — |
| LAB668 | 74867.3 | 339.9 | 0.21 | 6 | — | — | — |
| LAB666 | 74840.2 | 370.0 | L | 16 | — | — | — |
| LAB659 | 74835.1 | — | — | — | 26.9 | L | 13 |
| LAB659 | 74836.1 | — | — | — | 24.5 | 0.21 | 3 |
| LAB659 | 74839.1 | — | — | — | 28.1 | 0.11 | 18 |
| LAB652 | 74859.1 | — | — | — | 27.2 | L | 14 |
| LAB652 | 74861.1 | — | — | — | 28.1 | L | 18 |
| LAB626 | 74771.1 | — | — | — | 29.0 | 0.03 | 22 |
| CONT. | — | 319.3 | — | — | 23.8 | — | — |

Table 163. "CONT."—Control; "Ave."—Average; "% Incr." = % increment; "p-val."—p-value, L—p < 0.01.

Example 24

Evaluation of Transgenic *Arabidopsis* ABST, Biomass and Plant Growth Rate Under Abiotic Stress as Well as Under Standard Conditions in Greenhouse Assay (GH—SB Assays)

Assay 2—ABST Measured Until Bolting Stage.

Plant biomass and plant growth rate under drought conditions and standard growth conditions in greenhouse experiments—This assay follows the plant biomass formation and the rosette area growth of plants grown in the greenhouse under drought conditions and standard growth conditions. Transgenic *Arabidopsis* seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress (drought conditions). All plants are grown in the greenhouse until bolting stage. At harvest, plant biomass (the above ground tissue) was weighted directly after harvesting the rosette (plant fresh weight [FW]). Thereafter, plants were dried in an oven at 50° C. for 48 hours and weighted (plant dry weight [DW]).

Each construct was validated at its $T_2$ generation (under the control of the At6669 promoter, SEQ ID NO:10446). Transgenic plants transformed with a construct conformed by an empty vector carrying the At6669 promoter (SEQ ID NO:10446) and the selectable marker was used as control.

The plants were analyzed for their overall size, growth rate, fresh weight and dry matter. Transgenic plants performance was compared to control plants grown in parallel under the same conditions. Mock-transgenic plants with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) is used for capturing images of plant samples.

The image capturing process was repeated every 2 days starting from day 1 after transplanting till day 16. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 (Java based image processing program which was developed at the U.S National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area, Petiole Relative Area and leaf petiole length.

Vegetative growth rate: the relative growth rate (RGR) of leaf blade area (Formula XX), leaf number (Formula XXI), rosette area (Formula XXII), rosette diameter (Formula XXIII), plot coverage (Formula XXIV) and Petiole Relative Area (XXV) as described above.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results:

The genes were cloned under the regulation of a constitutive (At6669; SEQ ID NO: 10446). The evaluation of each gene was performed by testing the performance of different number of events. Event with p-value<0.1 was considered statistically significant.

The genes listed in Tables 164-166 improved plant ABST when grown under drought conditions. These genes produced larger plants with a larger photosynthetic area and increased biomass and growth rate [dry weight, fresh weight, leaf number, rosette diameter, rosette area, plot coverage, growth rate (RGR) of leaf number, growth rate (RGR) of plot coverage, growth rate (RGR) of rosette diameter] when grown under drought conditions.

The genes listed in Tables 167-169 improved plant performance when grown under standard (normal) growth conditions. These genes produced larger plants with a larger photosynthetic area and increased biomass and growth rate [dry weight, fresh weight, leaf number, rosette diameter, rosette area, plot coverage, growth rate (RGR) of leaf number, growth rate (RGR) of plot coverage, growth rate (RGR) of rosette diameter] when grown under normal conditions.

TABLE 164

Genes showing improved plant performance at drought growth conditions under regulation of A6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB824 | 75505.8 | 106.9 | 0.19 | 16 | — | — | — | — | — | — |
| LAB795 | 76491.3 | 116.9 | 0.08 | 26 | 1381.2 | 0.14 | 26 | 10.2 | 0.05 | 9 |
| LAB795 | 76494.5 | 102.1 | 0.28 | 10 | — | — | — | — | — | — |
| LAB795 | 76494.6 | — | — | — | — | — | — | 9.9 | 0.14 | 6 |
| LAB792 | 75876.1 | — | — | — | — | — | — | 9.8 | 0.28 | 5 |
| LAB792 | 75876.3 | — | — | — | — | — | — | 10.1 | 0.08 | 8 |
| LAB790 | 75713.2 | 114.4 | 0.03 | 24 | 1387.5 | 0.03 | 27 | 9.9 | 0.27 | 6 |
| LAB789 | 77081.1 | — | — | — | 1237.5 | 0.22 | 13 | — | — | — |
| LAB784 | 76466.3 | 108.6 | 0.09 | 17 | 1225.9 | 0.26 | 12 | — | — | — |
| LAB784 | 76467.4 | 121.2 | 0.20 | 31 | — | — | — | 10.6 | 0.02 | 13 |
| LAB784 | 76468.4 | 102.5 | 0.26 | 11 | — | — | — | — | — | — |
| LAB784 | 76470.2 | — | — | — | — | — | — | 10.2 | 0.25 | 9 |
| LAB769 | 75348.4 | 113.7 | 0.06 | 23 | — | — | — | — | — | — |
| LAB750 | 75447.2 | 116.2 | 0.22 | 26 | 1418.8 | 0.02 | 30 | 9.8 | 0.28 | 4 |
| LAB730 | 75180.2 | 113.5 | 0.04 | 23 | 1364.3 | 0.07 | 25 | 10.5 | 0.04 | 12 |
| LAB729 | 77303.10 | — | — | — | — | — | — | 9.8 | 0.28 | 5 |
| LAB729 | 77303.7 | 113.8 | 0.06 | 23 | 1362.5 | 0.27 | 25 | — | — | — |
| LAB713 | 75092.1 | — | — | — | 1243.8 | 0.21 | 14 | — | — | — |
| LAB670 | 75303.1 | — | — | — | 1429.5 | 0.02 | 31 | — | — | — |
| LAB656 | 77320.6 | 109.4 | 0.09 | 18 | 1393.8 | 0.22 | 27 | 10.6 | 0.22 | 13 |
| LAB649 | 77041.3 | — | — | — | 1298.2 | 0.17 | 19 | — | — | — |
| LAB649 | 77044.2 | 107.0 | 0.16 | 16 | — | — | — | — | — | — |
| LAB649 | 77045.3 | 118.8 | 0.02 | 28 | 1293.8 | 0.11 | 18 | — | — | — |
| LAB637 | 75105.5 | 103.7 | 0.22 | 12 | — | — | — | — | — | — |
| LAB637 | 75105.7 | — | — | — | 1305.4 | 0.09 | 19 | — | — | — |
| LAB637 | 75105.8 | — | — | — | — | — | — | 10.4 | 0.17 | 12 |
| LAB636 | 75100.3 | 122.5 | 0.03 | 32 | 1556.2 | 0.09 | 42 | 10.3 | 0.11 | 10 |
| LAB636 | 75104.8 | 105.0 | 0.27 | 14 | 1425.0 | 0.15 | 30 | 10.2 | 0.05 | 9 |
| CONT. | — | 92.5 | — | — | 1093.9 | — | — | 9.4 | — | — |
| LAB839 | 75624.1 | 57.5 | 0.13 | 14 | 531.2 | 0.02 | 30 | — | — | — |
| LAB809 | 75653.2 | 60.0 | 0.01 | 19 | 519.6 | L | 28 | — | — | — |
| LAB805 | 76117.2 | — | — | — | 462.5 | 0.20 | 14 | — | — | — |
| LAB798 | 75615.4 | — | — | — | 450.0 | 0.11 | 10 | — | — | — |
| LAB798 | 75616.2 | 54.7 | 0.16 | 8 | 473.2 | 0.01 | 16 | — | — | — |
| LAB792 | 75876.1 | 58.1 | 0.29 | 15 | 437.5 | 0.15 | 7 | — | — | — |
| LAB792 | 75876.2 | — | — | — | — | — | — | 11.6 | L | 7 |
| LAB790 | 75711.1 | — | — | — | — | — | — | 11.8 | L | 8 |
| LAB790 | 75713.2 | 66.5 | L | 32 | 558.9 | L | 37 | — | — | — |
| LAB740 | 75265.3 | 53.8 | 0.28 | 6 | — | — | — | — | — | — |
| LAB733 | 75158.2 | — | — | — | — | — | — | 11.4 | 0.03 | 5 |
| LAB733 | 75158.5 | — | — | — | 518.8 | 0.20 | 27 | 11.8 | 0.21 | 8 |
| LAB686 | 75364.6 | 56.2 | 0.08 | 11 | — | — | — | — | — | — |
| LAB686 | 75365.2 | — | — | — | — | — | — | 11.9 | 0.18 | 9 |
| LAB681 | 75418.2 | — | — | — | — | — | — | 11.8 | 0.24 | 9 |
| LAB679 | 75629.1 | — | — | — | 492.0 | 0.06 | 21 | — | — | — |
| LAB679 | 75629.4 | — | — | — | 480.4 | L | 18 | 11.2 | 0.28 | 3 |
| LAB679 | 75631.1 | — | — | — | 537.5 | 0.27 | 32 | 12.3 | 0.01 | 13 |
| LAB665 | 75040.3 | 57.5 | 0.13 | 14 | 518.8 | 0.28 | 27 | — | — | — |
| LAB665 | 75042.3 | 60.4 | 0.12 | 20 | 504.5 | 0.15 | 24 | — | — | — |
| LAB655 | 75119.1 | 60.7 | 0.04 | 20 | 500.0 | 0.01 | 23 | 11.6 | 0.23 | 7 |
| LAB655 | 75119.2 | — | — | — | 443.8 | 0.25 | 9 | — | — | — |
| LAB655 | 75122.1 | 59.4 | 0.13 | 18 | 525.0 | 0.05 | 29 | 11.5 | 0.16 | 6 |
| LAB640 | 76268.1 | — | — | — | — | — | — | 11.1 | 0.26 | 2 |
| CONT. | — | 50.5 | — | — | 407.3 | — | — | 10.9 | — | — |
| LAB815 | 76027.1 | — | — | — | — | — | — | 10.3 | 0.10 | 6 |
| LAB815 | 76027.2 | — | — | — | 1042.9 | 0.29 | 8 | 10.3 | 0.10 | 6 |
| LAB815 | 76029.4 | — | — | — | — | — | — | 10.2 | 0.22 | 6 |
| LAB815 | 76030.1 | 103.1 | 0.26 | 15 | 1162.5 | 0.03 | 20 | — | — | — |

TABLE 164-continued

Genes showing improved plant performance at drought growth conditions under regulation of A6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB794 | 75881.2 | 97.5 | 0.14 | 9 | — | — | — | — | — | — |
| LAB794 | 75883.1 | — | — | — | — | — | — | 10.2 | 0.05 | 6 |
| LAB794 | 75883.2 | — | — | — | 1071.4 | 0.28 | 10 | — | — | — |
| LAB794 | 75884.1 | — | — | — | 1027.7 | 0.18 | 6 | — | — | — |
| LAB794 | 75884.2 | — | — | — | — | — | — | 10.3 | L | 6 |
| LAB774 | 76372.2 | 98.5 | 0.12 | 10 | 1069.6 | 0.20 | 10 | — | — | — |
| LAB774 | 76375.1 | 103.1 | 0.05 | 15 | — | — | — | — | — | — |
| LAB774 | 76375.3 | 101.9 | 0.02 | 13 | — | — | — | 10.0 | 0.22 | 3 |
| LAB762 | 75866.2 | — | — | — | — | — | — | 10.2 | 0.22 | 6 |
| LAB762 | 75869.2 | — | — | — | 1112.5 | 0.27 | 15 | — | — | — |
| LAB762 | 75869.3 | — | — | — | — | — | — | 10.3 | 0.26 | 6 |
| LAB748 | 74972.1 | — | — | — | — | — | — | 10.3 | 0.26 | 6 |
| LAB748 | 74972.3 | — | — | — | 1037.5 | 0.18 | 7 | 10.4 | 0.16 | 7 |
| LAB748 | 74972.4 | — | — | — | — | — | — | 10.5 | 0.25 | 8 |
| LAB748 | 74976.2 | — | — | — | — | — | — | 10.7 | L | 10 |
| LAB748 | 74977.2 | — | — | — | — | — | — | 10.4 | 0.16 | 7 |
| LAB732 | 74966.2 | — | — | — | — | — | — | 10.4 | 0.02 | 7 |
| LAB732 | 74967.1 | — | — | — | 1026.7 | 0.17 | 6 | — | — | — |
| LAB732 | 74971.1 | — | — | — | — | — | — | 10.1 | 0.08 | 4 |
| LAB732 | 74971.3 | 94.4 | 0.27 | 5 | — | — | — | — | — | — |
| LAB732 | 74971.5 | — | — | — | — | — | — | 10.2 | 0.03 | 5 |
| LAB712 | 76208.1 | 101.9 | 0.14 | 13 | 1100.0 | 0.03 | 13 | — | — | — |
| LAB712 | 76208.3 | — | — | — | — | — | — | 10.4 | 0.02 | 7 |
| LAB712 | 76208.4 | 104.4 | 0.04 | 16 | 1062.5 | 0.08 | 10 | — | — | — |
| LAB712 | 76210.1 | 108.8 | 0.03 | 21 | 1118.8 | L | 15 | — | — | — |
| LAB706 | 74800.1 | 106.9 | 0.29 | 19 | 1143.8 | 0.12 | 18 | 10.1 | 0.10 | 4 |
| LAB695 | 74793.1 | — | — | — | 1043.8 | 0.19 | 8 | 10.0 | 0.22 | 3 |
| LAB695 | 74793.2 | — | — | — | — | — | — | 10.1 | 0.26 | 4 |
| LAB689 | 74759.2 | — | — | — | — | — | — | 9.9 | 0.23 | 2 |
| LAB689 | 74760.1 | 97.5 | 0.14 | 9 | 1058.9 | 0.06 | 9 | 11.1 | 0.17 | 14 |
| LAB683 | 74871.2 | 96.2 | 0.15 | 7 | — | — | — | 10.3 | 0.10 | 6 |
| LAB683 | 74871.4 | — | — | — | — | — | — | 10.1 | 0.08 | 4 |
| LAB683 | 74872.1 | 108.6 | 0.11 | 21 | — | — | — | 10.4 | 0.07 | 7 |
| LAB683 | 74872.3 | — | — | — | 1035.7 | 0.27 | 7 | — | — | — |
| LAB680 | 74774.1 | — | — | — | 1050.0 | 0.10 | 8 | — | — | — |
| LAB680 | 74774.3 | — | — | — | 1112.5 | L | 15 | 10.8 | L | 11 |
| LAB680 | 74774.4 | 103.8 | 0.27 | 16 | 1062.5 | 0.08 | 10 | — | — | — |
| LAB680 | 74775.1 | 103.1 | 0.02 | 15 | 1025.0 | 0.26 | 6 | — | — | — |
| LAB680 | 74777.2 | — | — | — | — | — | — | 10.2 | 0.03 | 5 |
| LAB666 | 74840.2 | — | — | — | — | — | — | 10.6 | 0.21 | 9 |
| LAB666 | 74840.3 | — | — | — | — | — | — | 10.6 | L | 9 |
| LAB624 | 77108.1 | — | — | — | 1041.1 | 0.11 | 7 | — | — | — |
| LAB624 | 77110.4 | 101.2 | 0.19 | 13 | — | — | — | — | — | — |
| LAB619 | 77314.2 | — | — | — | 1050.0 | 0.12 | 8 | 10.0 | 0.22 | 3 |
| CONT. | — | 89.8 | — | — | 969.6 | — | — | 9.7 | — | — |
| LAB837 | 76256.3 | 160.4 | L | 29 | 1680.4 | 0.17 | 22 | — | — | — |
| LAB837 | 76256.5 | 150.6 | L | 21 | 1656.2 | 0.06 | 20 | — | — | — |
| LAB837 | 76259.4 | 152.0 | 0.23 | 23 | 1750.0 | L | 27 | 9.8 | 0.08 | 13 |
| LAB837 | 76259.6 | 139.2 | 0.08 | 12 | — | — | — | — | — | — |
| LAB835 | 75896.4 | 132.4 | 0.27 | 7 | — | — | — | — | — | — |
| LAB835 | 75896.5 | 138.1 | 0.07 | 11 | — | — | — | 9.4 | 0.15 | 8 |
| LAB833 | 75465.1 | 151.2 | 0.20 | 22 | — | — | — | — | — | — |
| LAB833 | 75466.1 | 152.5 | 0.04 | 23 | — | — | — | 9.4 | L | 8 |
| LAB833 | 75467.3 | 137.8 | 0.22 | 11 | — | — | — | 9.2 | 0.19 | 7 |
| LAB800 | 75331.5 | — | — | — | — | — | — | 9.4 | 0.20 | 9 |
| LAB786 | 76226.1 | — | — | — | — | — | — | 9.1 | 0.01 | 6 |
| LAB786 | 76229.1 | — | — | — | — | — | — | 8.9 | 0.13 | 3 |
| LAB780 | 75772.2 | 134.4 | 0.21 | 8 | — | — | — | 9.1 | 0.02 | 5 |
| LAB778 | 75966.2 | 150.0 | 0.24 | 21 | — | — | — | — | — | — |
| LAB778 | 75966.3 | 140.0 | 0.16 | 13 | 1587.5 | 0.27 | 15 | 9.8 | L | 14 |
| LAB778 | 75967.2 | — | — | — | — | — | — | 9.1 | 0.20 | 5 |
| LAB778 | 75970.1 | 144.8 | 0.28 | 17 | — | — | — | 9.5 | 0.23 | 10 |
| LAB776 | 75749.1 | — | — | — | — | — | — | 8.9 | 0.08 | 3 |
| LAB776 | 75749.5 | 134.5 | 0.15 | 8 | — | — | — | 9.0 | 0.04 | 4 |
| LAB776 | 75750.3 | 141.9 | 0.21 | 14 | 1487.5 | 0.18 | 8 | — | — | — |
| LAB776 | 75750.4 | — | — | — | — | — | — | 9.4 | 0.15 | 8 |
| LAB772 | 75461.3 | — | — | — | — | — | — | 8.9 | 0.28 | 3 |
| LAB772 | 75461.6 | — | — | — | — | — | — | 9.1 | 0.20 | 5 |
| LAB772 | 75462.5 | 135.0 | 0.22 | 9 | — | — | — | 9.1 | 0.01 | 6 |
| LAB752 | 75165.2 | 139.9 | 0.03 | 13 | — | — | — | — | — | — |
| LAB752 | 75168.1 | 143.8 | 0.25 | 16 | 1587.5 | 0.23 | 15 | 9.7 | 0.04 | 12 |
| LAB752 | 75168.2 | 135.8 | 0.30 | 9 | — | — | — | 8.9 | 0.08 | 3 |

TABLE 164-continued

Genes showing improved plant performance at drought growth conditions under regulation of A6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB752 | 75168.3 | 149.4 | L | 20 | 1525.0 | 0.08 | 10 | — | — | — |
| LAB752 | 75170.1 | 140.5 | 0.14 | 13 | — | — | — | — | — | — |
| LAB746 | 75507.6 | — | — | — | — | — | — | 9.2 | 0.13 | 6 |
| LAB746 | 75507.8 | — | — | — | — | — | — | 9.5 | 0.23 | 10 |
| LAB746 | 75508.2 | — | — | — | — | — | — | 8.8 | 0.28 | 2 |
| LAB739 | 75442.1 | 142.9 | 0.26 | 15 | 1550.0 | 0.27 | 12 | — | — | — |
| LAB739 | 75444.5 | — | — | — | — | — | — | 9.9 | 0.07 | 14 |
| LAB733 | 75155.2 | — | — | — | — | — | — | 9.2 | 0.03 | 7 |
| LAB733 | 75157.2 | — | — | — | — | — | — | 8.8 | 0.28 | 2 |
| LAB718 | 75436.1 | — | — | — | — | — | — | 9.0 | 0.25 | 5 |
| LAB718 | 75437.2 | — | — | — | 1525.0 | 0.15 | 10 | — | — | — |
| LAB718 | 75439.2 | 139.4 | 0.05 | 12 | — | — | — | — | — | — |
| LAB718 | 75439.3 | 147.5 | 0.20 | 19 | — | — | — | — | — | — |
| LAB716 | 75431.2 | 167.5 | L | 35 | 1756.2 | 0.13 | 27 | 9.6 | 0.10 | 11 |
| LAB681 | 75419.1 | 153.0 | 0.03 | 23 | 1596.4 | 0.04 | 15 | 9.1 | 0.22 | 5 |
| LAB681 | 75421.2 | — | — | — | — | — | — | 9.1 | 0.02 | 5 |
| LAB681 | 75421.4 | — | — | — | — | — | — | 9.6 | 0.05 | 11 |
| LAB681 | 75421.5 | 138.5 | 0.06 | 12 | — | — | — | — | — | — |
| CONT. | — | 124.0 | — | — | 1382.9 | — | — | 8.6 | — | — |
| LAB824 | 75504.1 | 126.3 | 0.10 | 15 | — | — | — | — | — | — |
| LAB824 | 75505.7 | 120.9 | 0.10 | 10 | — | — | — | — | — | — |
| LAB795 | 76491.3 | 123.1 | 0.19 | 12 | 1356.2 | 0.05 | 7 | 11.4 | 0.06 | 9 |
| LAB795 | 76500.3 | — | — | — | 1375.0 | 0.14 | 8 | — | — | — |
| LAB790 | 75713.2 | — | — | — | 1381.2 | 0.17 | 9 | — | — | — |
| LAB789 | 77085.1 | 130.6 | 0.19 | 19 | — | — | — | — | — | — |
| LAB784 | 76469.1 | — | — | — | — | — | — | 11.4 | 0.26 | 9 |
| LAB769 | 75311.5 | 115.0 | 0.28 | 5 | — | — | — | — | — | — |
| LAB730 | 75180.3 | 130.9 | 0.02 | 19 | — | — | — | — | — | — |
| LAB713 | 75090.2 | 120.6 | 0.05 | 10 | — | — | — | — | — | — |
| LAB713 | 75092.4 | 120.6 | 0.05 | 10 | — | — | — | — | — | — |
| LAB708 | 75340.2 | 116.9 | 0.24 | 6 | — | — | — | — | — | — |
| LAB649 | 77042.4 | — | — | — | 1477.7 | 0.15 | 16 | — | — | — |
| LAB649 | 77044.2 | 130.0 | 0.04 | 18 | — | — | — | — | — | — |
| LAB636 | 75100.3 | — | — | — | 1343.8 | 0.05 | 6 | 11.4 | 0.20 | 9 |
| LAB636 | 75104.1 | 128.8 | L | 17 | 1400.0 | L | 10 | 11.3 | 0.07 | 8 |
| LAB618 | 77782.2 | — | — | — | — | — | — | 11.2 | 0.09 | 8 |
| LAB618 | 77784.2 | 128.1 | 0.05 | 17 | 1331.2 | 0.13 | 5 | 11.4 | 0.10 | 9 |
| CONT. | — | 109.9 | — | — | 1269.9 | — | — | 10.5 | — | — |
| LAB848 | 77339.2 | — | — | — | — | — | — | 11.7 | 0.19 | 11 |
| LAB842 | 76348.1 | — | — | — | — | — | — | 11.2 | 0.13 | 7 |
| LAB842 | 76350.2 | — | — | — | — | — | — | 10.9 | 0.19 | 4 |
| LAB841 | 76803.1 | — | — | — | 475.0 | 0.09 | 23 | 11.4 | 0.03 | 9 |
| LAB832 | 77332.4 | — | — | — | 425.0 | 0.14 | 10 | — | — | — |
| LAB829 | 76442.2 | — | — | — | — | — | — | 11.2 | 0.22 | 6 |
| LAB827 | 76795.5 | — | — | — | — | — | — | 10.9 | 0.15 | 3 |
| LAB816 | 76719.1 | 53.1 | 0.26 | 31 | — | — | — | — | — | — |
| LAB803 | 76760.1 | 52.1 | 0.04 | 29 | 500.0 | L | 29 | 11.0 | 0.07 | 5 |
| LAB803 | 76760.2 | — | — | — | — | — | — | 11.0 | 0.03 | 5 |
| LAB779 | 77306.4 | 48.3 | 0.30 | 19 | 432.1 | 0.16 | 12 | — | — | — |
| LAB770 | 77765.2 | — | — | — | 443.8 | 0.27 | 15 | — | — | — |
| LAB767 | 77701.1 | 45.7 | 0.28 | 13 | 421.4 | 0.13 | 9 | — | — | — |
| LAB767 | 77705.1 | — | — | — | — | — | — | 10.8 | 0.16 | 3 |
| LAB765 | 76113.3 | — | — | — | — | — | — | 10.9 | 0.15 | 3 |
| LAB764 | 76107.5 | — | — | — | — | — | — | 11.2 | 0.13 | 7 |
| LAB764 | 76110.5 | — | — | — | — | — | — | 11.2 | 0.01 | 7 |
| LAB758 | 76490.4 | — | — | — | 469.6 | 0.28 | 21 | 11.9 | 0.21 | 14 |
| LAB757 | 77326.3 | — | — | — | 437.5 | 0.06 | 13 | 11.2 | L | 6 |
| LAB757 | 77329.1 | 51.0 | 0.20 | 26 | 433.0 | 0.04 | 12 | — | — | — |
| LAB753 | 76439.3 | — | — | — | — | — | — | 10.8 | 0.16 | 3 |
| LAB753 | 76440.2 | 46.2 | 0.24 | 14 | — | — | — | — | — | — |
| LAB751 | 76929.2 | — | — | — | — | — | — | 11.4 | L | 8 |
| LAB749 | 77757.4 | 50.6 | 0.07 | 25 | 456.2 | 0.07 | 18 | — | — | — |
| LAB742 | 76434.3 | — | — | — | — | — | — | 11.3 | 0.29 | 8 |
| LAB735 | 77323.1 | — | — | — | — | — | — | 11.1 | 0.02 | 5 |
| LAB735 | 77324.4 | — | — | — | — | — | — | 10.9 | 0.05 | 4 |
| LAB731 | 77133.1 | — | — | — | 433.0 | 0.04 | 12 | — | — | — |
| LAB717 | 76430.1 | — | — | — | — | — | — | 11.8 | 0.05 | 12 |
| LAB703 | 76422.2 | — | — | — | — | — | — | 10.9 | 0.15 | 3 |
| LAB691 | 74784.2 | 59.4 | 0.20 | 47 | — | — | — | 11.4 | 0.03 | 9 |
| LAB691 | 74785.4 | — | — | — | — | — | — | 11.1 | 0.17 | 6 |
| LAB690 | 77276.2 | — | — | — | — | — | — | 11.2 | 0.22 | 6 |
| LAB678 | 77823.3 | 47.1 | 0.18 | 16 | — | — | — | — | — | — |

TABLE 164-continued

Genes showing improved plant performance at drought growth conditions under regulation of A6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB676 | 77275.2 | — | — | — | — | — | — | 11.0 | 0.03 | 5 |
| LAB671 | 76411.1 | 49.4 | 0.10 | 22 | 487.5 | 0.17 | 26 | 11.5 | 0.07 | 9 |
| LAB671 | 76411.6 | — | — | — | — | — | — | 10.9 | 0.15 | 3 |
| LAB669_H7 | 77879.4 | — | — | — | — | — | — | 11.1 | 0.12 | 5 |
| LAB667 | 76097.3 | — | — | — | — | — | — | 11.3 | 0.29 | 8 |
| LAB664 | 76224.4 | — | — | — | — | — | — | 10.9 | 0.15 | 3 |
| LAB663 | 77047.2 | — | — | — | 456.2 | L | 18 | — | — | — |
| LAB656 | 77316.1 | — | — | — | 449.1 | 0.30 | 16 | 11.4 | L | 8 |
| LAB641 | 77221.2 | — | — | — | — | — | — | 11.9 | L | 13 |
| LAB641 | 77224.1 | 46.2 | 0.24 | 14 | — | — | — | — | — | — |
| LAB641 | 77225.2 | 55.6 | 0.26 | 38 | 562.5 | 0.14 | 45 | 12.0 | L | 14 |
| LAB633 | 74831.4 | — | — | — | — | — | — | 11.0 | 0.03 | 5 |
| LAB630 | 77786.1 | — | — | — | — | — | — | 11.4 | 0.09 | 8 |
| LAB629 | 76896.2 | — | — | — | 462.5 | 0.01 | 19 | 11.1 | 0.28 | 5 |
| LAB622 | 75036.3 | — | — | — | 426.8 | 0.07 | 10 | — | — | — |
| CONT. | — | 40.4 | — | — | 387.1 | — | — | 10.5 | — | — |
| LAB840 | 75832.5 | 129.1 | 0.02 | 18 | 1314.3 | 0.15 | 8 | — | — | — |
| LAB840 | 75833.1 | 138.8 | 0.02 | 26 | 1393.8 | 0.16 | 14 | — | — | — |
| LAB840 | 75833.2 | 123.1 | 0.08 | 12 | — | — | — | — | — | — |
| LAB840 | 75834.2 | 126.8 | 0.02 | 15 | — | — | — | — | — | — |
| LAB839 | 75624.1 | — | — | — | 1393.8 | 0.26 | 14 | — | — | — |
| LAB830 | 76057.3 | 123.8 | 0.04 | 13 | — | — | — | 12.1 | 0.02 | 6 |
| LAB830 | 76060.4 | 139.4 | L | 27 | 1356.2 | 0.11 | 11 | — | — | — |
| LAB815 | 76029.2 | 148.1 | L | 35 | 1475.0 | 0.28 | 21 | — | — | — |
| LAB804 | 76281.3 | 125.0 | 0.23 | 14 | 1368.8 | 0.06 | 12 | — | — | — |
| LAB804 | 76282.1 | 133.8 | L | 22 | 1406.2 | 0.14 | 15 | — | — | — |
| LAB801 | 75886.5 | — | — | — | — | — | — | 11.9 | 0.26 | 4 |
| LAB801 | 75886.7 | 120.6 | 0.13 | 10 | — | — | — | — | — | — |
| LAB801 | 75889.1 | 130.7 | 0.10 | 19 | 1357.1 | 0.11 | 11 | — | — | — |
| LAB800 | 75331.2 | 125.0 | 0.23 | 14 | 1393.8 | 0.10 | 14 | — | — | — |
| LAB794 | 75881.2 | 123.1 | 0.08 | 12 | — | — | — | — | — | — |
| LAB794 | 75884.2 | 145.0 | L | 32 | 1300.0 | 0.21 | 7 | — | — | — |
| LAB788 | 76232.1 | 138.8 | 0.08 | 26 | 1475.0 | 0.25 | 21 | — | — | — |
| LAB788 | 76233.1 | 146.2 | 0.22 | 33 | — | — | — | — | — | — |
| LAB786 | 76230.2 | 131.9 | 0.03 | 20 | 1375.0 | 0.22 | 13 | 12.0 | 0.05 | 5 |
| LAB786 | 76230.7 | 123.8 | 0.20 | 13 | — | — | — | — | — | — |
| LAB777 | 76272.2 | 130.6 | 0.07 | 19 | — | — | — | — | — | — |
| LAB777 | 76273.1 | 132.5 | L | 21 | 1333.0 | 0.09 | 9 | — | — | — |
| LAB777 | 76273.3 | 148.8 | 0.02 | 35 | — | — | — | — | — | — |
| LAB741 | 75609.1 | 126.2 | 0.03 | 15 | 1406.2 | 0.28 | 15 | — | — | — |
| LAB741 | 75609.3 | 123.8 | 0.05 | 13 | — | — | — | — | — | — |
| LAB741 | 75611.4 | 130.4 | 0.04 | 19 | 1390.2 | 0.07 | 14 | — | — | — |
| LAB741 | 75612.1 | 119.4 | 0.13 | 9 | — | — | — | — | — | — |
| LAB712 | 76208.4 | 118.1 | 0.29 | 8 | — | — | — | — | — | — |
| LAB704 | 75132.1 | 136.2 | 0.27 | 24 | 1350.0 | 0.07 | 11 | — | — | — |
| LAB704 | 75132.2 | 141.9 | 0.24 | 29 | 1456.2 | 0.02 | 20 | — | — | — |
| LAB704 | 75132.3 | 117.9 | 0.22 | 7 | — | — | — | — | — | — |
| LAB704 | 75133.1 | 121.9 | 0.10 | 11 | — | — | — | — | — | — |
| LAB665 | 75039.2 | 118.8 | 0.30 | 8 | — | — | — | — | — | — |
| LAB665 | 75040.3 | 126.7 | 0.02 | 15 | — | — | — | — | — | — |
| CONT. | — | 109.8 | — | — | 1217.9 | — | — | 11.4 | — | — |
| LAB835 | 75896.4 | — | — | — | — | — | — | 10.8 | 0.10 | 5 |
| LAB835 | 75896.5 | 111.5 | 0.30 | 33 | — | — | — | — | — | — |
| LAB833 | 75465.1 | 109.4 | 0.12 | 30 | 962.5 | 0.02 | 21 | — | — | — |
| LAB833 | 75468.4 | 92.5 | 0.20 | 10 | 1062.5 | 0.13 | 33 | — | — | — |
| LAB796 | 75321.2 | 100.5 | 0.11 | 20 | 1028.3 | L | 29 | — | — | — |
| LAB796 | 75322.1 | 111.9 | L | 33 | 987.5 | 0.01 | 24 | — | — | — |
| LAB796 | 75324.1 | 99.4 | 0.08 | 18 | 893.8 | 0.22 | 12 | — | — | — |
| LAB780 | 75771.2 | 99.4 | 0.25 | 18 | 968.8 | 0.03 | 22 | 10.9 | 0.09 | 5 |
| LAB780 | 75771.3 | 111.2 | L | 32 | 1012.5 | L | 27 | — | — | — |
| LAB780 | 75774.1 | — | — | — | — | — | — | 10.9 | 0.24 | 6 |
| LAB778 | 75967.2 | 114.0 | L | 36 | 1089.3 | 0.04 | 37 | — | — | — |
| LAB778 | 75969.2 | 103.8 | 0.25 | 24 | — | — | — | 10.9 | 0.24 | 6 |
| LAB778 | 75969.4 | 100.8 | 0.02 | 20 | 958.0 | 0.19 | 20 | — | — | — |
| LAB778 | 75970.1 | 105.6 | L | 26 | 1018.8 | L | 28 | — | — | — |
| LAB776 | 75746.2 | 104.4 | 0.04 | 24 | 1056.2 | 0.04 | 33 | 11.3 | 0.02 | 10 |
| LAB776 | 75749.1 | 106.9 | L | 27 | 1006.3 | 0.03 | 26 | — | — | — |
| LAB776 | 75750.3 | 109.4 | L | 30 | 1012.5 | 0.09 | 27 | — | — | — |
| LAB776 | 75750.4 | 108.1 | 0.13 | 29 | 1106.2 | 0.12 | 39 | — | — | — |
| LAB772 | 75461.6 | 97.1 | 0.26 | 16 | 977.7 | 0.14 | 23 | — | — | — |
| LAB772 | 75462.5 | 95.4 | 0.08 | 14 | 957.1 | 0.13 | 20 | — | — | — |
| LAB768 | 75453.1 | 96.9 | 0.06 | 15 | 906.2 | 0.09 | 14 | — | — | — |

TABLE 164-continued

Genes showing improved plant performance at drought growth conditions under regulation of A6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB768 | 75453.2 | — | — | — | — | — | — | 10.8 | 0.17 | 4 |
| LAB768 | 75453.3 | 100.1 | 0.26 | 19 | — | — | — | — | — | — |
| LAB768 | 75455.1 | 108.1 | L | 29 | 1006.3 | 0.17 | 26 | — | — | — |
| LAB752 | 75165.2 | 101.9 | 0.02 | 21 | 943.8 | 0.03 | 18 | — | — | — |
| LAB752 | 75168.1 | 103.4 | 0.01 | 23 | 969.6 | 0.10 | 22 | 11.0 | 0.14 | 7 |
| LAB752 | 75168.2 | — | — | — | 900.0 | 0.23 | 13 | — | — | — |
| LAB752 | 75170.1 | 105.0 | 0.23 | 25 | — | — | — | — | — | — |
| LAB746 | 75507.2 | 90.6 | 0.27 | 8 | 868.8 | 0.28 | 9 | — | — | — |
| LAB746 | 75508.3 | — | — | — | 862.5 | 0.26 | 8 | — | — | — |
| LAB739 | 75441.2 | 100.6 | 0.02 | 20 | 887.5 | 0.14 | 11 | — | — | — |
| LAB739 | 75442.3 | — | — | — | 881.2 | 0.28 | 11 | — | — | — |
| LAB739 | 75444.4 | 91.9 | 0.20 | 9 | — | — | — | — | — | — |
| LAB739 | 75445.1 | — | — | — | — | — | — | 10.7 | 0.29 | 4 |
| LAB733 | 75154.3 | 101.9 | 0.02 | 21 | — | — | — | — | — | — |
| LAB733 | 75155.2 | 94.9 | 0.15 | 13 | — | — | — | — | — | — |
| LAB724 | 75143.2 | — | — | — | — | — | — | 10.7 | 0.29 | 4 |
| LAB724 | 75146.2 | — | — | — | 987.5 | 0.03 | 24 | — | — | — |
| LAB718 | 75435.2 | 92.5 | 0.17 | 10 | 918.8 | 0.09 | 15 | — | — | — |
| LAB718 | 75436.1 | 100.0 | 0.27 | 19 | 900.0 | 0.12 | 13 | — | — | — |
| LAB716 | 75430.1 | 91.9 | 0.25 | 9 | 887.5 | 0.14 | 11 | — | — | — |
| LAB716 | 75430.5 | 109.3 | L | 30 | 1128.6 | L | 42 | 10.7 | 0.17 | 4 |
| LAB705 | 74879.2 | 113.8 | 0.11 | 35 | — | — | — | 10.8 | 0.13 | 4 |
| LAB705 | 74879.3 | 107.5 | 0.20 | 28 | 950.0 | 0.23 | 19 | — | — | — |
| LAB705 | 74881.2 | 101.9 | 0.05 | 21 | 887.5 | 0.28 | 11 | — | — | — |
| LAB686 | 75364.4 | 121.1 | 0.02 | 44 | 1090.2 | 0.01 | 37 | 10.8 | 0.10 | 5 |
| LAB681 | 75419.1 | — | — | — | 861.2 | 0.26 | 8 | — | — | — |
| CONT. | — | 84.0 | — | — | 796.9 | — | — | 10.3 | — | — |
| LAB791 | 75319.5 | — | — | — | — | — | — | 10.4 | 0.13 | 4 |
| LAB769 | 75311.3 | 135.6 | 0.26 | 20 | — | — | — | 10.2 | 0.29 | 3 |
| LAB755 | 75175.1 | — | — | — | — | — | — | 10.3 | 0.29 | 3 |
| LAB750 | 75448.2 | — | — | — | — | — | — | 10.4 | 0.18 | 5 |
| LAB704 | 75132.2 | — | — | — | — | — | — | 10.6 | 0.11 | 6 |
| LAB670 | 75306.3 | — | — | — | — | — | — | 10.5 | 0.08 | 5 |
| LAB653 | 75113.4 | — | — | — | — | — | — | 10.7 | 0.05 | 7 |
| LAB623 | 75096.2 | — | — | — | — | — | — | 10.4 | 0.13 | 4 |
| CONT. | — | 113.5 | — | — | — | — | — | 10.0 | — | — |
| LAB834 | 75892.5 | — | — | — | — | — | — | 10.2 | 0.04 | 4 |
| LAB834 | 75895.3 | 123.9 | 0.15 | 38 | 1183.9 | 0.01 | 27 | 10.4 | 0.17 | 6 |
| LAB834 | 75895.5 | 110.8 | 0.03 | 23 | — | — | — | — | — | — |
| LAB825 | 76394.1 | — | — | — | — | — | — | 10.4 | L | 7 |
| LAB825 | 76394.2 | 104.0 | 0.06 | 16 | — | — | — | — | — | — |
| LAB825 | 76395.2 | 111.3 | L | 24 | — | — | — | — | — | — |
| LAB793 | 75751.1 | — | — | — | — | — | — | 10.1 | 0.13 | 3 |
| LAB793 | 75751.3 | 105.6 | 0.25 | 17 | — | — | — | 10.4 | 0.22 | 7 |
| LAB793 | 75755.1 | 112.5 | 0.29 | 25 | — | — | — | — | — | — |
| LAB793 | 75755.3 | 106.2 | 0.09 | 18 | — | — | — | 10.4 | L | 7 |
| LAB787 | 76753.1 | 100.7 | 0.30 | 12 | — | — | — | — | — | — |
| LAB787 | 76754.1 | 115.3 | 0.15 | 28 | 1139.3 | L | 23 | — | — | — |
| LAB760 | 75862.2 | 104.4 | 0.04 | 16 | 1068.8 | 0.11 | 15 | 10.4 | 0.17 | 6 |
| LAB760 | 75863.1 | — | — | — | — | — | — | 10.7 | 0.01 | 10 |
| LAB760 | 75863.2 | 114.1 | 0.14 | 27 | 1289.3 | L | 39 | 10.7 | 0.03 | 10 |
| LAB760 | 75865.2 | — | — | — | — | — | — | 10.8 | L | 10 |
| LAB760 | 75865.3 | — | — | — | — | — | — | 10.2 | 0.02 | 5 |
| LAB736 | 76368.1 | — | — | — | 1093.8 | 0.02 | 18 | 10.6 | 0.18 | 8 |
| LAB736 | 76368.2 | 110.6 | 0.26 | 23 | 1168.8 | L | 26 | 10.8 | 0.27 | 10 |
| LAB736 | 76370.1 | — | — | — | — | — | — | 10.4 | 0.22 | 7 |
| LAB736 | 76370.4 | 120.7 | L | 34 | — | — | — | 10.4 | 0.17 | 6 |
| LAB727 | 76387.3 | — | — | — | 1212.5 | L | 31 | 10.7 | L | 10 |
| LAB727 | 76389.2 | 103.8 | 0.26 | 15 | — | — | — | 10.4 | L | 6 |
| LAB726 | 76381.1 | 112.6 | 0.17 | 25 | — | — | — | 10.1 | 0.06 | 4 |
| LAB726 | 76382.1 | — | — | — | — | — | — | 10.4 | 0.07 | 7 |
| LAB726 | 76385.2 | — | — | — | — | — | — | 10.4 | 0.17 | 6 |
| LAB726 | 76385.3 | 111.9 | 0.24 | 24 | 1100.0 | 0.02 | 18 | — | — | — |
| LAB707 | 75855.5 | 116.5 | 0.10 | 30 | 1001.8 | 0.27 | 8 | — | — | — |
| LAB698 | 76201.1 | 100.0 | 0.11 | 11 | — | — | — | — | — | — |
| LAB698 | 76202.2 | 104.4 | 0.15 | 16 | 1037.5 | 0.22 | 12 | 10.1 | 0.13 | 3 |
| LAB698 | 76204.1 | — | — | — | 1031.2 | 0.28 | 11 | — | — | — |
| LAB688 | 75829.1 | — | — | — | — | — | — | 10.5 | 0.13 | 8 |
| LAB687 | 75045.2 | — | — | — | — | — | — | 10.4 | L | 7 |
| LAB687 | 75047.2 | 114.1 | 0.14 | 27 | — | — | — | 11.5 | L | 18 |
| LAB677 | 76521.3 | 115.7 | 0.04 | 29 | 1085.7 | 0.04 | 17 | — | — | — |
| LAB677 | 76522.2 | 140.6 | 0.18 | 56 | 1212.5 | 0.12 | 31 | — | — | — |

TABLE 164-continued

Genes showing improved plant performance at drought growth conditions under regulation of A6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB673 | 76537.1 | — | — | — | 1142.0 | 0.01 | 23 | 10.4 | L | 7 |
| LAB650 | 75838.4 | — | — | — | — | — | — | 10.5 | 0.02 | 8 |
| LAB639 | 76504.1 | 112.5 | L | 25 | — | — | — | — | — | — |
| LAB639 | 76504.3 | — | — | — | 1325.0 | 0.10 | 43 | 10.6 | L | 9 |
| LAB639 | 76505.1 | 97.9 | 0.19 | 9 | — | — | — | — | — | — |
| LAB639 | 76510.1 | — | — | — | 1131.2 | L | 22 | 10.0 | 0.29 | 3 |
| LAB625 | 76452.1 | 121.9 | 0.21 | 35 | 1231.2 | 0.03 | 33 | — | — | — |
| LAB625 | 76452.2 | — | — | — | — | — | — | 10.3 | 0.11 | 6 |
| LAB625 | 76452.5 | — | — | — | — | — | — | 10.8 | 0.18 | 10 |
| LAB625 | 76472.1 | — | — | — | — | — | — | 10.9 | 0.16 | 12 |
| CONT. | — | 89.9 | — | — | 929.1 | — | — | 9.8 | — | — |

Table 164. "CONT."—Control; "Ave."—Average; "% Incr." = % increment; "p-val."—value, L—p < 0.01.

TABLE 165

Genes showing improved plant performance at drought growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB795 | 76491.3 | 77.4 | 0.02 | 41 | 9.7 | 0.02 | 41 | 5.2 | 0.09 | 19 |
| LAB795 | 76494.3 | 66.4 | 0.29 | 21 | 8.3 | 0.29 | 21 | — | — | — |
| LAB792 | 75876.3 | 68.8 | 0.08 | 26 | 8.6 | 0.08 | 26 | 4.9 | 0.07 | 13 |
| LAB790 | 75713.2 | 71.4 | 0.07 | 31 | 8.9 | 0.07 | 31 | 4.9 | 0.12 | 11 |
| LAB789 | 77081.1 | — | — | — | — | — | — | 4.7 | 0.22 | 8 |
| LAB789 | 77085.3 | 63.2 | 0.26 | 16 | 7.9 | 0.26 | 16 | — | — | — |
| LAB784 | 76467.4 | 76.0 | 0.19 | 39 | 9.5 | 0.19 | 39 | 5.2 | 0.18 | 19 |
| LAB769 | 75309.1 | 77.4 | 0.02 | 42 | 9.7 | 0.02 | 42 | 5.1 | 0.03 | 18 |
| LAB750 | 75447.2 | 71.8 | 0.04 | 31 | 9.0 | 0.04 | 31 | 5.1 | 0.03 | 17 |
| LAB730 | 75180.2 | 68.4 | 0.10 | 25 | 8.5 | 0.10 | 25 | 4.9 | 0.17 | 11 |
| LAB729 | 77303.7 | 72.0 | 0.09 | 32 | 9.0 | 0.09 | 32 | 5.0 | 0.08 | 13 |
| LAB713 | 75092.1 | 71.3 | 0.05 | 30 | 8.9 | 0.05 | 30 | 4.9 | 0.09 | 12 |
| LAB708 | 75288.5 | — | — | — | — | — | — | 4.7 | 0.23 | 8 |
| LAB670 | 75303.1 | 68.5 | 0.08 | 25 | 8.6 | 0.08 | 25 | 5.0 | 0.06 | 14 |
| LAB656 | 77320.6 | 82.3 | 0.24 | 51 | 10.3 | 0.24 | 51 | 5.3 | 0.20 | 21 |
| LAB649 | 77041.3 | 65.4 | 0.28 | 20 | 8.2 | 0.28 | 20 | — | — | — |
| LAB649 | 77044.4 | 66.3 | 0.15 | 21 | 8.3 | 0.15 | 21 | 4.8 | 0.23 | 9 |
| LAB649 | 77045.3 | 65.9 | 0.14 | 21 | 8.2 | 0.14 | 21 | 4.8 | 0.13 | 10 |
| LAB637 | 75105.8 | 68.3 | 0.09 | 25 | 8.5 | 0.09 | 25 | 4.8 | 0.13 | 10 |
| LAB636 | 75100.3 | 81.8 | 0.02 | 50 | 10.2 | 0.02 | 50 | 5.4 | L | 24 |
| LAB636 | 75104.8 | 74.6 | 0.02 | 37 | 9.3 | 0.02 | 37 | 5.1 | 0.03 | 17 |
| CONT. | — | 54.7 | — | — | 6.8 | — | — | 4.4 | — | — |
| LAB839 | 75624.1 | 114.6 | 0.05 | 22 | 14.3 | 0.05 | 22 | 6.2 | 0.19 | 11 |
| LAB809 | 75653.2 | 111.4 | 0.25 | 19 | 13.9 | 0.25 | 19 | — | — | — |
| LAB805 | 76117.2 | 106.4 | 0.17 | 13 | 13.3 | 0.17 | 13 | 5.9 | 0.17 | 5 |
| LAB798 | 75615.4 | — | — | — | — | — | — | 5.9 | L | 5 |
| LAB798 | 75616.2 | 107.8 | 0.11 | 15 | 13.5 | 0.11 | 15 | 6.0 | 0.16 | 7 |
| LAB792 | 75876.1 | 100.9 | 0.06 | 7 | 12.6 | 0.06 | 7 | 6.0 | 0.02 | 8 |
| LAB790 | 75713.2 | 125.5 | 0.24 | 34 | 15.7 | 0.24 | 34 | 6.4 | 0.16 | 15 |
| LAB740 | 75265.2 | 97.5 | 0.27 | 4 | 12.2 | 0.27 | 4 | 5.8 | 0.05 | 4 |
| LAB740 | 75265.3 | 107.8 | 0.11 | 15 | 13.5 | 0.11 | 15 | — | — | — |
| LAB733 | 75158.5 | 124.4 | 0.18 | 33 | 15.5 | 0.18 | 33 | 6.2 | 0.16 | 11 |
| LAB681 | 75418.2 | 114.6 | 0.21 | 22 | 14.3 | 0.21 | 22 | 6.1 | 0.05 | 9 |
| LAB679 | 75629.1 | 112.2 | 0.30 | 20 | 14.9 | L | 27 | 6.3 | 0.08 | 13 |
| LAB679 | 75629.4 | 99.3 | 0.13 | 6 | 12.4 | 0.13 | 6 | — | — | — |
| LAB679 | 75631.1 | 129.7 | 0.13 | 38 | 16.2 | 0.13 | 38 | 6.2 | 0.11 | 12 |
| LAB665 | 75042.3 | 110.4 | 0.27 | 18 | 13.8 | 0.27 | 18 | 6.2 | 0.16 | 10 |
| LAB664 | 76224.3 | 99.1 | 0.19 | 6 | 12.4 | 0.19 | 6 | 5.7 | 0.14 | 2 |
| LAB655 | 75119.1 | 111.5 | 0.29 | 19 | 14.9 | L | 27 | 6.1 | L | 9 |
| LAB655 | 75122.1 | 118.5 | L | 26 | 14.8 | L | 26 | 6.2 | 0.11 | 11 |
| LAB640 | 76267.4 | — | — | — | — | — | — | 5.8 | 0.23 | 5 |
| CONT. | — | 93.8 | — | — | 11.7 | — | — | 5.6 | — | — |
| LAB815 | 76030.1 | 73.9 | 0.12 | 11 | 9.2 | 0.12 | 11 | 5.0 | 0.07 | 6 |
| LAB794 | 75884.1 | 81.2 | L | 21 | 10.1 | L | 21 | 5.2 | 0.02 | 10 |
| LAB762 | 75869.2 | — | — | — | — | — | — | 5.0 | 0.30 | 5 |
| LAB762 | 75869.3 | 74.0 | 0.12 | 11 | 9.2 | 0.12 | 11 | 4.9 | 0.27 | 4 |

TABLE 165-continued

Genes showing improved plant performance at drought growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB762 | 75870.2 | 71.6 | 0.28 | 7 | 9.0 | 0.28 | 7 | 4.9 | 0.21 | 4 |
| LAB748 | 74972.1 | 76.6 | 0.22 | 15 | 9.6 | 0.22 | 15 | — | — | — |
| LAB748 | 74972.3 | 74.6 | 0.22 | 12 | 9.3 | 0.22 | 12 | — | — | — |
| LAB748 | 74976.2 | 73.7 | 0.24 | 10 | 9.2 | 0.24 | 10 | — | — | — |
| LAB732 | 74966.2 | 73.0 | 0.25 | 9 | 9.1 | 0.25 | 9 | — | — | — |
| LAB732 | 74969.1 | 75.8 | 0.17 | 13 | 9.5 | 0.17 | 13 | 5.0 | 0.10 | 6 |
| LAB732 | 74971.3 | 73.8 | 0.28 | 10 | 9.2 | 0.28 | 10 | — | — | — |
| LAB732 | 74971.5 | 80.9 | 0.01 | 21 | 10.1 | 0.01 | 21 | 5.2 | L | 11 |
| LAB706 | 74799.1 | 75.0 | 0.12 | 12 | 9.4 | 0.12 | 12 | 5.0 | 0.06 | 6 |
| LAB706 | 74800.1 | 72.3 | 0.22 | 8 | 9.0 | 0.22 | 8 | 4.9 | 0.25 | 3 |
| LAB695 | 74797.4 | — | — | — | — | — | — | 4.9 | 0.22 | 4 |
| LAB689 | 74756.3 | 72.9 | 0.17 | 9 | 9.1 | 0.17 | 9 | 5.0 | 0.13 | 5 |
| LAB689 | 74758.4 | 76.9 | 0.04 | 15 | 9.6 | 0.04 | 15 | 4.9 | 0.26 | 3 |
| LAB689 | 74760.1 | 81.9 | L | 23 | 10.2 | L | 23 | 5.2 | 0.02 | 9 |
| LAB683 | 74872.1 | 72.3 | 0.22 | 8 | 9.0 | 0.22 | 8 | — | — | — |
| LAB683 | 74872.3 | 76.0 | 0.17 | 14 | 9.5 | 0.17 | 14 | 5.0 | 0.19 | 6 |
| LAB683 | 74873.1 | 77.6 | 0.11 | 16 | 9.7 | 0.11 | 16 | 5.0 | 0.06 | 7 |
| LAB680 | 74774.3 | 83.1 | L | 24 | 10.4 | L | 24 | 5.2 | 0.01 | 9 |
| LAB680 | 74774.4 | 78.4 | 0.02 | 17 | 9.8 | 0.02 | 17 | 5.1 | 0.03 | 8 |
| LAB680 | 74775.1 | 77.3 | 0.10 | 16 | 9.7 | 0.10 | 16 | 4.9 | 0.24 | 4 |
| LAB680 | 74777.1 | — | — | — | — | — | — | 4.9 | 0.19 | 4 |
| LAB680 | 74777.2 | 73.0 | 0.26 | 9 | 9.1 | 0.26 | 9 | 5.0 | 0.06 | 7 |
| LAB666 | 74845.1 | 75.7 | 0.12 | 13 | 9.5 | 0.12 | 13 | 5.0 | 0.12 | 5 |
| LAB619 | 77311.1 | 74.3 | 0.15 | 11 | 9.3 | 0.15 | 11 | 5.0 | 0.08 | 6 |
| LAB619 | 77314.2 | — | — | — | — | — | — | 4.9 | 0.24 | 4 |
| CONT. | — | 66.9 | — | — | 8.4 | — | — | 4.7 | — | — |
| LAB837 | 76256.3 | 71.7 | 0.04 | 39 | 9.0 | 0.04 | 39 | 5.1 | 0.04 | 18 |
| LAB837 | 76256.5 | 61.2 | 0.13 | 19 | 7.7 | 0.13 | 19 | 4.8 | 0.17 | 11 |
| LAB837 | 76259.4 | 68.3 | 0.18 | 32 | 8.5 | 0.18 | 32 | 5.2 | 0.17 | 18 |
| LAB835 | 75896.5 | 56.8 | 0.18 | 10 | 7.1 | 0.18 | 10 | 4.7 | 0.04 | 8 |
| LAB835 | 75900.1 | — | — | — | — | — | — | 4.6 | 0.08 | 5 |
| LAB833 | 75465.1 | 62.2 | 0.28 | 21 | 7.8 | 0.28 | 21 | 4.9 | 0.09 | 12 |
| LAB833 | 75466.1 | 57.5 | 0.21 | 11 | 7.2 | 0.21 | 11 | — | — | — |
| LAB800 | 75331.5 | — | — | — | — | — | — | 4.9 | 0.11 | 11 |
| LAB786 | 76230.2 | 57.9 | 0.01 | 12 | 7.2 | 0.01 | 12 | 4.8 | L | 9 |
| LAB778 | 75966.2 | — | — | — | — | — | — | 4.6 | 0.26 | 5 |
| LAB778 | 75966.3 | 65.9 | L | 28 | 8.2 | L | 28 | 4.9 | 0.01 | 11 |
| LAB776 | 75750.3 | 56.0 | 0.06 | 9 | 7.0 | 0.06 | 9 | 4.7 | 0.02 | 7 |
| LAB772 | 75462.2 | — | — | — | 6.9 | 0.09 | 7 | 4.7 | 0.11 | 9 |
| LAB768 | 75453.1 | — | — | — | — | — | — | 4.6 | 0.06 | 5 |
| LAB768 | 75453.2 | — | — | — | — | — | — | 4.6 | 0.11 | 5 |
| LAB752 | 75165.2 | — | — | — | — | — | — | 4.6 | 0.19 | 4 |
| LAB752 | 75168.1 | 62.4 | 0.07 | 21 | 7.8 | 0.07 | 21 | 4.8 | 0.06 | 11 |
| LAB752 | 75168.3 | 62.7 | 0.06 | 22 | 7.8 | 0.06 | 22 | 4.7 | 0.01 | 8 |
| LAB746 | 75507.6 | 54.3 | 0.19 | 5 | 6.8 | 0.19 | 5 | 4.6 | 0.24 | 5 |
| LAB746 | 75507.8 | 62.5 | 0.17 | 21 | 7.8 | 0.17 | 21 | 4.8 | 0.05 | 11 |
| LAB739 | 75444.4 | 55.3 | 0.11 | 7 | 6.9 | 0.11 | 7 | — | — | — |
| LAB739 | 75444.5 | 58.6 | 0.09 | 14 | 7.3 | 0.09 | 14 | 4.7 | 0.07 | 7 |
| LAB718 | 75437.2 | 54.9 | 0.19 | 6 | 6.9 | 0.19 | 6 | 4.6 | 0.13 | 5 |
| LAB718 | 75439.3 | 65.7 | 0.23 | 28 | 8.2 | 0.23 | 28 | 4.9 | 0.16 | 11 |
| LAB716 | 75429.3 | 56.2 | 0.26 | 9 | 7.0 | 0.26 | 9 | 4.7 | 0.28 | 8 |
| LAB716 | 75431.2 | 65.4 | L | 27 | 8.2 | L | 27 | 5.1 | 0.08 | 17 |
| LAB686 | 75364.1 | — | — | — | — | — | — | 4.6 | 0.10 | 4 |
| LAB681 | 75419.1 | — | — | — | 7.3 | L | 13 | 4.7 | 0.11 | 8 |
| LAB681 | 75421.4 | 55.1 | 0.10 | 7 | 6.9 | 0.10 | 7 | 4.6 | 0.12 | 5 |
| CONT. | — | 51.6 | — | — | 6.4 | — | — | 4.4 | — | — |
| LAB824 | 75504.1 | 88.8 | 0.10 | 10 | 11.1 | 0.10 | 10 | 5.5 | 0.16 | 5 |
| LAB792 | 75876.3 | 91.6 | 0.04 | 13 | 11.5 | 0.04 | 13 | 5.6 | 0.08 | 6 |
| LAB636 | 75100.3 | 86.7 | 0.21 | 7 | 10.8 | 0.21 | 7 | 5.5 | 0.27 | 4 |
| LAB636 | 75104.1 | 100.3 | 0.01 | 24 | 12.5 | 0.01 | 24 | 5.9 | 0.03 | 12 |
| LAB618 | 77784.2 | — | — | — | — | — | — | 5.6 | 0.09 | 7 |
| CONT. | — | 80.9 | — | — | 10.1 | — | — | 5.3 | — | — |
| LAB850 | 77714.3 | 71.0 | 0.04 | 9 | 8.9 | 0.14 | 8 | 5.0 | 0.13 | 7 |
| LAB848 | 77336.7 | 70.8 | 0.03 | 9 | 8.8 | 0.14 | 7 | 5.0 | 0.08 | 6 |
| LAB844 | 76787.4 | — | — | — | — | — | — | 4.9 | 0.27 | 5 |
| LAB842 | 76350.2 | 75.3 | 0.14 | 16 | 9.4 | 0.15 | 14 | 5.1 | 0.24 | 8 |
| LAB842 | 76350.3 | 74.7 | L | 15 | 9.3 | 0.02 | 13 | 5.2 | 0.02 | 10 |
| LAB841 | 76803.1 | 82.3 | L | 27 | 10.3 | L | 25 | 5.3 | L | 14 |
| LAB832 | 77332.4 | 79.2 | 0.05 | 22 | 9.9 | 0.04 | 20 | 5.2 | L | 11 |
| LAB827 | 76791.2 | 78.3 | 0.18 | 21 | 9.8 | 0.18 | 19 | 5.2 | 0.11 | 10 |
| LAB827 | 76794.3 | 69.5 | 0.08 | 7 | 8.7 | 0.27 | 5 | 5.0 | 0.12 | 6 |
| LAB823 | 77026.4 | 75.6 | 0.25 | 17 | 9.5 | 0.27 | 15 | 5.1 | 0.14 | 9 |

TABLE 165-continued

Genes showing improved plant performance at drought growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB823 | 77027.1 | 73.5 | 0.28 | 13 | — | — | — | 5.2 | 0.15 | 12 |
| LAB823 | 77028.2 | — | — | — | — | — | — | 4.9 | 0.20 | 4 |
| LAB816 | 76717.2 | — | — | — | — | — | — | 4.9 | 0.25 | 4 |
| LAB816 | 76719.1 | 70.5 | 0.04 | 9 | 8.8 | 0.16 | 7 | 4.8 | 0.25 | 3 |
| LAB811 | 76343.1 | 69.8 | 0.12 | 8 | 8.7 | 0.28 | 6 | 5.0 | 0.05 | 8 |
| LAB803 | 76760.1 | 75.7 | 0.09 | 17 | 9.5 | 0.10 | 15 | 5.0 | 0.02 | 8 |
| LAB803 | 76760.2 | 78.6 | 0.04 | 21 | 9.8 | 0.04 | 19 | 5.3 | 0.21 | 14 |
| LAB770 | 77765.2 | 80.2 | 0.23 | 24 | 10.0 | 0.23 | 22 | 5.2 | 0.06 | 12 |
| LAB767 | 77701.1 | — | — | — | — | — | — | 5.0 | 0.05 | 6 |
| LAB765 | 76113.3 | 72.5 | 0.09 | 12 | 9.1 | 0.14 | 10 | — | — | — |
| LAB765 | 76113.5 | — | — | — | — | — | — | 4.9 | 0.23 | 4 |
| LAB764 | 76107.5 | 72.6 | 0.09 | 12 | 9.1 | 0.14 | 10 | 5.0 | 0.23 | 7 |
| LAB764 | 76110.1 | — | — | — | — | — | — | 4.9 | 0.21 | 4 |
| LAB758 | 76490.4 | 85.7 | L | 32 | 10.7 | L | 30 | 5.4 | 0.02 | 15 |
| LAB757 | 77326.3 | 82.9 | L | 28 | 10.4 | L | 26 | 5.4 | 0.06 | 15 |
| LAB757 | 77326.7 | 79.4 | L | 22 | 9.9 | L | 20 | 5.2 | 0.02 | 10 |
| LAB757 | 77329.1 | 73.7 | 0.24 | 14 | 9.2 | 0.27 | 12 | 5.0 | 0.15 | 7 |
| LAB753 | 76439.3 | — | — | — | — | — | — | 5.0 | 0.28 | 7 |
| LAB753 | 76440.2 | 77.1 | L | 19 | 9.6 | L | 17 | 5.2 | L | 10 |
| LAB751 | 76929.2 | 82.0 | 0.01 | 26 | 10.2 | L | 24 | 5.2 | L | 12 |
| LAB749 | 77757.4 | 78.4 | 0.03 | 21 | 9.8 | 0.03 | 19 | 5.3 | 0.04 | 13 |
| LAB742 | 76432.1 | 75.9 | 0.27 | 17 | 9.5 | 0.29 | 15 | 5.0 | 0.25 | 7 |
| LAB742 | 76434.3 | — | — | — | — | — | — | 4.9 | 0.13 | 5 |
| LAB722 | 76464.1 | 74.2 | L | 14 | 9.3 | 0.02 | 12 | 5.1 | 0.05 | 8 |
| LAB722 | 76465.2 | 77.9 | 0.28 | 20 | 9.7 | 0.29 | 18 | 5.2 | 0.27 | 12 |
| LAB717 | 76430.1 | 83.3 | 0.26 | 28 | 10.4 | 0.26 | 26 | 5.2 | 0.26 | 12 |
| LAB711 | 77076.1 | 85.3 | 0.06 | 31 | 10.7 | 0.05 | 29 | 5.3 | L | 14 |
| LAB711 | 77077.3 | — | — | — | — | — | — | 5.0 | 0.10 | 7 |
| LAB692 | 76418.1 | 68.7 | 0.14 | 6 | — | — | — | 4.9 | 0.11 | 5 |
| LAB691 | 74784.2 | 74.2 | 0.16 | 14 | 9.3 | 0.18 | 13 | 5.1 | 0.13 | 8 |
| LAB691 | 74785.4 | 72.8 | 0.24 | 12 | 9.1 | 0.28 | 10 | 5.1 | 0.06 | 9 |
| LAB690 | 77276.2 | 77.4 | 0.07 | 19 | 9.7 | 0.07 | 17 | 5.3 | 0.05 | 13 |
| LAB672 | 77699.2 | 73.3 | 0.04 | 13 | 9.2 | 0.07 | 11 | 5.1 | 0.05 | 10 |
| LAB672 | 77700.1 | 68.3 | 0.22 | 5 | — | — | — | — | — | — |
| LAB671 | 76411.1 | 87.0 | 0.04 | 34 | 10.9 | 0.03 | 32 | 5.5 | L | 18 |
| LAB671 | 76411.6 | 70.1 | 0.07 | 8 | 8.8 | 0.22 | 6 | — | — | — |
| LAB664 | 76224.4 | 71.2 | 0.03 | 10 | 8.9 | 0.11 | 8 | 5.0 | 0.10 | 6 |
| LAB663 | 77046.1 | 73.4 | 0.17 | 13 | 9.2 | 0.20 | 11 | — | — | — |
| LAB663 | 77047.2 | 77.0 | L | 19 | 9.6 | L | 17 | 5.2 | L | 10 |
| LAB663 | 77048.1 | 69.0 | 0.12 | 6 | — | — | — | 4.9 | 0.15 | 5 |
| LAB662 | 77296.3 | 71.9 | 0.03 | 11 | 9.0 | 0.10 | 9 | 5.0 | 0.03 | 7 |
| LAB656 | 77316.1 | 80.2 | 0.01 | 24 | 10.0 | 0.01 | 22 | 5.2 | 0.15 | 11 |
| LAB656 | 77318.2 | 73.9 | 0.08 | 14 | 9.2 | 0.11 | 12 | 5.0 | 0.05 | 7 |
| LAB653 | 75113.1 | 71.1 | 0.15 | 10 | 8.9 | 0.23 | 8 | 5.1 | 0.01 | 9 |
| LAB641 | 77224.1 | 78.7 | L | 21 | 9.8 | L | 19 | 5.1 | L | 10 |
| LAB641 | 77225.2 | 101.0 | 0.11 | 56 | 12.6 | 0.10 | 53 | 5.9 | 0.09 | 25 |
| LAB633 | 74828.2 | 67.7 | 0.26 | 4 | — | — | — | 4.8 | 0.29 | 3 |
| LAB633 | 74831.4 | 74.2 | 0.30 | 14 | — | — | — | 5.1 | 0.23 | 10 |
| LAB633 | 74832.1 | — | — | — | — | — | — | 5.0 | 0.27 | 8 |
| LAB629 | 76896.2 | 86.5 | 0.08 | 33 | 10.8 | 0.07 | 31 | 5.4 | 0.03 | 16 |
| LAB627 | 77694.2 | 70.5 | 0.09 | 9 | 8.8 | 0.21 | 7 | — | — | — |
| LAB622 | 75036.3 | 82.4 | 0.23 | 27 | 10.3 | 0.24 | 25 | 5.3 | 0.06 | 14 |
| CONT. | — | 64.9 | — | — | 8.2 | — | — | 4.7 | — | — |
| LAB840 | 75833.2 | 107.7 | 0.28 | 18 | 13.5 | 0.28 | 18 | 5.9 | 0.18 | 8 |
| LAB830 | 76056.1 | 98.3 | 0.30 | 8 | 12.3 | 0.30 | 8 | 5.8 | 0.25 | 6 |
| LAB815 | 76029.4 | 110.2 | 0.04 | 21 | 13.8 | 0.04 | 21 | 6.0 | 0.02 | 10 |
| LAB804 | 76281.3 | 103.4 | 0.10 | 14 | 12.9 | 0.10 | 14 | 5.9 | 0.10 | 8 |
| LAB804 | 76282.1 | 111.1 | 0.14 | 22 | 13.9 | 0.14 | 22 | 6.1 | 0.13 | 12 |
| LAB788 | 76232.1 | 101.2 | 0.28 | 11 | 12.6 | 0.28 | 11 | 6.0 | 0.27 | 10 |
| LAB777 | 76274.7 | 118.9 | 0.10 | 31 | 14.9 | 0.10 | 31 | 6.1 | 0.25 | 13 |
| LAB704 | 75132.2 | — | — | — | — | — | — | 5.7 | 0.28 | 5 |
| CONT. | — | 91.0 | — | — | 11.4 | — | — | 5.4 | — | — |
| LAB835 | 75896.3 | — | — | — | — | — | — | 4.8 | 0.11 | 4 |
| LAB833 | 75465.1 | 64.8 | 0.30 | 21 | 8.1 | 0.30 | 21 | 5.1 | 0.08 | 10 |
| LAB833 | 75466.1 | — | — | — | — | — | — | 4.9 | 0.17 | 5 |
| LAB833 | 75467.4 | 57.2 | 0.24 | 7 | 7.1 | 0.24 | 7 | — | — | — |
| LAB796 | 75322.1 | 66.6 | 0.15 | 25 | 8.3 | 0.15 | 25 | 5.2 | 0.07 | 11 |
| LAB796 | 75323.2 | 62.8 | L | 18 | 7.9 | L | 18 | 5.0 | 0.02 | 8 |
| LAB796 | 75324.1 | 63.1 | L | 18 | 7.9 | L | 18 | 5.0 | L | 8 |
| LAB780 | 75771.2 | 67.1 | L | 26 | 8.4 | L | 26 | 5.2 | L | 13 |
| LAB780 | 75771.3 | 72.4 | 0.08 | 36 | 9.1 | 0.08 | 36 | 5.4 | 0.04 | 16 |
| LAB780 | 75773.3 | 63.8 | 0.22 | 19 | 8.0 | 0.22 | 19 | 5.0 | L | 8 |

TABLE 165-continued

Genes showing improved plant performance at drought growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB780 | 75774.1 | 58.3 | 0.10 | 9 | 7.3 | 0.10 | 9 | — | — | — |
| LAB778 | 75967.2 | 76.5 | 0.12 | 43 | 9.6 | 0.12 | 43 | 5.5 | L | 19 |
| LAB778 | 75969.2 | 68.1 | 0.02 | 27 | 8.5 | 0.02 | 27 | 5.2 | 0.27 | 13 |
| LAB778 | 75969.4 | 66.3 | L | 24 | 8.3 | L | 24 | 5.1 | L | 10 |
| LAB776 | 75746.2 | 70.4 | 0.16 | 32 | 8.8 | 0.16 | 32 | 5.2 | 0.28 | 11 |
| LAB776 | 75750.3 | 66.2 | L | 24 | 8.3 | L | 24 | 5.1 | L | 10 |
| LAB776 | 75750.4 | 66.3 | L | 24 | 8.3 | L | 24 | 5.1 | L | 10 |
| LAB772 | 75459.1 | 56.5 | 0.26 | 6 | 7.1 | 0.26 | 6 | 4.9 | 0.06 | 6 |
| LAB768 | 75453.1 | 61.9 | 0.11 | 16 | 7.7 | 0.11 | 16 | 4.9 | 0.13 | 5 |
| LAB768 | 75453.2 | 64.4 | 0.24 | 21 | 8.1 | 0.24 | 21 | — | — | — |
| LAB768 | 75455.1 | 67.0 | 0.19 | 25 | 8.4 | 0.19 | 25 | 5.2 | 0.24 | 13 |
| LAB752 | 75168.1 | 64.6 | L | 21 | 8.1 | L | 21 | 4.9 | 0.01 | 6 |
| LAB746 | 75507.2 | 58.1 | 0.08 | 9 | 7.3 | 0.08 | 9 | — | — | — |
| LAB739 | 75441.2 | 63.0 | 0.27 | 18 | 7.9 | 0.27 | 18 | — | — | — |
| LAB739 | 75444.4 | 59.4 | 0.15 | 11 | 7.4 | 0.15 | 11 | 4.9 | 0.27 | 5 |
| LAB739 | 75445.1 | 65.1 | L | 22 | 8.1 | L | 22 | 5.1 | L | 10 |
| LAB733 | 75158.2 | 59.2 | 0.27 | 11 | 7.4 | 0.27 | 11 | — | — | — |
| LAB724 | 75142.1 | 68.1 | 0.02 | 28 | 8.5 | 0.02 | 28 | 5.2 | L | 12 |
| LAB724 | 75143.2 | 63.0 | L | 18 | 7.9 | L | 18 | 5.1 | L | 9 |
| LAB718 | 75435.2 | 58.3 | 0.12 | 9 | 7.3 | 0.12 | 9 | — | — | — |
| LAB718 | 75436.1 | — | — | — | — | — | — | 5.2 | 0.28 | 11 |
| LAB718 | 75437.2 | 60.0 | 0.07 | 12 | 7.5 | 0.07 | 12 | 4.8 | 0.05 | 4 |
| LAB718 | 75439.2 | 58.9 | 0.04 | 10 | 7.4 | 0.04 | 10 | — | — | — |
| LAB716 | 75429.3 | 62.4 | 0.04 | 17 | 7.8 | 0.04 | 17 | 5.0 | 0.03 | 7 |
| LAB716 | 75430.5 | 65.9 | 0.21 | 23 | 8.8 | L | 32 | 5.4 | L | 16 |
| LAB705 | 74879.2 | 72.2 | L | 35 | 9.0 | L | 35 | 5.4 | L | 16 |
| LAB705 | 74879.3 | 65.5 | 0.23 | 23 | 8.2 | 0.23 | 23 | 5.1 | 0.05 | 9 |
| LAB705 | 74881.1 | 63.7 | 0.18 | 19 | 8.0 | 0.18 | 19 | 5.1 | 0.07 | 10 |
| LAB686 | 75364.4 | 68.7 | 0.02 | 29 | 8.6 | 0.02 | 29 | 5.2 | L | 12 |
| CONT. | — | 53.4 | — | — | 6.7 | — | — | 4.6 | — | — |
| LAB791 | 75318.2 | — | — | — | — | — | — | 5.3 | 0.30 | 13 |
| LAB670 | 75306.3 | 78.8 | 0.21 | 30 | 9.8 | 0.21 | 30 | 5.3 | 0.27 | 13 |
| CONT. | — | 60.5 | — | — | 7.6 | — | — | 4.7 | — | — |
| LAB834 | 75895.3 | 91.7 | L | 30 | 11.5 | L | 30 | 5.8 | L | 14 |
| LAB807 | 76240.1 | 76.9 | 0.29 | 9 | 9.6 | 0.29 | 9 | — | — | — |
| LAB793 | 75755.1 | 78.6 | 0.17 | 11 | 9.8 | 0.17 | 11 | 5.4 | 0.07 | 7 |
| LAB760 | 75863.2 | 97.0 | 0.07 | 37 | 12.1 | 0.07 | 37 | 5.6 | 0.16 | 11 |
| LAB736 | 76368.2 | 95.3 | 0.01 | 35 | 11.9 | 0.01 | 35 | 5.9 | 0.01 | 17 |
| LAB736 | 76370.1 | 87.8 | 0.07 | 24 | 11.0 | 0.07 | 24 | 5.4 | 0.11 | 7 |
| LAB727 | 76387.3 | 95.5 | L | 35 | 11.9 | L | 35 | 5.9 | 0.01 | 16 |
| LAB727 | 76389.2 | 83.2 | 0.01 | 18 | 10.4 | 0.01 | 18 | 5.5 | 0.08 | 9 |
| LAB698 | 76201.1 | 81.8 | 0.02 | 16 | 10.2 | 0.02 | 16 | 5.3 | 0.18 | 5 |
| LAB698 | 76202.2 | — | — | — | — | — | — | 5.4 | 0.28 | 7 |
| LAB698 | 76204.1 | 90.6 | L | 28 | 11.3 | L | 28 | 5.7 | L | 13 |
| LAB698 | 76205.1 | 75.8 | 0.21 | 7 | 9.5 | 0.21 | 7 | — | — | — |
| LAB688 | 75829.1 | 88.9 | 0.11 | 26 | 11.1 | 0.11 | 26 | 5.5 | 0.24 | 9 |
| LAB687 | 75046.4 | 76.9 | 0.18 | 9 | 9.6 | 0.18 | 9 | — | — | — |
| LAB687 | 75047.2 | 83.3 | 0.17 | 18 | 10.4 | 0.17 | 18 | 5.3 | 0.12 | 5 |
| LAB677 | 76528.1 | 78.3 | 0.08 | 11 | 9.8 | 0.08 | 11 | 5.2 | 0.26 | 4 |
| LAB673 | 76537.1 | 77.5 | 0.21 | 10 | — | — | — | — | — | — |
| LAB650 | 75838.2 | 78.2 | 0.11 | 11 | 9.8 | 0.11 | 11 | 5.3 | 0.25 | 4 |
| LAB650 | 75838.3 | 79.0 | 0.06 | 12 | 9.9 | 0.06 | 12 | — | — | — |
| LAB639 | 76504.3 | 98.3 | L | 39 | 12.3 | L | 39 | 6.0 | L | 18 |
| LAB639 | 76510.1 | 77.3 | 0.13 | 10 | 9.7 | 0.13 | 10 | 5.3 | 0.17 | 5 |
| LAB625 | 76452.1 | 86.3 | L | 22 | 10.8 | L | 22 | 5.7 | 0.17 | 12 |
| LAB625 | 76452.5 | 85.3 | L | 21 | 10.7 | L | 21 | 5.6 | 0.03 | 11 |
| LAB625 | 76472.1 | 84.9 | 0.26 | 20 | 10.6 | 0.26 | 20 | 5.3 | 0.22 | 5 |
| CONT. | — | 70.6 | — | — | 8.8 | — | — | 5.1 | — | — |

Table 165. "CONT."—Control; "Ave."—Average; "% Incr." = % increment; "p-val."—p-value, L—p < 0.01.

TABLE 166

Genes showing improved plant performance at drought growth conditions under regulation of At6669 promoter

| Gene Name | Event # | RGR Of Leaf Number (Number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB795 | 76491.3 | — | — | — | 10.2 | 0.08 | 41 | — | — | — |
| LAB790 | 75713.2 | — | — | — | 9.4 | 0.19 | 31 | — | — | — |
| LAB784 | 76467.4 | — | — | — | 10.0 | 0.11 | 39 | — | — | — |
| LAB769 | 75309.1 | — | — | — | 10.2 | 0.07 | 42 | — | — | — |
| LAB750 | 75447.2 | — | — | — | 9.4 | 0.18 | 31 | 0.49 | 0.23 | 19 |
| LAB730 | 75180.2 | 0.78 | 0.18 | 25 | 8.9 | 0.29 | 24 | — | — | — |
| LAB729 | 77303.7 | — | — | — | 9.4 | 0.18 | 31 | — | — | — |
| LAB713 | 75092.1 | — | — | — | 9.4 | 0.19 | 30 | — | — | — |
| LAB670 | 75303.1 | — | — | — | 9.0 | 0.27 | 25 | — | — | — |
| LAB656 | 77320.6 | 0.78 | 0.22 | 25 | 10.9 | 0.04 | 51 | 0.49 | 0.26 | 19 |
| LAB637 | 75105.7 | — | — | — | 9.0 | 0.3 | 25 | — | — | — |
| LAB636 | 75100.3 | — | — | — | 10.8 | 0.04 | 51 | 0.50 | 0.17 | 22 |
| LAB636 | 75104.1 | — | — | — | 9.0 | 0.3 | 25 | — | — | — |
| LAB636 | 75104.8 | — | — | — | 9.9 | 0.11 | 37 | 0.48 | 0.3 | 16 |
| CONT. | — | 0.62 | — | — | 7.2 | — | — | 0.41 | — | — |
| LAB839 | 75624.1 | — | — | — | 14.4 | 0.04 | 22 | 0.53 | 0.18 | 8 |
| LAB809 | 75653.2 | — | — | — | 14.1 | 0.08 | 19 | — | — | — |
| LAB805 | 76117.2 | — | — | — | 13.4 | 0.22 | 13 | 0.53 | 0.25 | 7 |
| LAB798 | 75615.4 | — | — | — | — | — | — | 0.56 | 0.03 | 13 |
| LAB798 | 75616.2 | — | — | — | 13.4 | 0.22 | 13 | 0.52 | 0.29 | 6 |
| LAB792 | 75876.1 | — | — | — | — | — | — | 0.56 | 0.02 | 14 |
| LAB790 | 75695.2 | — | — | — | — | — | — | 0.54 | 0.15 | 9 |
| LAB790 | 75713.2 | — | — | — | 16.0 | L | 35 | 0.59 | L | 19 |
| LAB740 | 75265.2 | — | — | — | — | — | — | 0.54 | 0.11 | 9 |
| LAB740 | 75265.3 | — | — | — | 13.5 | 0.17 | 14 | 0.53 | 0.26 | 6 |
| LAB733 | 75155.2 | — | — | — | — | — | — | 0.54 | 0.14 | 9 |
| LAB733 | 75158.5 | — | — | — | 15.7 | L | 32 | 0.53 | 0.21 | 7 |
| LAB686 | 75365.2 | 0.75 | 0.12 | 25 | — | — | — | — | — | — |
| LAB681 | 75418.2 | — | — | — | 14.4 | 0.04 | 22 | — | — | — |
| LAB681 | 75421.1 | — | — | — | — | — | — | 0.54 | 0.14 | 8 |
| LAB679 | 75629.1 | — | — | — | 13.9 | 0.14 | 17 | 0.55 | 0.04 | 11 |
| LAB679 | 75631.1 | 0.70 | 0.27 | 18 | 16.2 | L | 37 | — | — | — |
| LAB665 | 75040.3 | — | — | — | 14.6 | 0.07 | 23 | — | — | — |
| LAB665 | 75042.3 | — | — | — | 13.8 | 0.14 | 16 | 0.54 | 0.1 | 10 |
| LAB655 | 75119.1 | — | — | — | 14.2 | 0.07 | 20 | 0.54 | 0.11 | 9 |
| LAB655 | 75122.1 | — | — | — | 14.9 | 0.02 | 26 | 0.55 | 0.04 | 11 |
| LAB640 | 76267.4 | — | — | — | — | — | — | 0.55 | 0.06 | 10 |
| CONT. | — | 0.60 | — | — | 11.8 | — | — | 0.49 | — | — |
| LAB815 | 76027.1 | 0.85 | 0.14 | 26 | — | — | — | — | — | — |
| LAB794 | 75884.1 | — | — | — | 10.8 | 0.17 | 22 | — | — | — |
| LAB748 | 74972.3 | 0.83 | 0.22 | 22 | — | — | — | — | — | — |
| LAB748 | 74972.4 | 0.89 | 0.08 | 31 | — | — | — | — | — | — |
| LAB748 | 74976.2 | 0.81 | 0.23 | 20 | — | — | — | — | — | — |
| LAB732 | 74966.2 | 0.80 | 0.29 | 19 | — | — | — | — | — | — |
| LAB732 | 74971.5 | — | — | — | 10.7 | 0.19 | 21 | 0.49 | 0.29 | 11 |
| LAB712 | 76208.3 | 0.80 | 0.27 | 19 | — | — | — | — | — | — |
| LAB689 | 74760.1 | 0.80 | 0.28 | 18 | 10.8 | 0.16 | 22 | — | — | — |
| LAB680 | 74774.3 | 0.80 | 0.29 | 18 | 11.0 | 0.12 | 25 | — | — | — |
| LAB680 | 74774.4 | — | — | — | 10.3 | 0.28 | 17 | — | — | — |
| LAB666 | 74840.2 | 0.81 | 0.24 | 20 | — | — | — | — | — | — |
| CONT. | — | 0.67 | — | — | 8.8 | — | — | 0.44 | — | — |
| LAB837 | 76256.3 | — | — | — | 12.1 | L | 40 | 0.57 | 0.03 | 25 |
| LAB837 | 76256.5 | 0.73 | 0.24 | 27 | 10.2 | 0.07 | 19 | 0.52 | 0.17 | 15 |
| LAB837 | 76259.4 | 0.71 | 0.28 | 24 | 11.5 | L | 33 | 0.58 | 0.02 | 27 |
| LAB835 | 75896.5 | 0.72 | 0.24 | 25 | 9.7 | 0.22 | 12 | 0.54 | 0.09 | 19 |
| LAB835 | 75900.1 | — | — | — | — | — | — | 0.51 | 0.26 | 13 |
| LAB833 | 75465.1 | — | — | — | 10.5 | 0.05 | 21 | 0.53 | 0.17 | 16 |
| LAB833 | 75466.1 | — | — | — | 9.7 | 0.21 | 12 | 0.52 | 0.18 | 15 |
| LAB833 | 75467.3 | 0.75 | 0.19 | 31 | — | — | — | — | — | — |
| LAB800 | 75331.2 | 0.79 | 0.11 | 37 | — | — | — | — | — | — |
| LAB800 | 75331.5 | — | — | — | 10.5 | 0.05 | 22 | 0.51 | 0.3 | 12 |
| LAB786 | 76230.2 | — | — | — | 9.6 | 0.24 | 12 | 0.52 | 0.22 | 14 |
| LAB778 | 75966.2 | — | — | — | 9.6 | 0.28 | 11 | — | — | — |
| LAB778 | 75966.3 | 0.73 | 0.24 | 27 | 11.0 | L | 27 | 0.51 | 0.28 | 11 |
| LAB778 | 75970.1 | 0.73 | 0.26 | 27 | 9.9 | 0.25 | 14 | — | — | — |
| LAB776 | 75749.1 | 0.71 | 0.26 | 24 | — | — | — | — | — | — |
| LAB776 | 75750.3 | — | — | — | — | — | — | 0.51 | 0.25 | 13 |
| LAB772 | 75462.2 | — | — | — | — | — | — | 0.52 | 0.22 | 13 |
| LAB768 | 75455.1 | 0.80 | 0.07 | 38 | — | — | — | — | — | — |
| LAB752 | 75165.2 | — | — | — | — | — | — | 0.52 | 0.17 | 15 |
| LAB752 | 75168.1 | — | — | — | 10.3 | 0.06 | 19 | — | — | — |

TABLE 166-continued

Genes showing improved plant performance at drought growth conditions under regulation of At6669 promoter

| Gene Name | Event # | RGR Of Leaf Number (Number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB752 | 75168.3 | — | — | — | 10.6 | 0.03 | 23 | — | — | — |
| LAB746 | 75507.2 | 0.72 | 0.24 | 25 | — | — | — | — | — | — |
| LAB746 | 75507.8 | — | — | — | 10.5 | 0.04 | 21 | 0.51 | 0.27 | 12 |
| LAB739 | 75444.5 | 0.79 | 0.11 | 37 | 9.7 | 0.22 | 12 | — | — | — |
| LAB733 | 75154.3 | — | — | — | 10.4 | 0.09 | 20 | — | — | — |
| LAB733 | 75158.2 | 0.71 | 0.25 | 24 | — | — | — | — | — | — |
| LAB718 | 75436.1 | 0.76 | 0.12 | 33 | — | — | — | — | — | — |
| LAB718 | 75437.2 | 0.76 | 0.17 | 33 | — | — | — | — | — | — |
| LAB718 | 75439.3 | — | — | — | 11.0 | 0.02 | 28 | 0.52 | 0.23 | 14 |
| LAB716 | 75431.2 | — | — | — | 11.0 | 0.01 | 27 | 0.56 | 0.05 | 23 |
| LAB681 | 75419.1 | — | — | — | — | — | — | 0.53 | 0.14 | 16 |
| LAB681 | 75421.2 | 0.75 | 0.16 | 30 | — | — | — | — | — | — |
| LAB681 | 75421.4 | 0.72 | 0.25 | 25 | — | — | — | — | — | — |
| CONT. | — | 0.58 | — | — | 8.6 | — | — | 0.45 | — | — |
| LAB636 | 75104.1 | — | — | — | 13.1 | 0.13 | 22 | — | — | — |
| LAB632 | 74960.3 | 0.87 | 0.26 | 16 | — | — | — | — | — | — |
| CONT. | — | 0.75 | — | — | 10.7 | — | — | — | — | — |
| LAB848 | 77339.2 | — | — | — | 10.8 | 0.13 | 20 | — | — | — |
| LAB842 | 76350.2 | 0.80 | 0.24 | 22 | 10.6 | 0.14 | 17 | — | — | — |
| LAB842 | 76350.3 | — | — | — | 10.3 | 0.23 | 14 | — | — | — |
| LAB841 | 76803.1 | — | — | — | 11.3 | 0.04 | 25 | — | — | — |
| LAB832 | 77332.4 | — | — | — | 10.8 | 0.09 | 20 | — | — | — |
| LAB829 | 76442.2 | 0.81 | 0.2 | 23 | — | — | — | — | — | — |
| LAB827 | 76791.2 | — | — | — | 10.9 | 0.08 | 21 | — | — | — |
| LAB823 | 77026.4 | — | — | — | 10.6 | 0.16 | 17 | — | — | — |
| LAB823 | 77027.1 | — | — | — | 10.2 | 0.28 | 13 | 0.50 | 0.15 | 18 |
| LAB803 | 76760.1 | — | — | — | 10.5 | 0.17 | 16 | — | — | — |
| LAB803 | 76760.2 | — | — | — | 10.9 | 0.08 | 21 | — | — | — |
| LAB782 | 76848.6 | 0.82 | 0.19 | 24 | — | — | — | — | — | — |
| LAB770 | 77765.2 | — | — | — | 11.2 | 0.05 | 23 | 0.48 | 0.28 | 13 |
| LAB767 | 77705.1 | — | — | — | 10.6 | 0.17 | 17 | — | — | — |
| LAB765 | 76113.3 | — | — | — | 10.3 | 0.25 | 13 | — | — | — |
| LAB764 | 76107.5 | 0.81 | 0.24 | 22 | 10.1 | 0.3 | 12 | — | — | — |
| LAB764 | 76110.5 | 0.81 | 0.22 | 23 | 10.3 | 0.27 | 14 | — | — | — |
| LAB758 | 76490.4 | 0.86 | 0.09 | 31 | 12.0 | L | 32 | 0.49 | 0.22 | 15 |
| LAB757 | 77326.3 | — | — | — | 11.5 | 0.02 | 27 | 0.50 | 0.15 | 18 |
| LAB757 | 77326.7 | — | — | — | 11.0 | 0.07 | 21 | — | — | — |
| LAB753 | 76440.2 | — | — | — | 10.7 | 0.13 | 18 | — | — | — |
| LAB751 | 76929.2 | — | — | — | 11.4 | 0.03 | 26 | 0.49 | 0.22 | 15 |
| LAB749 | 77757.4 | — | — | — | 10.6 | 0.14 | 17 | — | — | — |
| LAB742 | 76432.1 | — | — | — | 10.5 | 0.17 | 16 | — | — | — |
| LAB731 | 77135.3 | — | — | — | 11.4 | 0.08 | 26 | 0.50 | 0.2 | 19 |
| LAB728 | 75152.2 | 0.79 | 0.29 | 19 | — | — | — | — | — | — |
| LAB722 | 76464.1 | — | — | — | 10.3 | 0.23 | 14 | — | — | — |
| LAB722 | 76465.2 | — | — | — | 10.9 | 0.1 | 20 | 0.49 | 0.19 | 17 |
| LAB717 | 76430.1 | — | — | — | 11.8 | 0.02 | 31 | — | — | — |
| LAB711 | 77076.1 | — | — | — | 11.8 | 0.01 | 31 | 0.49 | 0.2 | 16 |
| LAB691 | 74784.2 | — | — | — | 10.2 | 0.25 | 13 | — | — | — |
| LAB691 | 74785.4 | — | — | — | 10.2 | 0.28 | 13 | 0.48 | 0.25 | 14 |
| LAB690 | 77276.2 | — | — | — | 10.5 | 0.16 | 16 | 0.48 | 0.27 | 14 |
| LAB676 | 77275.1 | — | — | — | 10.4 | 0.21 | 15 | — | — | — |
| LAB672 | 77699.2 | — | — | — | 10.3 | 0.21 | 14 | 0.48 | 0.29 | 13 |
| LAB672 | 77700.1 | 0.80 | 0.27 | 20 | — | — | — | — | — | — |
| LAB671 | 76411.1 | 0.79 | 0.28 | 20 | 12.1 | L | 34 | 0.51 | 0.11 | 20 |
| LAB669_H7 | 77879.4 | — | — | — | 11.4 | 0.06 | 26 | — | — | — |
| LAB663 | 77046.1 | — | — | — | 10.4 | 0.22 | 14 | — | — | — |
| LAB663 | 77047.2 | — | — | — | 10.9 | 0.08 | 21 | 0.50 | 0.14 | 18 |
| LAB662 | 77296.3 | — | — | — | 10.2 | 0.27 | 13 | 0.48 | 0.29 | 13 |
| LAB656 | 77316.1 | — | — | — | 11.2 | 0.04 | 24 | — | — | — |
| LAB656 | 77318.2 | 0.80 | 0.27 | 22 | 10.4 | 0.18 | 15 | — | — | — |
| LAB653 | 75113.1 | — | — | — | — | — | — | 0.50 | 0.13 | 19 |
| LAB641 | 77221.2 | — | — | — | 11.2 | 0.06 | 23 | — | — | — |
| LAB641 | 77224.1 | 0.80 | 0.28 | 21 | 11.0 | 0.07 | 21 | — | — | — |
| LAB641 | 77225.2 | — | — | — | 13.7 | L | 51 | 0.53 | 0.05 | 24 |
| LAB633 | 74831.4 | — | — | — | 10.3 | 0.26 | 14 | — | — | — |
| LAB633 | 74832.1 | — | — | — | 10.3 | 0.25 | 14 | — | — | — |
| LAB630 | 77786.1 | 0.85 | 0.12 | 29 | — | — | — | — | — | — |
| LAB629 | 76896.2 | — | — | — | 12.0 | L | 32 | 0.49 | 0.22 | 15 |
| LAB622 | 75036.2 | 0.79 | 0.29 | 20 | — | — | — | — | — | — |
| LAB622 | 75036.3 | — | — | — | 11.6 | 0.02 | 28 | 0.51 | 0.12 | 19 |
| CONT. | — | 0.66 | — | — | 9.0 | — | — | 0.42 | — | — |

TABLE 166-continued

Genes showing improved plant performance at drought growth conditions under regulation of At6669 promoter

| Gene Name | Event # | RGR Of Leaf Number (Number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB840 | 75833.2 | — | — | — | 15.3 | 0.22 | 19 | — | — | — |
| LAB839 | 75624.1 | — | — | — | 16.1 | 0.11 | 25 | — | — | — |
| LAB837 | 76256.5 | 0.84 | 0.22 | 19 | — | — | — | — | — | — |
| LAB830 | 76056.1 | 0.84 | 0.19 | 19 | — | — | — | — | — | — |
| LAB830 | 76060.2 | 0.84 | 0.23 | 18 | — | — | — | — | — | — |
| LAB815 | 76029.2 | — | — | — | 15.4 | 0.19 | 20 | — | — | — |
| LAB815 | 76029.4 | — | — | — | 15.9 | 0.11 | 23 | — | — | — |
| LAB804 | 76281.3 | — | — | — | 14.8 | 0.29 | 15 | — | — | — |
| LAB804 | 76282.1 | — | — | — | 16.0 | 0.11 | 24 | 0.56 | 0.21 | 16 |
| LAB794 | 75883.1 | 0.85 | 0.18 | 20 | — | — | — | — | — | — |
| LAB786 | 76226.1 | 0.82 | 0.29 | 15 | — | — | — | — | — | — |
| LAB777 | 76274.7 | — | — | — | 16.8 | 0.04 | 31 | — | — | — |
| LAB740 | 75265.2 | 0.84 | 0.25 | 18 | — | — | — | — | — | — |
| CONT. | — | 0.71 | — | — | 12.9 | — | — | 0.49 | — | — |
| LAB835 | 75896.4 | — | — | — | 8.3 | 0.19 | 19 | — | — | — |
| LAB835 | 75896.5 | 0.74 | 0.29 | 15 | — | — | — | — | — | — |
| LAB835 | 75900.1 | 0.74 | 0.27 | 15 | — | — | — | — | — | — |
| LAB833 | 75465.1 | — | — | — | 8.5 | 0.14 | 21 | 0.48 | 0.27 | 10 |
| LAB833 | 75466.1 | — | — | — | — | — | — | 0.48 | 0.25 | 9 |
| LAB796 | 75322.1 | 0.75 | 0.24 | 16 | 8.8 | 0.08 | 26 | 0.49 | 0.19 | 11 |
| LAB796 | 75323.2 | — | — | — | 8.3 | 0.19 | 18 | — | — | — |
| LAB796 | 75324.1 | — | — | — | 8.4 | 0.17 | 19 | 0.48 | 0.27 | 9 |
| LAB780 | 75771.2 | — | — | — | 8.9 | 0.06 | 27 | 0.52 | 0.06 | 17 |
| LAB780 | 75771.3 | — | — | — | 9.6 | 0.01 | 36 | 0.52 | 0.06 | 17 |
| LAB780 | 75773.3 | — | — | — | 8.4 | 0.16 | 20 | — | — | — |
| LAB778 | 75967.2 | — | — | — | 10.1 | L | 43 | 0.53 | 0.02 | 19 |
| LAB778 | 75969.2 | — | — | — | 9.0 | 0.05 | 29 | 0.50 | 0.13 | 14 |
| LAB778 | 75969.4 | — | — | — | 8.7 | 0.08 | 24 | — | — | — |
| LAB776 | 75746.2 | 0.76 | 0.15 | 18 | 9.3 | 0.03 | 33 | 0.49 | 0.22 | 11 |
| LAB776 | 75749.1 | — | — | — | 8.7 | 0.11 | 23 | 0.50 | 0.15 | 13 |
| LAB776 | 75750.3 | — | — | — | 8.7 | 0.08 | 24 | 0.49 | 0.2 | 11 |
| LAB776 | 75750.4 | — | — | — | 8.8 | 0.08 | 25 | 0.50 | 0.11 | 14 |
| LAB772 | 75459.1 | — | — | — | — | — | — | 0.48 | 0.27 | 9 |
| LAB768 | 75453.1 | — | — | — | 8.3 | 0.21 | 18 | — | — | — |
| LAB768 | 75453.2 | — | — | — | 8.4 | 0.16 | 19 | — | — | — |
| LAB768 | 75455.1 | — | — | — | 8.9 | 0.07 | 26 | 0.49 | 0.21 | 11 |
| LAB752 | 75168.1 | — | — | — | 8.6 | 0.11 | 22 | 0.48 | 0.27 | 9 |
| LAB752 | 75168.3 | 0.74 | 0.29 | 15 | — | — | — | — | — | — |
| LAB739 | 75441.2 | — | — | — | 8.4 | 0.18 | 19 | — | — | — |
| LAB739 | 75445.1 | — | — | — | 8.6 | 0.1 | 22 | 0.48 | 0.24 | 10 |
| LAB724 | 75142.1 | — | — | — | 9.0 | 0.04 | 28 | 0.51 | 0.09 | 14 |
| LAB724 | 75143.2 | — | — | — | 8.3 | 0.2 | 18 | 0.48 | 0.28 | 9 |
| LAB724 | 75146.2 | — | — | — | 8.2 | 0.25 | 16 | 0.49 | 0.22 | 11 |
| LAB718 | 75436.1 | — | — | — | 8.4 | 0.17 | 20 | 0.50 | 0.12 | 14 |
| LAB716 | 75429.3 | — | — | — | 8.3 | 0.2 | 17 | 0.48 | 0.28 | 9 |
| LAB716 | 75430.5 | — | — | — | 8.7 | 0.1 | 24 | 0.54 | 0.02 | 22 |
| LAB705 | 74879.2 | — | — | — | 9.5 | 0.02 | 35 | 0.53 | 0.02 | 20 |
| LAB705 | 74879.3 | — | — | — | 8.7 | 0.11 | 23 | 0.49 | 0.18 | 11 |
| LAB705 | 74881.1 | — | — | — | 8.4 | 0.17 | 19 | — | — | — |
| LAB686 | 75364.4 | — | — | — | 9.1 | 0.04 | 30 | 0.51 | 0.09 | 15 |
| CONT. | — | 0.64 | — | — | 7.0 | — | — | 0.44 | — | — |
| LAB670 | 75306.3 | — | — | — | 10.6 | 0.24 | 31 | — | — | — |
| CONT. | — | — | — | — | 8.1 | — | — | — | — | — |
| LAB834 | 75895.3 | — | — | — | 13.4 | 0.05 | 30 | 0.59 | 0.16 | 17 |
| LAB793 | 75751.3 | — | — | — | 13.4 | 0.12 | 31 | 0.60 | 0.22 | 19 |
| LAB793 | 75755.3 | 0.45 | 0.29 | 38 | — | — | — | — | — | — |
| LAB787 | 76754.1 | 0.46 | 0.27 | 42 | — | — | — | — | — | — |
| LAB760 | 75863.1 | 0.56 | 0.07 | 74 | — | — | — | — | — | — |
| LAB760 | 75863.2 | — | — | — | 14.0 | 0.03 | 36 | — | — | — |
| LAB736 | 76368.2 | — | — | — | 13.6 | 0.04 | 32 | — | — | — |
| LAB736 | 76370.1 | — | — | — | 12.8 | 0.12 | 24 | — | — | — |
| LAB727 | 76387.3 | — | — | — | 13.8 | 0.03 | 34 | 0.58 | 0.22 | 15 |
| LAB727 | 76389.2 | — | — | — | 12.0 | 0.26 | 17 | — | — | — |
| LAB726 | 76382.1 | 0.46 | 0.28 | 41 | — | — | — | — | — | — |
| LAB698 | 76204.1 | — | — | — | 12.9 | 0.1 | 25 | — | — | — |
| LAB688 | 75829.1 | — | — | — | 13.2 | 0.08 | 28 | — | — | — |
| LAB687 | 75047.2 | — | — | — | 12.1 | 0.25 | 17 | — | — | — |
| LAB650 | 75838.4 | — | — | — | 12.5 | 0.24 | 21 | — | — | — |
| LAB639 | 76504.3 | — | — | — | 14.3 | 0.01 | 39 | 0.59 | 0.16 | 17 |
| LAB625 | 76452.1 | — | — | — | 12.7 | 0.13 | 23 | — | — | — |
| LAB625 | 76452.5 | — | — | — | 12.5 | 0.16 | 21 | 0.58 | 0.25 | 14 |

TABLE 166-continued

Genes showing improved plant performance at drought growth conditions under regulation of At6669 promoter

| Gene Name | Event # | RGR Of Leaf Number (Number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB625 | 76472.1 | — | — | — | 12.0 | 0.29 | 17 | — | — | — |
| CONT. | — | 0.32 | — | — | 10.3 | — | — | 0.51 | — | — |

Table 166. "CONT."—Control; "Ave."—Average; "% Incr." = % increment; "p-val."—p-value, L—$p < 0.01$.

TABLE 167

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB824 | 75502.2 | 175.0 | L | 21 | 1975.0 | 0.15 | 15 | — | — | — |
| LAB824 | 75504.2 | 169.2 | 0.02 | 17 | 1929.5 | 0.13 | 13 | — | — | — |
| LAB824 | 75505.3 | 189.4 | 0.09 | 31 | — | — | — | — | — | — |
| LAB795 | 76491.3 | 161.5 | 0.18 | 12 | 2033.0 | 0.11 | 19 | — | — | — |
| LAB795 | 76494.6 | — | — | — | 1946.4 | 0.20 | 14 | — | — | — |
| LAB792 | 75876.3 | 162.5 | 0.09 | 13 | 1887.5 | 0.24 | 10 | — | — | — |
| LAB792 | 75878.3 | 161.9 | 0.12 | 12 | — | — | — | 9.9 | 0.06 | 4 |
| LAB792 | 75880.4 | — | — | — | 2150.0 | 0.26 | 25 | 10.9 | 0.05 | 14 |
| LAB790 | 75695.1 | — | — | — | 1862.5 | 0.28 | 9 | — | — | — |
| LAB790 | 75713.2 | 154.4 | 0.23 | 7 | — | — | — | — | — | — |
| LAB789 | 77081.4 | 159.8 | 0.22 | 11 | — | — | — | — | — | — |
| LAB789 | 77085.3 | 160.0 | 0.13 | 11 | 1968.8 | 0.15 | 15 | — | — | — |
| LAB784 | 76467.4 | 176.9 | 0.02 | 23 | 2012.5 | 0.09 | 17 | 9.8 | 0.29 | 2 |
| LAB784 | 76468.3 | 180.0 | 0.15 | 25 | 2118.8 | 0.13 | 24 | 9.8 | 0.17 | 2 |
| LAB784 | 76470.2 | 168.8 | 0.21 | 17 | 1881.2 | 0.27 | 10 | — | — | — |
| LAB769 | 75309.1 | 166.9 | 0.06 | 16 | 1925.0 | 0.11 | 12 | 9.9 | 0.13 | 4 |
| LAB769 | 75311.5 | — | — | — | — | — | — | 9.8 | 0.11 | 3 |
| LAB769 | 75348.4 | 183.8 | 0.20 | 27 | 2056.2 | 0.28 | 20 | 10.2 | L | 7 |
| LAB750 | 75448.4 | — | — | — | — | — | — | 9.7 | 0.29 | 2 |
| LAB730 | 75180.3 | — | — | — | — | — | — | 10.0 | 0.06 | 5 |
| LAB729 | 77303.7 | — | — | — | — | — | — | 9.8 | 0.17 | 2 |
| LAB649 | 77041.3 | 164.6 | 0.04 | 14 | 1915.2 | 0.12 | 12 | — | — | — |
| LAB649 | 77041.4 | 175.6 | L | 22 | 2000.0 | 0.04 | 17 | — | — | — |
| LAB649 | 77045.3 | 183.1 | 0.24 | 27 | — | — | — | 10.1 | 0.12 | 6 |
| LAB637 | 75105.8 | 185.0 | 0.17 | 28 | 2143.8 | 0.17 | 25 | 10.4 | 0.16 | 10 |
| LAB636 | 75100.3 | 180.0 | 0.06 | 25 | 2093.8 | 0.20 | 22 | — | — | — |
| LAB636 | 75104.8 | 163.8 | 0.28 | 14 | — | — | — | 10.1 | 0.12 | 6 |
| LAB632 | 74960.2 | 172.5 | 0.01 | 20 | 1918.8 | 0.11 | 12 | — | — | — |
| CONT. | — | 144.2 | — | — | 1713.6 | — | — | 9.5 | — | — |
| LAB839 | 75623.2 | — | — | — | — | — | — | 10.9 | 0.25 | 6 |
| LAB839 | 75623.3 | — | — | — | — | — | — | 11.5 | 0.03 | 12 |
| LAB839 | 75624.1 | — | — | — | 881.2 | 0.24 | 19 | 12.4 | 0.13 | 20 |
| LAB831 | 76254.1 | — | — | — | — | — | — | 11.0 | 0.12 | 7 |
| LAB809 | 75651.2 | — | — | — | — | — | — | 11.0 | 0.12 | 7 |
| LAB809 | 75651.3 | — | — | — | — | — | — | 10.9 | 0.17 | 5 |
| LAB792 | 75876.1 | — | — | — | — | — | — | 10.8 | 0.21 | 5 |
| LAB783 | 75980.5 | — | — | — | — | — | — | 10.8 | 0.27 | 4 |
| LAB783 | 75980.6 | — | — | — | — | — | — | 11.2 | 0.06 | 9 |
| LAB762 | 75866.2 | — | — | — | 900.0 | 0.17 | 22 | 11.2 | 0.24 | 8 |
| LAB762 | 75870.2 | — | — | — | — | — | — | 10.8 | 0.25 | 5 |
| LAB740 | 75264.1 | — | — | — | — | — | — | 11.4 | 0.06 | 10 |
| LAB740 | 75265.3 | — | — | — | — | — | — | 11.0 | 0.27 | 7 |
| LAB733 | 75158.5 | — | — | — | — | — | — | 11.1 | 0.12 | 8 |
| LAB686 | 75364.6 | — | — | — | 903.6 | 0.17 | 23 | 12.2 | 0.20 | 19 |
| LAB686 | 75365.2 | — | — | — | — | — | — | 10.9 | 0.24 | 5 |
| LAB681 | 75418.2 | — | — | — | — | — | — | 11.4 | 0.04 | 11 |
| LAB679 | 75631.1 | — | — | — | — | — | — | 11.4 | 0.14 | 10 |
| LAB665 | 75040.3 | 88.8 | 0.17 | 18 | 881.2 | 0.28 | 19 | 12.2 | 0.04 | 19 |
| LAB655 | 75119.2 | — | — | — | — | — | — | 11.2 | 0.14 | 8 |
| LAB655 | 75122.1 | — | — | — | — | — | — | 10.9 | 0.17 | 5 |
| CONT. | — | 75.4 | — | — | 737.5 | — | — | 10.3 | — | — |
| LAB815 | 76027.2 | — | — | — | 1558.3 | 0.28 | 7 | — | — | — |
| LAB815 | 76030.1 | — | — | — | — | — | — | 10.6 | 0.08 | 4 |
| LAB794 | 75881.2 | — | — | — | — | — | — | 10.9 | 0.08 | 7 |

TABLE 167-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB794 | 75883.1 | — | — | — | 1512.5 | 0.16 | 4 | — | — | — |
| LAB794 | 75883.2 | — | — | — | — | — | — | 11.1 | 0.28 | 8 |
| LAB774 | 76372.2 | 145.0 | 0.08 | 23 | 1606.2 | L | 10 | — | — | — |
| LAB774 | 76374.1 | 127.5 | 0.16 | 8 | — | — | — | — | — | — |
| LAB774 | 76374.2 | — | — | — | 1601.8 | 0.02 | 10 | — | — | — |
| LAB774 | 76375.3 | — | — | — | — | — | — | 10.6 | 0.25 | 4 |
| LAB762 | 75866.5 | 128.1 | 0.12 | 9 | 1531.2 | 0.08 | 5 | — | — | — |
| LAB762 | 75869.2 | 126.9 | 0.21 | 8 | 1512.5 | 0.16 | 4 | 10.6 | 0.08 | 4 |
| LAB762 | 75869.3 | — | — | — | — | — | — | 10.9 | L | 7 |
| LAB748 | 74972.3 | — | — | — | — | — | — | 11.1 | 0.01 | 9 |
| LAB748 | 74972.4 | — | — | — | 1540.2 | 0.06 | 6 | 10.8 | 0.11 | 6 |
| LAB748 | 74976.2 | — | — | — | — | — | — | 10.5 | 0.17 | 3 |
| LAB732 | 74966.2 | 133.1 | 0.25 | 13 | — | — | — | — | — | — |
| LAB732 | 74969.1 | 138.8 | 0.05 | 18 | — | — | — | — | — | — |
| LAB732 | 74971.3 | 142.8 | 0.13 | 21 | 1661.6 | 0.17 | 14 | — | — | — |
| LAB712 | 76210.1 | 133.1 | 0.19 | 13 | 1584.8 | 0.04 | 9 | — | — | — |
| LAB706 | 74799.1 | — | — | — | — | — | — | 10.5 | 0.04 | 3 |
| LAB695 | 74793.1 | — | — | — | 1507.1 | 0.20 | 4 | — | — | — |
| LAB695 | 74797.4 | 137.4 | 0.20 | 17 | 1558.9 | 0.03 | 7 | — | — | — |
| LAB689 | 74756.1 | 127.1 | 0.19 | 8 | — | — | — | — | — | — |
| LAB689 | 74756.2 | — | — | — | 1567.9 | 0.03 | 8 | 10.8 | 0.23 | 5 |
| LAB689 | 74756.3 | 125.4 | 0.24 | 7 | — | — | — | 10.8 | 0.05 | 5 |
| LAB689 | 74758.4 | 126.9 | 0.26 | 8 | 1625.0 | L | 12 | 11.0 | 0.02 | 8 |
| LAB689 | 74760.1 | — | — | — | — | — | — | 10.8 | L | 6 |
| LAB680 | 74774.3 | 150.0 | L | 28 | 1620.8 | L | 11 | 10.4 | 0.18 | 2 |
| LAB680 | 74774.4 | 131.9 | 0.07 | 12 | — | — | — | 10.4 | 0.12 | 2 |
| LAB680 | 74775.1 | — | — | — | — | — | — | 10.7 | 0.16 | 5 |
| LAB680 | 74777.1 | 139.7 | 0.07 | 19 | — | — | — | — | — | — |
| LAB666 | 74840.5 | — | — | — | 1525.0 | 0.17 | 5 | — | — | — |
| LAB666 | 74841.2 | 137.5 | 0.06 | 17 | — | — | — | — | — | — |
| LAB666 | 74844.3 | 125.8 | 0.21 | 7 | — | — | — | — | — | — |
| LAB666 | 74845.1 | 135.4 | 0.27 | 15 | 1637.5 | 0.03 | 13 | — | — | — |
| LAB624 | 77106.1 | — | — | — | 1600.0 | 0.06 | 10 | — | — | — |
| LAB624 | 77110.4 | 141.9 | 0.28 | 21 | — | — | — | — | — | — |
| LAB619 | 77311.1 | 138.1 | 0.12 | 17 | 1556.2 | 0.10 | 7 | — | — | — |
| LAB619 | 77311.3 | — | — | — | 1562.5 | 0.03 | 7 | — | — | — |
| LAB619 | 77312.2 | 126.9 | 0.18 | 8 | — | — | — | — | — | — |
| LAB619 | 77314.2 | 128.1 | 0.12 | 9 | — | — | — | — | — | — |
| CONT. | — | 117.6 | — | — | 1454.6 | — | — | 10.2 | — | — |
| LAB837 | 76256.2 | — | — | — | 2021.4 | 0.22 | 14 | — | — | — |
| LAB837 | 76256.3 | — | — | — | 2069.6 | 0.23 | 17 | — | — | — |
| LAB837 | 76259.4 | — | — | — | 1922.3 | 0.13 | 9 | 9.4 | 0.24 | 3 |
| LAB833 | 75468.4 | — | — | — | 2018.7 | 0.03 | 14 | — | — | — |
| LAB800 | 75331.2 | — | — | — | — | — | — | 9.4 | 0.24 | 3 |
| LAB800 | 75331.5 | — | — | — | 1943.8 | 0.08 | 10 | — | — | — |
| LAB786 | 76229.1 | — | — | — | 1887.5 | 0.21 | 7 | — | — | — |
| LAB786 | 76230.2 | — | — | — | — | — | — | 9.9 | 0.15 | 7 |
| LAB786 | 76230.7 | — | — | — | 2075.0 | 0.18 | 17 | 9.5 | 0.22 | 3 |
| LAB780 | 75771.2 | — | — | — | 2059.8 | 0.01 | 17 | — | — | — |
| LAB780 | 75773.3 | — | — | — | 1894.6 | 0.18 | 7 | — | — | — |
| LAB778 | 75966.2 | 192.9 | 0.21 | 12 | — | — | — | — | — | — |
| LAB778 | 75966.3 | — | — | — | — | — | — | 9.5 | 0.22 | 3 |
| LAB778 | 75969.4 | — | — | — | 1907.1 | 0.14 | 8 | — | — | — |
| LAB776 | 75750.3 | — | — | — | 1963.4 | 0.09 | 11 | — | — | — |
| LAB772 | 75461.6 | — | — | — | 2000.0 | 0.18 | 13 | — | — | — |
| LAB772 | 75462.5 | — | — | — | 2035.7 | 0.24 | 15 | — | — | — |
| LAB768 | 75453.1 | — | — | — | 1890.2 | 0.26 | 7 | 9.9 | 0.15 | 7 |
| LAB768 | 75453.3 | — | — | — | — | — | — | 9.6 | 0.09 | 4 |
| LAB752 | 75165.2 | — | — | — | 1887.5 | 0.23 | 7 | — | — | — |
| LAB746 | 75508.3 | — | — | — | — | — | — | 9.6 | 0.10 | 5 |
| LAB739 | 75442.1 | — | — | — | 1967.9 | 0.05 | 11 | — | — | — |
| LAB739 | 75444.5 | — | — | — | 2012.5 | 0.06 | 14 | — | — | — |
| LAB733 | 75154.3 | — | — | — | — | — | — | 9.4 | 0.24 | 3 |
| LAB733 | 75155.2 | — | — | — | — | — | — | 9.8 | 0.09 | 7 |
| LAB733 | 75158.3 | — | — | — | 1950.0 | 0.07 | 10 | — | — | — |
| LAB718 | 75437.2 | — | — | — | — | — | — | 9.7 | 0.04 | 5 |
| LAB716 | 75429.3 | — | — | — | 1943.8 | 0.21 | 10 | 9.9 | L | 7 |
| LAB686 | 75363.1 | 205.5 | 0.06 | 20 | 1918.8 | 0.12 | 9 | — | — | — |
| LAB681 | 75419.1 | — | — | — | 1875.0 | 0.24 | 6 | — | — | — |
| LAB681 | 75421.4 | — | — | — | — | — | — | 9.7 | 0.04 | 5 |
| CONT. | — | 171.9 | — | — | 1767.6 | — | — | 9.2 | — | — |
| LAB824 | 75502.2 | 165.0 | 0.07 | 10 | — | — | — | — | — | — |

TABLE 167-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB824 | 75504.1 | 161.7 | 0.17 | 8 | — | — | — | — | — | — |
| LAB795 | 76500.3 | 176.2 | 0.05 | 18 | 2012.5 | 0.13 | 16 | — | — | — |
| LAB792 | 75876.3 | 177.9 | 0.09 | 19 | 1956.2 | 0.03 | 13 | — | — | — |
| LAB789 | 77084.4 | — | — | — | — | — | — | 11.2 | 0.24 | 5 |
| LAB789 | 77085.3 | 167.8 | 0.04 | 12 | 1966.1 | 0.18 | 14 | — | — | — |
| LAB784 | 76469.1 | 164.4 | 0.10 | 10 | — | — | — | 11.4 | 0.08 | 6 |
| LAB769 | 75345.1 | 166.1 | 0.27 | 11 | — | — | — | — | — | — |
| LAB730 | 75182.1 | 161.2 | 0.11 | 8 | 1831.2 | 0.14 | 6 | — | — | — |
| LAB729 | 77303.7 | — | — | — | 1906.2 | 0.01 | 10 | — | — | — |
| LAB708 | 75288.5 | 175.4 | L | 17 | 1930.4 | 0.08 | 12 | — | — | — |
| LAB670 | 75306.3 | — | — | — | — | — | — | 11.0 | 0.27 | 2 |
| LAB649 | 77041.4 | 161.9 | 0.16 | 8 | 1806.2 | 0.19 | 4 | — | — | — |
| LAB649 | 77042.1 | 162.5 | 0.08 | 8 | 1825.0 | 0.13 | 5 | — | — | — |
| LAB649 | 77044.2 | 158.1 | 0.25 | 5 | — | — | — | — | — | — |
| LAB649 | 77045.3 | — | — | — | 1881.2 | 0.02 | 9 | — | — | — |
| LAB637 | 75105.6 | — | — | — | — | — | — | 11.2 | 0.24 | 5 |
| LAB637 | 75105.8 | 183.8 | 0.01 | 22 | 2031.2 | 0.01 | 17 | 11.6 | 0.18 | 8 |
| LAB637 | 75105.9 | 173.2 | 0.26 | 15 | — | — | — | — | — | — |
| LAB636 | 75100.3 | 176.9 | 0.11 | 18 | — | — | — | — | — | — |
| LAB636 | 75104.1 | 158.8 | 0.20 | 6 | 1893.8 | 0.02 | 9 | 11.5 | 0.13 | 7 |
| LAB632 | 74960.3 | 161.9 | 0.22 | 8 | — | — | — | — | — | — |
| LAB618 | 77782.1 | 162.5 | 0.07 | 8 | 1793.8 | 0.25 | 4 | — | — | — |
| CONT. | — | 150.0 | — | — | 1731.0 | — | — | 10.8 | — | — |
| LAB840 | 75832.5 | — | — | — | 1893.8 | 0.11 | 7 | — | — | — |
| LAB840 | 75832.6 | 195.9 | 0.27 | 9 | — | — | — | — | — | — |
| LAB840 | 75833.1 | — | — | — | — | — | — | 11.5 | 0.15 | 3 |
| LAB840 | 75833.2 | — | — | — | — | — | — | 11.8 | 0.08 | 6 |
| LAB839 | 75623.4 | 197.2 | 0.25 | 10 | — | — | — | — | — | — |
| LAB837 | 76256.2 | 188.8 | 0.25 | 5 | — | — | — | — | — | — |
| LAB830 | 76060.2 | — | — | — | — | — | — | 11.6 | 0.06 | 4 |
| LAB830 | 76060.4 | 189.1 | 0.12 | 6 | — | — | — | — | — | — |
| LAB815 | 76027.2 | — | — | — | — | — | — | 11.4 | 0.22 | 2 |
| LAB804 | 76281.1 | — | — | — | — | — | — | 11.4 | 0.15 | 3 |
| LAB804 | 76284.1 | — | — | — | 1906.2 | 0.26 | 7 | — | — | — |
| LAB801 | 75886.5 | — | — | — | — | — | — | 11.4 | 0.15 | 3 |
| LAB801 | 75887.2 | — | — | — | 1925.0 | 0.29 | 8 | — | — | — |
| LAB801 | 75889.1 | 186.0 | 0.06 | 4 | — | — | — | — | — | — |
| LAB800 | 75355.3 | — | — | — | 1993.8 | 0.01 | 12 | — | — | — |
| LAB794 | 75881.2 | — | — | — | — | — | — | 11.5 | 0.15 | 3 |
| LAB794 | 75883.1 | 199.4 | 0.21 | 11 | — | — | — | — | — | — |
| LAB794 | 75884.2 | — | — | — | — | — | — | 11.8 | 0.18 | 5 |
| LAB788 | 76232.2 | — | — | — | — | — | — | 11.5 | 0.15 | 3 |
| LAB788 | 76234.1 | 226.9 | 0.27 | 27 | 2143.8 | 0.03 | 21 | — | — | — |
| LAB786 | 76229.1 | — | — | — | — | — | — | 11.8 | 0.03 | 5 |
| LAB786 | 76230.2 | 186.8 | 0.06 | 4 | — | — | — | — | — | — |
| LAB786 | 76230.6 | 190.0 | 0.13 | 6 | — | — | — | — | — | — |
| LAB777 | 76273.3 | 190.0 | 0.04 | 6 | — | — | — | — | — | — |
| LAB777 | 76274.7 | 195.0 | 0.30 | 9 | — | — | — | — | — | — |
| LAB704 | 75132.1 | 194.4 | L | 9 | 1968.8 | 0.23 | 11 | — | — | — |
| LAB642 | 75912.1 | — | — | — | 2062.5 | 0.11 | 16 | — | — | — |
| LAB642 | 75914.1 | 185.6 | 0.07 | 4 | — | — | — | — | — | — |
| LAB642 | 75936.2 | — | — | — | 1868.8 | 0.23 | 5 | 11.6 | 0.20 | 4 |
| CONT. | — | 179.1 | — | — | 1776.8 | — | — | 11.1 | — | — |
| LAB835 | 75896.3 | 147.5 | 0.26 | 19 | 1655.4 | 0.14 | 33 | 10.6 | L | 11 |
| LAB835 | 75896.4 | 153.1 | 0.21 | 23 | 1562.5 | 0.01 | 26 | 10.2 | 0.02 | 8 |
| LAB835 | 75900.1 | 171.2 | 0.24 | 38 | 1512.5 | 0.01 | 22 | 10.1 | 0.14 | 6 |
| LAB833 | 75466.1 | 148.8 | 0.17 | 20 | 1600.0 | 0.10 | 29 | 9.8 | 0.24 | 3 |
| LAB833 | 75467.3 | 144.7 | 0.19 | 16 | — | — | — | 9.8 | 0.05 | 3 |
| LAB796 | 75321.2 | — | — | — | — | — | — | 9.7 | 0.19 | 2 |
| LAB796 | 75322.1 | 160.0 | 0.03 | 29 | 1631.2 | 0.15 | 31 | 10.6 | 0.05 | 11 |
| LAB796 | 75323.2 | — | — | — | 1431.2 | 0.24 | 15 | — | — | — |
| LAB796 | 75325.2 | — | — | — | 1325.0 | 0.26 | 7 | 10.2 | 0.24 | 7 |
| LAB780 | 75771.2 | — | — | — | 1418.8 | 0.26 | 14 | 10.6 | 0.15 | 11 |
| LAB780 | 75771.3 | 136.9 | 0.20 | 10 | 1425.0 | 0.22 | 15 | 10.2 | 0.02 | 8 |
| LAB780 | 75773.3 | 146.9 | 0.29 | 18 | 1481.2 | 0.08 | 19 | 10.4 | 0.13 | 9 |
| LAB778 | 75967.2 | 142.7 | 0.05 | 15 | 1650.0 | L | 33 | 11.1 | 0.18 | 17 |
| LAB778 | 75969.2 | — | — | — | 1406.2 | 0.09 | 13 | — | — | — |
| LAB778 | 75969.4 | — | — | — | — | — | — | 10.3 | 0.08 | 9 |
| LAB776 | 75746.2 | 139.8 | 0.10 | 13 | 1509.8 | 0.03 | 21 | 10.6 | 0.22 | 11 |
| LAB776 | 75749.1 | 158.8 | 0.18 | 28 | 1556.2 | 0.02 | 25 | 9.9 | 0.01 | 5 |
| LAB776 | 75750.3 | 166.2 | L | 34 | 1762.5 | L | 42 | 10.8 | L | 14 |
| LAB776 | 75750.4 | 154.4 | 0.01 | 24 | 1581.2 | 0.06 | 27 | 10.6 | 0.09 | 12 |

TABLE 167-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB772 | 75459.1 | — | — | — | 1587.5 | L | 28 | 10.2 | L | 8 |
| LAB772 | 75461.6 | 148.8 | 0.06 | 20 | 1531.2 | L | 23 | 10.5 | L | 11 |
| LAB772 | 75462.5 | — | — | — | 1325.9 | 0.26 | 7 | — | — | — |
| LAB768 | 75453.1 | 159.4 | 0.03 | 28 | 1706.2 | L | 37 | 10.4 | 0.06 | 10 |
| LAB768 | 75453.2 | 142.3 | 0.09 | 15 | — | — | — | 10.4 | 0.24 | 9 |
| LAB768 | 75453.3 | 166.2 | 0.11 | 34 | 1743.8 | 0.13 | 40 | 10.2 | L | 7 |
| LAB768 | 75455.1 | 141.8 | 0.07 | 14 | 1492.9 | L | 20 | 10.6 | 0.15 | 11 |
| LAB768 | 75456.1 | — | — | — | — | — | — | 9.7 | 0.19 | 2 |
| LAB752 | 75168.1 | 141.2 | 0.09 | 14 | 1512.5 | L | 22 | 10.5 | 0.28 | 11 |
| LAB746 | 75507.2 | — | — | — | 1406.2 | 0.05 | 13 | 10.2 | 0.02 | 8 |
| LAB746 | 75508.2 | — | — | — | — | — | — | 9.8 | 0.07 | 3 |
| LAB746 | 75508.3 | — | — | — | 1339.3 | 0.19 | 8 | — | — | — |
| LAB739 | 75442.1 | — | — | — | — | — | — | 10.2 | 0.10 | 7 |
| LAB739 | 75444.4 | 148.8 | 0.13 | 20 | 1525.0 | L | 23 | 10.3 | 0.30 | 9 |
| LAB739 | 75445.1 | — | — | — | 1512.5 | L | 22 | 10.5 | L | 11 |
| LAB733 | 75154.3 | — | — | — | — | — | — | 10.5 | L | 11 |
| LAB733 | 75157.2 | — | — | — | — | — | — | 9.8 | 0.24 | 3 |
| LAB733 | 75158.2 | 147.5 | 0.02 | 19 | 1475.0 | 0.01 | 19 | 10.1 | L | 7 |
| LAB724 | 75142.1 | 170.6 | 0.20 | 37 | 1531.2 | 0.01 | 23 | — | — | — |
| LAB724 | 75143.2 | 141.9 | 0.06 | 14 | 1537.5 | L | 24 | — | — | — |
| LAB724 | 75144.4 | — | — | — | — | — | — | 10.1 | 0.30 | 6 |
| LAB724 | 75146.2 | 141.9 | 0.07 | 14 | 1600.0 | L | 29 | 10.5 | L | 11 |
| LAB718 | 75435.2 | — | — | — | — | — | — | 10.0 | 0.06 | 5 |
| LAB718 | 75437.2 | 163.1 | L | 31 | 1593.8 | 0.18 | 28 | 10.1 | 0.14 | 6 |
| LAB718 | 75439.2 | 151.9 | 0.23 | 22 | 1481.2 | 0.01 | 19 | — | — | — |
| LAB718 | 75439.3 | — | — | — | — | — | — | 10.0 | L | 5 |
| LAB716 | 75429.3 | 155.5 | L | 25 | 1497.3 | 0.02 | 20 | 10.1 | L | 6 |
| LAB716 | 75430.5 | 171.0 | L | 38 | 1665.2 | L | 34 | 10.2 | 0.25 | 7 |
| LAB716 | 75431.2 | 159.8 | 0.03 | 29 | 1507.1 | 0.14 | 21 | 10.8 | 0.08 | 13 |
| LAB716 | 75431.4 | — | — | — | 1395.5 | 0.19 | 12 | — | — | — |
| LAB705 | 74876.2 | — | — | — | — | — | — | 10.0 | 0.06 | 5 |
| LAB705 | 74879.2 | 158.1 | 0.28 | 27 | 1600.0 | L | 29 | — | — | — |
| LAB705 | 74879.3 | — | — | — | — | — | — | 10.1 | L | 7 |
| LAB705 | 74881.1 | 143.1 | 0.05 | 15 | — | — | — | — | — | — |
| LAB705 | 74881.2 | — | — | — | 1528.6 | 0.14 | 23 | — | — | — |
| LAB686 | 75364.1 | — | — | — | 1500.0 | 0.13 | 21 | — | — | — |
| LAB686 | 75364.4 | — | — | — | — | — | — | 10.6 | 0.23 | 11 |
| LAB681 | 75419.1 | — | — | — | — | — | — | 9.9 | 0.01 | 5 |
| LAB681 | 75420.4 | — | — | — | 1368.8 | 0.11 | 10 | 10.4 | L | 10 |
| LAB681 | 75421.4 | — | — | — | 1433.0 | 0.27 | 15 | 10.8 | 0.08 | 13 |
| CONT. | — | 124.3 | — | — | 1243.6 | — | — | 9.5 | — | — |
| LAB800 | 75331.6 | 248.8 | 0.11 | 47 | 2937.5 | 0.16 | 37 | — | — | — |
| LAB800 | 75355.3 | 208.1 | 0.26 | 23 | — | — | — | — | — | — |
| LAB791 | 75316.2 | 281.2 | 0.03 | 66 | 2759.8 | 0.23 | 29 | — | — | — |
| LAB791 | 75317.2 | 245.6 | 0.07 | 45 | — | — | — | — | — | — |
| LAB791 | 75318.2 | 308.5 | 0.21 | 82 | 3308.0 | 0.07 | 55 | — | — | — |
| LAB791 | 75319.5 | 226.2 | 0.24 | 33 | — | — | — | — | — | — |
| LAB755 | 75172.7 | 225.4 | 0.18 | 33 | — | — | — | — | — | — |
| LAB730 | 75177.3 | 209.4 | 0.23 | 23 | — | — | — | — | — | — |
| LAB713 | 75090.2 | 261.2 | 0.20 | 54 | — | — | — | — | — | — |
| LAB708 | 75342.1 | 223.1 | 0.23 | 31 | — | — | — | — | — | — |
| LAB704 | 75132.3 | 219.4 | 0.16 | 29 | 2825.0 | 0.19 | 32 | — | — | — |
| LAB704 | 75132.4 | 230.5 | 0.13 | 36 | — | — | — | — | — | — |
| LAB704 | 75133.1 | 264.4 | 0.05 | 56 | 2787.5 | 0.21 | 30 | — | — | — |
| LAB637 | 75105.1 | 205.9 | 0.26 | 21 | 2683.9 | 0.27 | 25 | — | — | — |
| CONT. | — | 169.7 | — | — | 2138.9 | — | — | — | — | — |
| LAB834 | 75892.5 | 171.9 | 0.11 | 39 | 1606.2 | 0.09 | 24 | 10.4 | 0.19 | 4 |
| LAB834 | 75895.5 | 150.7 | 0.12 | 22 | — | — | — | — | — | — |
| LAB807 | 76240.1 | 153.8 | 0.27 | 24 | — | — | — | 10.6 | 0.02 | 6 |
| LAB807 | 76240.4 | — | — | — | 1462.5 | 0.28 | 13 | — | — | — |
| LAB793 | 75751.2 | 175.9 | 0.21 | 42 | 1743.8 | L | 34 | 10.7 | 0.21 | 7 |
| LAB793 | 75755.1 | — | — | — | 1718.8 | L | 32 | — | — | — |
| LAB736 | 76368.2 | — | — | — | 1462.5 | 0.18 | 13 | — | — | — |
| LAB736 | 76370.1 | — | — | — | — | — | — | 10.4 | 0.19 | 4 |
| LAB736 | 76370.3 | 168.9 | L | 37 | 1505.4 | 0.17 | 16 | — | — | — |
| LAB736 | 76370.4 | 169.6 | 0.29 | 37 | — | — | — | — | — | — |
| LAB727 | 76387.3 | 154.6 | 0.16 | 25 | 1735.4 | 0.30 | 34 | 10.5 | 0.04 | 5 |
| LAB726 | 76385.3 | — | — | — | 1512.5 | 0.08 | 17 | — | — | — |
| LAB707 | 75855.4 | 161.2 | L | 30 | — | — | — | — | — | — |
| LAB698 | 76204.1 | 163.8 | 0.18 | 32 | 1560.7 | 0.18 | 20 | — | — | — |
| LAB688 | 75829.1 | 145.6 | 0.06 | 18 | 1725.0 | 0.01 | 33 | 10.3 | 0.17 | 3 |
| LAB687 | 75046.4 | 148.8 | 0.13 | 20 | 1675.0 | 0.22 | 29 | — | — | — |

TABLE 167-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LAB687 | 75047.2 | — | — | — | — | — | — | 11.4 | L | 14 |
| LAB677 | 76524.1 | — | — | — | — | — | — | 10.4 | 0.19 | 4 |
| LAB677 | 76528.1 | — | — | — | 1583.0 | 0.24 | 22 | — | — | — |
| LAB673 | 76532.1 | — | — | — | — | — | — | 10.5 | 0.23 | 5 |
| LAB673 | 76533.1 | 137.9 | 0.21 | 11 | 1635.0 | 0.01 | 26 | 10.5 | 0.07 | 5 |
| LAB673 | 76537.1 | — | — | — | — | — | — | 10.6 | 0.11 | 6 |
| LAB650 | 75838.3 | — | — | — | — | — | — | 10.9 | L | 9 |
| LAB639 | 76504.3 | — | — | — | 1679.5 | 0.08 | 29 | 10.3 | 0.17 | 3 |
| LAB625 | 76452.1 | 176.4 | 0.27 | 43 | 1614.3 | 0.07 | 24 | — | — | — |
| LAB625 | 76453.1 | — | — | — | — | — | — | 10.3 | 0.29 | 3 |
| LAB625 | 76473.1 | — | — | — | 1565.2 | 0.09 | 21 | — | — | — |
| LAB616 | 76732.4 | 163.2 | 0.03 | 32 | 1479.5 | 0.25 | 14 | — | — | — |
| CONT. | — | 123.8 | — | — | 1298.2 | — | — | 10.0 | — | — |

Table 167. "CONT."—Control; "Ave."—Average; "% Incr." = % increment; "p-val."—p-value, L—p < 0.01.

TABLE 168

Genes showing improved plant performance at normal growth conditions under regulation of At6669 promoter

| Gene Name | Event # | Plot Coverage [cm$^2$] | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB824 | 75502.2 | 68.8 | 0.19 | 17 | 8.6 | 0.19 | 17 | 5.0 | 0.16 | 8 |
| LAB795 | 76491.3 | 71.1 | 0.20 | 21 | 8.9 | 0.20 | 21 | — | — | — |
| LAB795 | 76494.3 | 73.0 | 0.30 | 24 | 9.1 | 0.30 | 24 | 5.1 | 0.26 | 10 |
| LAB795 | 76494.6 | 70.0 | 0.24 | 19 | 8.7 | 0.24 | 19 | — | — | — |
| LAB792 | 75876.3 | 70.7 | 0.19 | 20 | 8.8 | 0.19 | 20 | — | — | — |
| LAB792 | 75878.3 | 74.5 | 0.02 | 27 | 9.3 | 0.02 | 27 | 5.2 | 0.03 | 13 |
| LAB792 | 75880.4 | 73.7 | 0.13 | 25 | 9.2 | 0.13 | 25 | 5.1 | 0.09 | 10 |
| LAB789 | 77085.3 | 71.4 | 0.16 | 21 | 8.9 | 0.16 | 21 | 5.1 | 0.08 | 11 |
| LAB784 | 76467.4 | 70.3 | 0.06 | 20 | 8.8 | 0.06 | 20 | 5.0 | 0.10 | 9 |
| LAB784 | 76468.3 | 73.1 | 0.16 | 24 | 9.1 | 0.16 | 24 | 5.1 | 0.05 | 12 |
| LAB784 | 76470.2 | 73.9 | 0.02 | 26 | 9.2 | 0.02 | 26 | 5.0 | 0.07 | 10 |
| LAB769 | 75309.1 | 72.4 | 0.04 | 23 | 9.1 | 0.04 | 23 | 5.1 | 0.06 | 11 |
| LAB769 | 75348.4 | 75.5 | 0.02 | 28 | 9.4 | 0.02 | 28 | 5.1 | 0.04 | 12 |
| LAB649 | 77041.4 | 67.9 | 0.18 | 16 | 8.5 | 0.18 | 16 | 5.0 | 0.24 | 8 |
| LAB649 | 77045.3 | 77.6 | 0.28 | 32 | 9.7 | 0.28 | 32 | — | — | — |
| LAB637 | 75105.8 | 82.3 | 0.12 | 40 | 10.3 | 0.12 | 40 | 5.4 | 0.14 | 17 |
| LAB636 | 75100.3 | 76.9 | 0.04 | 31 | 9.6 | 0.04 | 31 | 5.2 | 0.21 | 13 |
| LAB636 | 75104.8 | 66.0 | 0.22 | 12 | 8.2 | 0.22 | 12 | — | — | — |
| CONT. | — | 58.8 | — | — | 7.3 | — | — | 4.6 | — | — |
| LAB839 | 75624.1 | 145.5 | 0.09 | 33 | 18.2 | 0.09 | 33 | 6.9 | 0.09 | 13 |
| LAB783 | 75980.6 | — | — | — | — | — | — | 6.6 | 0.16 | 8 |
| LAB762 | 75866.2 | 134.2 | 0.16 | 23 | 16.8 | 0.16 | 23 | 6.7 | 0.10 | 9 |
| LAB686 | 75364.6 | 134.0 | 0.22 | 23 | 16.7 | 0.22 | 23 | — | — | — |
| LAB679 | 75631.1 | 127.8 | 0.21 | 17 | 16.0 | 0.21 | 17 | 6.4 | 0.24 | 6 |
| LAB665 | 75040.3 | 132.2 | 0.25 | 21 | 16.5 | 0.25 | 21 | — | — | — |
| LAB665 | 75042.3 | 139.8 | 0.08 | 28 | 17.5 | 0.08 | 28 | 6.8 | 0.06 | 11 |
| CONT. | — | 109.0 | — | — | 13.6 | — | — | 6.1 | — | — |
| LAB815 | 76026.1 | 83.9 | 0.02 | 13 | 10.5 | 0.02 | 13 | — | — | — |
| LAB815 | 76027.2 | 79.5 | 0.14 | 8 | 9.9 | 0.14 | 8 | — | — | — |
| LAB815 | 76030.1 | 87.6 | 0.11 | 19 | 11.0 | 0.11 | 19 | 5.5 | 0.19 | 9 |
| LAB794 | 75881.2 | 85.7 | 0.30 | 16 | 10.7 | 0.30 | 16 | 5.4 | 0.28 | 8 |
| LAB794 | 75883.2 | 81.6 | 0.04 | 10 | 10.2 | 0.04 | 10 | — | — | — |
| LAB794 | 75884.1 | 82.9 | 0.26 | 12 | 10.4 | 0.26 | 12 | 5.3 | 0.27 | 6 |
| LAB774 | 76372.2 | — | — | — | — | — | — | 5.3 | 0.26 | 5 |
| LAB762 | 75866.5 | 80.5 | 0.20 | 9 | 10.1 | 0.20 | 9 | 5.5 | 0.01 | 8 |
| LAB762 | 75869.2 | 81.0 | 0.06 | 10 | 10.1 | 0.06 | 10 | 5.3 | 0.19 | 6 |
| LAB762 | 75870.3 | 78.7 | 0.17 | 6 | 9.8 | 0.17 | 6 | 5.2 | 0.26 | 3 |
| LAB748 | 74972.1 | 77.6 | 0.27 | 5 | 9.7 | 0.27 | 5 | — | — | — |
| LAB748 | 74972.3 | 81.9 | 0.04 | 11 | 10.2 | 0.04 | 11 | 5.3 | 0.08 | 5 |
| LAB748 | 74972.4 | 83.3 | 0.06 | 13 | 10.4 | 0.06 | 13 | 5.3 | 0.19 | 6 |
| LAB748 | 74976.2 | 86.5 | 0.12 | 17 | 10.8 | 0.12 | 17 | — | — | — |
| LAB732 | 74966.2 | — | — | — | — | — | — | 5.4 | 0.03 | 6 |
| LAB732 | 74971.5 | 84.9 | 0.01 | 15 | 10.6 | 0.01 | 15 | 5.3 | 0.10 | 4 |
| LAB706 | 74803.4 | 78.8 | 0.17 | 7 | 9.8 | 0.17 | 7 | — | — | — |

TABLE 168-continued

Genes showing improved plant performance at normal growth conditions under regulation of At6669 promoter

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LAB695 | 74797.4 | 84.8 | 0.21 | 15 | 10.6 | 0.21 | 15 | — | — | — |
| LAB689 | 74756.2 | — | — | — | — | — | — | 5.2 | 0.14 | 4 |
| LAB689 | 74758.4 | 96.3 | 0.01 | 30 | 12.0 | 0.01 | 30 | 5.7 | L | 13 |
| LAB689 | 74760.1 | 93.4 | 0.05 | 26 | 11.7 | 0.05 | 26 | 5.8 | L | 14 |
| LAB683 | 74871.3 | 82.7 | 0.27 | 12 | 10.3 | 0.27 | 12 | — | — | — |
| LAB683 | 74873.1 | 84.4 | 0.22 | 14 | 10.5 | 0.22 | 14 | 5.4 | 0.13 | 6 |
| LAB680 | 74774.3 | — | — | — | — | — | — | 5.2 | 0.23 | 3 |
| LAB680 | 74774.4 | 79.7 | 0.10 | 8 | 10.0 | 0.10 | 8 | 5.3 | 0.11 | 6 |
| LAB680 | 74777.1 | — | — | — | — | — | — | 5.3 | 0.20 | 5 |
| LAB666 | 74845.1 | — | — | — | — | — | — | 5.2 | 0.16 | 4 |
| LAB619 | 77311.3 | 84.3 | 0.13 | 14 | 10.5 | 0.13 | 14 | 5.3 | 0.11 | 6 |
| LAB619 | 77314.3 | 80.0 | 0.15 | 8 | 10.0 | 0.15 | 8 | — | — | — |
| CONT. | — | 73.9 | — | — | 9.2 | — | — | 5.0 | — | — |
| LAB837 | 76256.3 | 62.8 | 0.02 | 10 | 7.8 | 0.02 | 10 | 4.9 | 0.02 | 5 |
| LAB837 | 76259.4 | 67.9 | 0.13 | 19 | 8.5 | 0.13 | 19 | 5.2 | 0.26 | 10 |
| LAB833 | 75468.4 | — | — | — | — | — | — | 4.8 | 0.29 | 2 |
| LAB800 | 75331.5 | 65.0 | 0.01 | 14 | 8.1 | 0.01 | 14 | 5.0 | L | 7 |
| LAB786 | 76229.1 | 60.5 | 0.12 | 6 | 7.6 | 0.12 | 6 | 4.9 | 0.21 | 4 |
| LAB786 | 76230.2 | 68.1 | L | 19 | 8.5 | L | 19 | 5.2 | 0.08 | 11 |
| LAB780 | 75771.2 | — | — | — | — | — | — | 4.9 | 0.02 | 5 |
| LAB780 | 75773.3 | 60.1 | 0.15 | 5 | 7.5 | 0.15 | 5 | — | — | — |
| LAB776 | 75750.3 | — | — | — | — | — | — | 4.9 | 0.11 | 5 |
| LAB772 | 75461.6 | — | — | — | 8.4 | L | 17 | 5.0 | 0.10 | 7 |
| LAB768 | 75453.1 | 62.0 | 0.12 | 8 | 7.7 | 0.12 | 8 | — | — | — |
| LAB752 | 75165.2 | 64.3 | L | 12 | 8.0 | L | 12 | 5.0 | L | 7 |
| LAB752 | 75168.1 | 62.0 | 0.03 | 8 | 7.7 | 0.03 | 8 | 4.8 | 0.06 | 3 |
| LAB746 | 75507.8 | — | — | — | — | — | — | 4.9 | 0.19 | 4 |
| LAB746 | 75508.3 | 64.2 | 0.03 | 12 | 8.0 | 0.03 | 12 | 5.0 | 0.15 | 7 |
| LAB739 | 75442.1 | 60.2 | 0.30 | 5 | 7.5 | 0.30 | 5 | — | — | — |
| LAB739 | 75444.5 | — | — | — | — | — | — | 5.1 | 0.19 | 10 |
| LAB718 | 75437.2 | 62.9 | 0.08 | 10 | 7.9 | 0.08 | 10 | 5.0 | 0.11 | 7 |
| LAB716 | 75429.3 | — | — | — | — | — | — | 5.1 | 0.13 | 10 |
| LAB716 | 75431.2 | 66.6 | 0.03 | 16 | 8.3 | 0.03 | 16 | 5.0 | 0.04 | 7 |
| LAB681 | 75419.1 | 64.1 | 0.13 | 12 | 8.0 | 0.13 | 12 | 5.0 | L | 6 |
| CONT. | — | 57.2 | — | — | 7.2 | — | — | 4.7 | — | — |
| LAB792 | 75876.3 | 98.1 | 0.25 | 18 | 12.3 | 0.25 | 18 | — | — | — |
| LAB789 | 77085.3 | — | — | — | 11.8 | 0.10 | 14 | — | — | — |
| LAB730 | 75182.1 | 95.9 | 0.03 | 15 | 12.0 | 0.03 | 15 | — | — | — |
| LAB649 | 77042.1 | 91.3 | 0.11 | 10 | 11.4 | 0.11 | 10 | — | — | — |
| LAB649 | 77045.3 | 94.8 | 0.04 | 14 | 11.9 | 0.04 | 14 | 6.0 | 0.03 | 9 |
| LAB637 | 75105.8 | 97.5 | 0.13 | 17 | 12.2 | 0.13 | 17 | 5.7 | 0.24 | 4 |
| LAB636 | 75100.3 | 92.9 | 0.07 | 12 | 11.6 | 0.07 | 12 | 5.8 | 0.14 | 5 |
| LAB636 | 75104.1 | 110.2 | L | 33 | 13.8 | L | 33 | 6.2 | 0.08 | 13 |
| LAB618 | 77785.2 | — | — | — | — | — | — | 5.9 | 0.19 | 7 |
| CONT. | — | 83.0 | — | — | 10.4 | — | — | 5.5 | — | — |
| LAB840 | 75833.2 | — | — | — | — | — | — | 6.0 | 0.25 | 4 |
| LAB801 | 75887.2 | 114.4 | 0.29 | 15 | 14.3 | 0.29 | 15 | 6.4 | 0.09 | 11 |
| LAB800 | 75355.3 | 108.5 | 0.20 | 9 | 13.6 | 0.20 | 9 | 6.0 | 0.28 | 4 |
| LAB788 | 76234.1 | — | — | — | — | — | — | 6.3 | 0.23 | 10 |
| LAB786 | 76230.6 | — | — | — | — | — | — | 6.0 | 0.26 | 4 |
| LAB777 | 76274.7 | 114.6 | 0.09 | 15 | 14.3 | 0.09 | 15 | 6.1 | 0.11 | 6 |
| LAB704 | 75132.1 | 106.8 | 0.19 | 7 | 13.4 | 0.19 | 7 | 6.1 | 0.14 | 5 |
| LAB704 | 75132.2 | 112.8 | 0.04 | 13 | 14.1 | 0.04 | 13 | 6.3 | 0.02 | 9 |
| LAB642 | 75912.1 | 108.0 | 0.14 | 8 | 13.5 | 0.14 | 8 | 6.2 | 0.05 | 7 |
| CONT. | — | 99.7 | — | — | 12.5 | — | — | 5.8 | — | — |
| LAB835 | 75896.3 | 62.7 | 0.06 | 30 | 7.8 | 0.06 | 30 | 4.8 | L | 11 |
| LAB835 | 75896.4 | 59.2 | 0.19 | 23 | 7.4 | 0.19 | 23 | 4.8 | 0.28 | 9 |
| LAB835 | 75900.1 | 59.7 | 0.21 | 24 | 7.5 | 0.21 | 24 | 4.8 | 0.11 | 11 |
| LAB833 | 75466.1 | 63.1 | 0.05 | 31 | 7.9 | 0.05 | 31 | 5.2 | L | 21 |
| LAB833 | 75467.3 | 52.6 | 0.22 | 9 | 6.6 | 0.22 | 9 | — | — | — |
| LAB833 | 75468.4 | 54.4 | 0.01 | 13 | 6.8 | 0.01 | 13 | 4.5 | 0.29 | 3 |
| LAB796 | 75322.1 | 66.0 | 0.20 | 37 | 8.2 | 0.20 | 37 | 5.1 | 0.17 | 17 |
| LAB780 | 75771.2 | 56.6 | 0.26 | 18 | 7.1 | 0.26 | 18 | 4.7 | 0.05 | 8 |
| LAB780 | 75771.3 | 58.7 | L | 22 | 7.3 | L | 22 | 4.7 | 0.01 | 8 |
| LAB780 | 75773.3 | 60.5 | 0.12 | 26 | 7.6 | 0.12 | 26 | 4.7 | 0.02 | 9 |
| LAB778 | 75967.2 | 65.4 | L | 36 | 8.2 | L | 36 | 4.9 | L | 13 |
| LAB778 | 75969.2 | 56.6 | L | 18 | 7.1 | L | 18 | 4.7 | 0.04 | 9 |
| LAB776 | 75746.2 | 60.7 | 0.21 | 26 | 8.1 | L | 34 | 5.1 | L | 17 |
| LAB776 | 75749.1 | — | — | — | — | — | — | 4.8 | 0.06 | 9 |
| LAB776 | 75750.3 | 68.6 | L | 43 | 8.6 | L | 43 | 5.2 | L | 20 |
| LAB776 | 75750.4 | 64.1 | L | 33 | 8.0 | L | 33 | 5.0 | 0.02 | 15 |
| LAB772 | 75459.1 | 54.1 | 0.02 | 12 | 6.8 | 0.02 | 12 | 4.6 | 0.22 | 5 |

TABLE 168-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB772 | 75461.6 | 52.6 | 0.04 | 9 | 6.6 | 0.04 | 9 | — | — | — |
| LAB768 | 75453.1 | 63.3 | 0.08 | 31 | 7.9 | 0.08 | 31 | 5.0 | 0.05 | 16 |
| LAB768 | 75453.2 | 55.4 | L | 15 | 6.9 | L | 15 | 4.7 | 0.01 | 8 |
| LAB768 | 75453.3 | 60.0 | 0.08 | 25 | 7.5 | 0.08 | 25 | 4.8 | 0.12 | 10 |
| LAB768 | 75455.1 | 58.5 | 0.07 | 22 | 7.3 | 0.07 | 22 | 4.8 | L | 10 |
| LAB752 | 75168.1 | 59.6 | 0.05 | 24 | 7.4 | 0.05 | 24 | 4.8 | 0.02 | 11 |
| LAB746 | 75507.2 | 58.2 | L | 21 | 7.3 | L | 21 | 4.8 | L | 11 |
| LAB739 | 75444.4 | 61.0 | 0.04 | 27 | 7.6 | 0.04 | 27 | 4.9 | L | 12 |
| LAB739 | 75445.1 | 59.7 | L | 24 | 7.5 | L | 24 | 4.9 | 0.02 | 12 |
| LAB733 | 75158.2 | 53.2 | 0.07 | 11 | 6.7 | 0.07 | 11 | 4.5 | 0.22 | 4 |
| LAB724 | 75142.1 | 56.9 | 0.10 | 18 | 7.1 | 0.10 | 18 | 4.7 | 0.09 | 8 |
| LAB724 | 75143.2 | 63.0 | L | 31 | 7.9 | L | 31 | 5.1 | L | 16 |
| LAB724 | 75145.1 | 53.6 | 0.02 | 11 | 6.7 | 0.02 | 11 | 4.6 | 0.06 | 6 |
| LAB724 | 75146.2 | 69.6 | 0.15 | 45 | 8.7 | 0.15 | 45 | 5.2 | 0.09 | 20 |
| LAB718 | 75437.2 | — | — | — | — | — | — | 4.7 | 0.10 | 8 |
| LAB718 | 75439.2 | 60.4 | L | 26 | 7.5 | L | 26 | 4.9 | 0.01 | 13 |
| LAB716 | 75429.3 | 64.0 | L | 33 | 8.0 | L | 33 | 5.0 | L | 16 |
| LAB716 | 75430.5 | 59.7 | L | 24 | 8.0 | 0.11 | 33 | 4.9 | 0.03 | 14 |
| LAB716 | 75431.2 | 56.3 | 0.11 | 17 | 7.0 | 0.11 | 17 | — | — | — |
| LAB705 | 74879.2 | 62.7 | L | 30 | 7.8 | L | 30 | 4.9 | L | 14 |
| LAB705 | 74879.3 | 51.2 | 0.12 | 6 | 6.4 | 0.12 | 6 | 4.5 | 0.24 | 3 |
| LAB705 | 74881.1 | 55.9 | 0.03 | 16 | 7.0 | 0.03 | 16 | 4.7 | 0.08 | 8 |
| LAB686 | 75364.1 | 54.7 | 0.02 | 14 | 6.8 | 0.02 | 14 | — | — | — |
| LAB686 | 75364.4 | 56.6 | 0.25 | 18 | 7.1 | 0.25 | 18 | — | — | — |
| LAB686 | 75364.6 | — | — | — | — | — | — | 4.5 | 0.23 | 3 |
| LAB681 | 75420.4 | 58.4 | L | 21 | 7.3 | L | 21 | 4.8 | L | 11 |
| LAB681 | 75421.4 | 51.9 | 0.15 | 8 | 6.5 | 0.15 | 8 | — | — | — |
| CONT. | — | 48.1 | — | — | 6.0 | — | — | 4.3 | — | — |
| LAB800 | 75331.6 | 84.7 | 0.28 | 28 | 10.6 | 0.28 | 28 | 5.6 | 0.22 | 17 |
| LAB791 | 75318.2 | 88.1 | 0.22 | 33 | 11.0 | 0.22 | 33 | 5.7 | 0.18 | 18 |
| LAB769 | 75345.1 | 86.2 | 0.28 | 30 | 10.8 | 0.28 | 30 | 5.7 | 0.19 | 19 |
| LAB704 | 75132.3 | — | — | — | — | — | — | 5.5 | 0.28 | 14 |
| LAB704 | 75133.1 | — | — | — | — | — | — | 5.5 | 0.27 | 14 |
| CONT. | — | 66.2 | — | — | 8.3 | — | — | 4.8 | — | — |
| LAB807 | 76240.1 | 104.3 | 0.21 | 18 | 13.0 | 0.21 | 18 | 6.3 | 0.16 | 8 |
| LAB793 | 75751.2 | 103.3 | 0.07 | 17 | 12.9 | 0.07 | 17 | 6.1 | 0.16 | 5 |
| LAB793 | 75755.1 | 107.8 | 0.06 | 22 | 13.5 | 0.06 | 22 | 6.4 | 0.08 | 10 |
| LAB727 | 76387.3 | — | — | — | 13.7 | 0.24 | 24 | — | — | — |
| LAB726 | 76382.1 | — | — | — | — | — | — | 6.2 | 0.11 | 7 |
| LAB688 | 75829.1 | 107.4 | 0.18 | 21 | 13.4 | 0.18 | 21 | 6.5 | 0.13 | 11 |
| LAB625 | 76472.1 | 95.3 | 0.22 | 8 | 11.9 | 0.22 | 8 | — | — | — |
| CONT. | — | 88.5 | — | — | 11.1 | — | — | 5.8 | — | — |

Table 168. "CONT."—Control; "Ave."—Average; "% Incr." = % increment; "p-val."—p-value, L—p < 0.01.

TABLE 169

Genes showing improved plant performance at normal growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB795 | 76491.2 | 0.76 | 0.28 | 17 | 9.75 | 0.19 | 27 | — | — | — |
| LAB795 | 76491.3 | — | — | — | 9.28 | 0.28 | 21 | — | — | — |
| LAB795 | 76494.3 | — | — | — | 9.50 | 0.23 | 23 | — | — | — |
| LAB792 | 75878.3 | — | — | — | 9.75 | 0.17 | 27 | — | — | — |
| LAB792 | 75880.4 | 0.86 | 0.04 | 33 | 9.73 | 0.18 | 26 | — | — | — |
| LAB789 | 77085.3 | — | — | — | 9.36 | 0.26 | 22 | — | — | — |
| LAB784 | 76468.3 | — | — | — | 9.58 | 0.2 | 25 | — | — | — |
| LAB784 | 76470.2 | — | — | — | 9.54 | 0.21 | 24 | — | — | — |
| LAB769 | 75309.1 | — | — | — | 9.51 | 0.22 | 24 | — | — | — |
| LAB769 | 75348.4 | — | — | — | 9.87 | 0.14 | 28 | — | — | — |
| LAB649 | 77044.2 | — | — | — | 9.62 | 0.23 | 25 | — | — | — |
| LAB649 | 77045.3 | — | — | — | 10.22 | 0.1 | 33 | 0.50 | 0.28 | 16 |
| LAB637 | 75105.8 | — | — | — | 10.74 | 0.05 | 40 | — | — | — |
| LAB636 | 75100.3 | — | — | — | 10.09 | 0.11 | 31 | — | — | — |

TABLE 169-continued

Genes showing improved plant performance at normal growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB636 | 75104.1 | 0.79 | 0.23 | 22 | 10.97 | 0.07 | 43 | 0.51 | 0.23 | 18 |
| CONT. | — | 0.65 | — | — | 7.69 | — | — | 0.43 | — | — |
| LAB839 | 75623.3 | 0.67 | 0.16 | 40 | — | — | — | — | — | — |
| LAB839 | 75624.1 | 0.69 | 0.13 | 44 | 18.32 | 0.09 | 34 | — | — | — |
| LAB809 | 75651.2 | 0.65 | 0.2 | 36 | — | — | — | — | — | — |
| LAB809 | 75651.3 | 0.70 | 0.12 | 46 | — | — | — | — | — | — |
| LAB783 | 75980.5 | 0.70 | 0.13 | 45 | — | — | — | — | — | — |
| LAB762 | 75866.2 | — | — | — | 16.95 | 0.21 | 24 | — | — | — |
| LAB740 | 75264.1 | 0.63 | 0.26 | 31 | — | — | — | — | — | — |
| LAB686 | 75364.6 | 0.70 | 0.14 | 46 | 17.05 | 0.2 | 25 | — | — | — |
| LAB681 | 75418.2 | 0.66 | 0.24 | 37 | — | — | — | — | — | — |
| LAB681 | 75421.4 | 0.64 | 0.25 | 33 | — | — | — | — | — | — |
| LAB665 | 75040.3 | 0.73 | 0.08 | 53 | 16.46 | 0.29 | 20 | — | — | — |
| LAB665 | 75042.3 | — | — | — | 17.69 | 0.14 | 29 | 0.65 | 0.16 | 17 |
| LAB655 | 75119.2 | 0.68 | 0.14 | 42 | — | — | — | — | — | — |
| CONT. | — | 0.48 | — | — | 13.66 | — | — | 0.55 | — | — |
| LAB815 | 76026.1 | — | — | — | — | — | — | 0.53 | 0.21 | 11 |
| LAB815 | 76030.1 | — | — | — | 11.57 | 0.23 | 18 | — | — | — |
| LAB794 | 75881.2 | — | — | — | 11.34 | 0.29 | 16 | — | — | — |
| LAB762 | 75870.3 | 0.86 | 0.23 | 15 | — | — | — | — | — | — |
| LAB748 | 74972.3 | 0.93 | 0.05 | 25 | — | — | — | — | — | — |
| LAB748 | 74976.2 | — | — | — | 11.36 | 0.29 | 16 | — | — | — |
| LAB706 | 74802.2 | — | — | — | — | — | — | 0.52 | 0.29 | 9 |
| LAB689 | 74756.2 | 0.86 | 0.22 | 15 | — | — | — | — | — | — |
| LAB689 | 74758.4 | — | — | — | 12.66 | 0.06 | 29 | 0.54 | 0.17 | 12 |
| LAB689 | 74760.1 | — | — | — | 12.36 | 0.09 | 26 | 0.55 | 0.09 | 15 |
| LAB666 | 74840.3 | 0.85 | 0.26 | 14 | — | — | — | — | — | — |
| LAB624 | 77106.1 | 0.90 | 0.11 | 20 | — | — | — | — | — | — |
| LAB624 | 77108.5 | 0.86 | 0.26 | 15 | — | — | — | — | — | — |
| CONT. | — | 0.74 | — | — | 9.80 | — | — | 0.48 | — | — |
| LAB837 | 76259.4 | — | — | — | 11.47 | 0.08 | 18 | 0.57 | 0.27 | 12 |
| LAB800 | 75331.5 | — | — | — | 11.03 | 0.17 | 14 | — | — | — |
| LAB786 | 76230.2 | 0.81 | 0.21 | 24 | 11.58 | 0.05 | 19 | 0.60 | 0.08 | 17 |
| LAB778 | 75966.3 | — | — | — | 11.75 | 0.05 | 21 | 0.59 | 0.14 | 16 |
| LAB776 | 75750.3 | — | — | — | — | — | — | 0.58 | 0.18 | 13 |
| LAB776 | 75750.4 | 0.82 | 0.12 | 27 | — | — | — | — | — | — |
| LAB772 | 75461.6 | — | — | — | — | — | — | 0.59 | 0.11 | 16 |
| LAB768 | 75453.1 | 0.81 | 0.18 | 24 | — | — | — | — | — | — |
| LAB768 | 75453.3 | 0.82 | 0.13 | 27 | — | — | — | — | — | — |
| LAB752 | 75165.2 | — | — | — | 11.17 | 0.13 | 15 | 0.57 | 0.2 | 12 |
| LAB746 | 75508.3 | — | — | — | 10.96 | 0.19 | 13 | 0.57 | 0.26 | 11 |
| LAB739 | 75444.5 | 0.84 | 0.12 | 30 | 11.98 | 0.04 | 23 | 0.57 | 0.2 | 13 |
| LAB733 | 75155.2 | 0.83 | 0.12 | 28 | 10.86 | 0.24 | 12 | — | — | — |
| LAB733 | 75158.3 | — | — | — | 10.84 | 0.28 | 12 | 0.57 | 0.24 | 12 |
| LAB718 | 75437.2 | — | — | — | 10.76 | 0.27 | 11 | 0.57 | 0.2 | 12 |
| LAB716 | 75429.3 | — | — | — | 11.37 | 0.1 | 17 | 0.59 | 0.1 | 16 |
| LAB716 | 75431.2 | — | — | — | 11.33 | 0.1 | 17 | — | — | — |
| LAB686 | 75363.1 | — | — | — | — | — | — | 0.57 | 0.26 | 11 |
| LAB681 | 75419.1 | — | — | — | 11.02 | 0.17 | 13 | 0.57 | 0.21 | 12 |
| CONT. | — | 0.65 | — | — | 9.72 | — | — | 0.51 | — | — |
| LAB792 | 75876.3 | — | — | — | 12.86 | 0.29 | 17 | — | — | — |
| LAB636 | 75104.1 | — | — | — | 14.45 | 0.06 | 32 | — | — | — |
| CONT. | — | — | — | — | 10.98 | — | — | — | — | — |
| LAB801 | 75887.2 | — | — | — | 16.60 | 0.21 | 16 | — | — | — |
| LAB788 | 76234.1 | — | — | — | 16.97 | 0.16 | 18 | — | — | — |
| LAB704 | 75132.2 | — | — | — | 16.76 | 0.17 | 17 | — | — | — |
| CONT. | — | — | — | — | 14.36 | — | — | — | — | — |
| LAB835 | 75896.3 | — | — | — | 8.27 | 0.02 | 31 | 0.45 | 0.22 | 12 |
| LAB835 | 75896.4 | 0.67 | 0.22 | 22 | 7.81 | 0.08 | 24 | 0.45 | 0.26 | 11 |
| LAB835 | 75896.5 | — | — | — | — | — | — | 0.45 | 0.25 | 13 |
| LAB835 | 75900.1 | — | — | — | 7.78 | 0.09 | 24 | 0.46 | 0.14 | 15 |
| LAB833 | 75466.1 | — | — | — | 8.34 | 0.02 | 33 | 0.52 | L | 29 |
| LAB833 | 75467.4 | 0.68 | 0.22 | 24 | 8.03 | 0.09 | 28 | — | — | — |
| LAB833 | 75468.4 | 0.66 | 0.3 | 20 | — | — | — | — | — | — |
| LAB796 | 75322.1 | — | — | — | 8.63 | 0.01 | 37 | 0.47 | 0.08 | 18 |
| LAB780 | 75771.2 | 0.67 | 0.25 | 21 | 7.43 | 0.17 | 18 | — | — | — |
| LAB780 | 75771.3 | — | — | — | 7.74 | 0.09 | 23 | 0.44 | 0.3 | 10 |
| LAB780 | 75773.3 | 0.70 | 0.14 | 26 | 7.82 | 0.07 | 24 | — | — | — |
| LAB778 | 75967.2 | 0.74 | 0.06 | 34 | 8.57 | 0.01 | 36 | 0.46 | 0.17 | 13 |
| LAB778 | 75969.2 | — | — | — | 7.42 | 0.17 | 18 | 0.44 | 0.29 | 10 |
| LAB778 | 75969.4 | 0.69 | 0.16 | 24 | — | — | — | — | — | — |

TABLE 169-continued

Genes showing improved plant performance at normal growth conditions under regulation of At6669 promoter

| Gene Name | Event # | RGR Of Leaf Number (number/day) | | | RGR Of Plot Coverage (cm²/day) | | | RGR Of Rosette Diameter (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB776 | 75746.2 | 0.72 | 0.09 | 31 | 8.05 | 0.04 | 28 | 0.50 | 0.02 | 23 |
| LAB776 | 75749.1 | — | — | — | 7.42 | 0.18 | 18 | 0.46 | 0.18 | 13 |
| LAB776 | 75750.3 | 0.70 | 0.12 | 27 | 9.06 | L | 44 | 0.50 | 0.01 | 25 |
| LAB776 | 75750.4 | 0.70 | 0.13 | 27 | 8.42 | 0.01 | 34 | 0.47 | 0.09 | 16 |
| LAB772 | 75459.1 | 0.69 | 0.2 | 24 | — | — | — | — | — | — |
| LAB772 | 75461.6 | 0.70 | 0.14 | 26 | — | — | — | — | — | — |
| LAB768 | 75453.1 | — | — | — | 8.27 | 0.03 | 31 | 0.47 | 0.08 | 18 |
| LAB768 | 75453.2 | 0.67 | 0.24 | 21 | 7.33 | 0.2 | 17 | 0.46 | 0.13 | 15 |
| LAB768 | 75453.3 | — | — | — | 7.82 | 0.07 | 24 | — | — | — |
| LAB768 | 75455.1 | — | — | — | 7.77 | 0.08 | 23 | 0.46 | 0.18 | 13 |
| LAB752 | 75168.1 | 0.69 | 0.17 | 25 | 7.73 | 0.09 | 23 | 0.45 | 0.23 | 12 |
| LAB746 | 75507.2 | — | — | — | 7.64 | 0.1 | 21 | 0.45 | 0.25 | 11 |
| LAB746 | 75508.3 | 0.69 | 0.17 | 25 | — | — | — | 0.44 | 0.3 | 10 |
| LAB739 | 75444.4 | — | — | — | 7.99 | 0.05 | 27 | 0.46 | 0.12 | 15 |
| LAB739 | 75445.1 | — | — | — | 7.80 | 0.07 | 24 | 0.46 | 0.14 | 15 |
| LAB733 | 75154.3 | 0.66 | 0.27 | 19 | — | — | — | — | — | — |
| LAB724 | 75142.1 | — | — | — | 7.50 | 0.14 | 19 | — | — | — |
| LAB724 | 75143.2 | — | — | — | 8.18 | 0.03 | 30 | 0.47 | 0.12 | 16 |
| LAB724 | 75146.2 | 0.67 | 0.24 | 22 | 9.15 | L | 45 | 0.49 | 0.03 | 22 |
| LAB718 | 75437.2 | — | — | — | 7.61 | 0.13 | 21 | 0.45 | 0.25 | 11 |
| LAB718 | 75439.2 | — | — | — | 7.99 | 0.04 | 27 | 0.46 | 0.13 | 14 |
| LAB718 | 75439.3 | — | — | — | 7.20 | 0.26 | 15 | — | — | — |
| LAB716 | 75429.3 | — | — | — | 8.37 | 0.02 | 33 | 0.48 | 0.05 | 19 |
| LAB716 | 75430.5 | — | — | — | 7.83 | 0.08 | 24 | 0.47 | 0.07 | 18 |
| LAB716 | 75431.2 | 0.76 | 0.04 | 37 | 7.42 | 0.17 | 18 | — | — | — |
| LAB705 | 74879.2 | — | — | — | 8.15 | 0.03 | 30 | 0.46 | 0.18 | 13 |
| LAB705 | 74879.3 | 0.68 | 0.19 | 24 | — | — | — | — | — | — |
| LAB705 | 74881.1 | — | — | — | 7.26 | 0.23 | 15 | — | — | — |
| LAB686 | 75364.1 | — | — | — | 7.27 | 0.24 | 16 | 0.45 | 0.21 | 12 |
| LAB686 | 75364.4 | 0.68 | 0.21 | 23 | 7.36 | 0.2 | 17 | — | — | — |
| LAB681 | 75420.4 | 0.72 | 0.1 | 30 | 7.70 | 0.09 | 22 | 0.47 | 0.09 | 16 |
| LAB681 | 75421.4 | 0.71 | 0.13 | 28 | — | — | — | — | — | — |
| CONT. | — | 0.55 | — | — | 6.29 | — | — | 0.40 | — | — |
| LAB800 | 75331.6 | — | — | — | 11.43 | 0.25 | 29 | 0.58 | 0.22 | 20 |
| LAB791 | 75318.2 | — | — | — | 11.82 | 0.2 | 33 | 0.58 | 0.24 | 19 |
| LAB769 | 75345.1 | — | — | — | 11.56 | 0.25 | 30 | 0.58 | 0.23 | 20 |
| CONT. | — | — | — | — | 8.87 | — | — | 0.49 | — | — |
| LAB793 | 75755.1 | — | — | — | 16.33 | 0.17 | 23 | — | — | — |
| LAB787 | 76755.5 | 0.61 | 0.01 | 82 | — | — | — | — | — | — |
| LAB736 | 76368.2 | 0.49 | 0.23 | 45 | — | — | — | — | — | — |
| LAB736 | 76370.1 | 0.51 | 0.1 | 52 | — | — | — | — | — | — |
| LAB736 | 76370.3 | 0.46 | 0.22 | 38 | — | — | — | — | — | — |
| LAB727 | 76387.3 | — | — | — | — | — | — | 0.74 | 0.19 | 17 |
| LAB726 | 76382.1 | — | — | — | 15.92 | 0.27 | 20 | — | — | — |
| LAB698 | 76201.1 | 0.46 | 0.24 | 38 | — | — | — | — | — | — |
| LAB688 | 75829.1 | — | — | — | 16.35 | 0.16 | 23 | — | — | — |
| LAB687 | 75043.1 | 0.47 | 0.24 | 38 | — | — | — | — | — | — |
| LAB687 | 75046.4 | — | — | — | 17.11 | 0.14 | 29 | — | — | — |
| LAB677 | 76528.1 | 0.50 | 0.14 | 47 | — | — | — | — | — | — |
| LAB673 | 76533.1 | 0.47 | 0.28 | 41 | — | — | — | — | — | — |
| LAB625 | 76472.1 | 0.47 | 0.23 | 41 | — | — | — | — | — | — |
| CONT. | — | 0.34 | — | — | 13.29 | — | — | 0.64 | — | — |

Table 169. "CONT."—Control; "Ave."—Average; "% Incr." = % increment; "p-val."—p-value, L—p < 0.01.

Example 25

Evaluating Transgenic *Arabidopsis* Plant Growth Under Abiotic Stress as Well as Under Favorable Conditions by Seedlind Analyses Assay 3: Seedling analysis of plants growth under osmotic stress [poly (ethylene glycol) (PEG)]—One of the consequences of drought is the induction of osmotic stress in the area surrounding the roots; therefore, in many scientific studies, PEG (e.g., 2.2% PEG) is used to simulate the osmotic stress conditions resembling the high osmolarity found during drought stress.

Assay 4: Seedling analysis of plants growth under high salinity conditions (NaCl)—High salinity is an abiotic stress that challenges the root systems of plants. Thus, an assay in which plants are grown under high salinity (110-120 mM NaCl) was conducted and plant performance in terms of shoot and root growth was evaluated.

Assay 5: Seedling analysis of plants growth under low and favorable nitrogen concentration levels—Low nitrogen is another abiotic stress that impact root growth and seedling growth. Therefore, an assay that examines plant performance under low (0.75 mM Nitrogen) and favorable (15 mM Nitrogen) nitrogen concentrations was performed.

Description of Experiment for Assays 3 and 4:

Surface sterilized seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing either 2.2% PEG: 0.5 MS media (assay 3), 110-120 mM NaCl: 0.5 MS media (assay 4), or Normal growth conditions (0.5 MS media). Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment.

Description of Experiment for Assay 5:

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F).

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at Hypertext Transfer Protocol://rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following Formulas XXVI (below) and XVII (above).

Relative growth rate of leaf area=Regression coefficient of leaf area along time course (measured in $cm^2$ per day).     Formula XXVI:

At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor, under osmotic stress, as well as under optimal conditions. Similarly, the effect of the gene introduced on biomass accumulation, under osmotic stress as well as under optimal conditions, was determined by comparing the plants' fresh and dry weight to that of control plants (containing an empty vector or the GUS reporter gene under the same promoter). From every construct created, 3-5 independent transformation events are examined in replicates.

Statistical analyses—To identify genes conferring significantly improved tolerance to abiotic stresses or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if $p \leq 0.1$. The JMP statistics software package was used (Version 5.2.1, SAS Institute Inc., Cary, N.C., USA).

Experimental Results:

The genes listed in Table 170 improved plant biomass when grown at standard conditions. These genes produced larger plant biomass (plant fresh and dry weight) when grown under standard conditions, compared to control plants. Larger plant biomass under these growth conditions indicates the high ability of the plant to better metabolize the nutrients present in the medium. Plants were evaluated in T2 generation (Table 170). The genes were cloned under the regulation of a constitutive promoter (At6669; SEQ ID NO:10446). The evaluation of each gene was performed by testing the performance of different number of events. Some of the genes were evaluated in more than one seedling analysis resulting in positive results as well.

TABLE 170

Genes showing improved plant performance at Normal growth conditions under regulation of At6669 promoter (T2 generation)

| | | Dry Weight [mg] | | | Fresh Weight [mg] | | |
|---|---|---|---|---|---|---|---|
| Gene Name | Event # | Ave. | P-Val. | % Incr. | Ave. | P-Val. | % Incr. |
| LAB799 | 77468.3 | 8.0 | 0.11 | 40 | — | — | — |
| LAB738 | 75163.4 | 12.8 | 0.03 | 123 | 236.5 | 0.02 | 119 |
| CONT. | — | 5.7 | — | — | 108.0 | — | — |
| LAB682 | 77859.1 | 7.6 | 0.11 | 153 | — | — | — |
| CONT. | — | 3.0 | — | — | — | — | — |
| LAB823 | 77027.1 | 6.5 | 0.04 | 84 | 109.0 | 0.03 | 47 |
| LAB782 | 76850.4 | 5.7 | 0.11 | 61 | — | — | — |

TABLE 170-continued

Genes showing improved plant performance at Normal growth conditions under regulation of At6669 promoter (T2 generation)

| Gene Name | Event # | Dry Weight [mg] Ave. | P-Val. | % Incr. | Fresh Weight [mg] Ave. | P-Val. | % Incr. |
|---|---|---|---|---|---|---|---|
| LAB751 | 76930.2 | 5.2 | 0.26 | 48 | — | — | — |
| LAB717 | 76430.1 | 4.7 | 0.26 | 33 | — | — | — |
| LAB703 | 76422.2 | 5.1 | 0.24 | 44 | — | — | — |
| CONT. | — | 3.5 | — | — | 74.0 | — | — |
| LAB832 | 77332.1 | 6.5 | L | 72 | 101.6 | L | 34 |
| LAB832 | 77332.4 | 7.3 | L | 93 | 120.3 | 0.02 | 59 |
| LAB832 | 77333.7 | 5.3 | 0.01 | 39 | 98.9 | 0.04 | 31 |
| LAB770 | 77763.2 | 4.9 | 0.05 | 28 | 91.1 | 0.22 | 21 |
| LAB755 | 75172.7 | 6.4 | 0.15 | 68 | 135.3 | 0.02 | 79 |
| LAB722 | 76464.4 | — | — | — | 98.7 | 0.29 | 31 |
| LAB678 | 77821.4 | 5.1 | L | 35 | 94.0 | 0.15 | 24 |
| LAB678 | 77823.3 | 6.3 | 0.22 | 66 | 104.9 | L | 39 |
| LAB660 | 75841.3 | 5.5 | 0.20 | 43 | 90.1 | 0.06 | 19 |
| LAB653 | 75116.3 | 4.5 | 0.26 | 18 | 98.8 | 0.27 | 31 |
| LAB630 | 77786.2 | 5.2 | 0.07 | 36 | — | — | — |
| CONT. | — | 3.8 | — | — | 75.6 | — | — |
| LAB834 | 75891.1 | 7.8 | L | 40 | 175.9 | 0.09 | 31 |
| LAB834 | 75892.5 | 8.1 | 0.07 | 45 | 192.5 | 0.17 | 44 |
| LAB807 | 76236.3 | 6.6 | 0.26 | 18 | — | — | — |
| LAB807 | 76237.1 | 11.8 | L | 111 | 277.7 | L | 107 |
| LAB726 | 76381.1 | 10.0 | 0.05 | 79 | 194.4 | 0.19 | 45 |
| LAB726 | 76382.1 | 8.8 | L | 57 | 168.3 | 0.19 | 26 |
| LAB726 | 76385.1 | 7.5 | 0.03 | 34 | 185.3 | 0.26 | 38 |
| LAB696 | 75849.2 | — | — | — | 200.3 | 0.15 | 50 |
| LAB696 | 75850.4 | 6.7 | 0.29 | 20 | — | — | — |
| LAB687 | 75045.2 | 7.0 | 0.03 | 26 | 182.0 | 0.14 | 36 |
| LAB687 | 75046.1 | 7.9 | 0.12 | 41 | — | — | — |
| LAB687 | 75046.4 | 6.6 | 0.12 | 19 | 179.8 | 0.27 | 34 |
| LAB687 | 75047.2 | 6.6 | 0.08 | 19 | — | — | — |
| LAB673 | 76532.2 | 8.3 | 0.07 | 48 | 231.8 | 0.16 | 73 |
| LAB673 | 76533.1 | 8.4 | 0.12 | 50 | 189.9 | 0.25 | 42 |
| LAB673 | 76534.3 | 7.1 | 0.22 | 27 | — | — | — |
| LAB650 | 75836.2 | 7.6 | L | 36 | 200.0 | 0.29 | 49 |
| LAB650 | 75838.2 | 8.2 | 0.05 | 46 | — | — | — |
| LAB650 | 75839.2 | 6.5 | 0.26 | 17 | — | — | — |
| LAB626 | 74770.1 | 7.6 | 0.01 | 37 | 181.4 | 0.13 | 35 |
| LAB626 | 74771.2 | 7.4 | 0.02 | 33 | 196.6 | 0.05 | 47 |
| CONT. | — | 5.6 | — | — | 133.9 | — | — |
| LAB848 | 77339.2 | 6.6 | 0.07 | 69 | 125.8 | 0.28 | 42 |
| LAB811 | 78053.6 | 4.9 | 0.19 | 26 | 111.7 | 0.20 | 26 |
| LAB785 | 77997.3 | 6.5 | 0.03 | 65 | — | — | — |
| LAB728 | 75151.2 | 6.2 | 0.29 | 59 | — | — | — |
| CONT. | — | 3.9 | — | — | 88.8 | — | — |
| LAB813 | 76245.2 | — | — | — | 145.3 | 0.27 | 41 |
| CONT. | — | — | — | — | 103.1 | — | — |
| LAB725 | 75857.2 | — | — | — | 134.5 | 0.23 | 61 |
| LAB657 | 75733.4 | 8.2 | 0.14 | 93 | 138.9 | 0.27 | 66 |
| CONT. | — | 4.3 | — | — | 83.8 | — | — |
| LAB721 | 76102.3 | 7.2 | 0.22 | 24 | — | — | — |
| LAB696 | 75850.2 | 8.0 | 0.14 | 37 | 152.2 | 0.23 | 16 |
| LAB654 | 76745.2 | 9.4 | 0.24 | 62 | — | — | — |
| LAB651 | 76739.3 | 8.0 | 0.15 | 37 | — | — | — |
| CONT. | — | 5.8 | — | — | 131.2 | — | — |
| LAB803 | 76760.1 | 3.6 | 0.11 | 45 | — | — | — |
| LAB799 | 77466.1 | 4.2 | 0.04 | 71 | 100.5 | 0.11 | 41 |
| LAB799 | 77470.3 | 5.2 | L | 111 | 143.4 | L | 101 |
| LAB779 | 77308.1 | 4.9 | L | 98 | — | — | — |
| LAB779 | 77309.3 | 4.2 | 0.02 | 69 | 121.4 | 0.02 | 70 |
| LAB761 | 77291.1 | 6.1 | L | 146 | 135.9 | 0.11 | 91 |
| LAB761 | 77292.8 | — | — | — | 142.2 | 0.20 | 99 |
| LAB761 | 77295.2 | 4.5 | L | 79 | 151.2 | 0.30 | 112 |
| LAB731 | 77131.2 | 6.3 | L | 154 | 113.5 | 0.16 | 59 |
| LAB731 | 77134.1 | 5.7 | 0.10 | 128 | 119.6 | 0.20 | 68 |
| LAB727 | 76386.1 | 4.6 | 0.06 | 85 | — | — | — |
| LAB727 | 76386.2 | — | — | — | 120.4 | 0.22 | 69 |
| LAB727 | 76386.4 | 5.9 | L | 139 | 147.6 | 0.08 | 107 |
| LAB727 | 76387.3 | 3.7 | 0.03 | 50 | — | — | — |
| LAB617 | 76336.1 | 4.8 | L | 94 | 128.4 | 0.16 | 80 |
| LAB616 | 76732.4 | 6.6 | L | 164 | 142.2 | L | 100 |
| LAB616 | 76732.6 | 3.1 | 0.28 | 27 | — | — | — |
| LAB616 | 76732.8 | 3.7 | 0.08 | 50 | 123.8 | 0.07 | 74 |
| CONT. | — | 2.5 | — | — | 71.3 | — | — |

Table 170. "CONT."—Control; "Ave."—Average; "% Incr." = % increment; "p-val."—p-value; L—p < 0.01.

The genes listed in Tables 171-172 improved leaf and root performance when grown at standard conditions. These genes produced larger leaf area and root biomass (leaf area, root length and root coverage) when grown under standard growth conditions, compared to control plants. Plants producing larger root biomass have better possibilities to absorb larger amount of water and nitrogen from soil. Plants producing larger leafs have better ability to produce assimilates. Plants were evaluated in T2 generation (Table 171) or T1 generation (Table 172). The genes were cloned under the regulation of a constitutive promoter (At6669; SEQ ID NO:10446). The evaluation of each gene was performed by testing the performance of different number of events. Some of the genes were evaluated in more than one seedling analysis resulting in positive results as well.

TABLE 171

Genes showing improved plant performance at Normal growth conditions under regulation of At6669 promoter (T2 generation)

| Gene Name | Event # | Leaf Area [cm$^2$] Ave. | P-Val. | % Incr. | Roots Coverage [cm$^2$] Ave. | P-Val. | % Incr. | Roots Length [cm] Ave. | P-Val. | % Incr. |
|---|---|---|---|---|---|---|---|---|---|---|
| LAB817 | 75756.5 | 0.607 | 0.25 | 24 | 9.392 | 0.07 | 43 | 7.073 | 0.05 | 12 |
| LAB810 | 76287.1 | — | — | — | 8.715 | 0.10 | 32 | — | — | — |
| LAB799 | 77468.3 | 0.639 | 0.10 | 31 | 9.902 | 0.03 | 50 | 7.286 | 0.13 | 15 |
| LAB738 | 75163.4 | 0.835 | 0.12 | 71 | 11.803 | 0.20 | 79 | 7.086 | 0.29 | 12 |
| CONT. | — | 0.489 | — | — | 6.584 | — | — | 6.316 | — | — |
| LAB849 | 75686.2 | — | — | — | 10.671 | 0.12 | 44 | 7.274 | 0.17 | 13 |
| LAB849 | 75706.2 | — | — | — | — | — | — | 7.427 | 0.01 | 16 |
| LAB813 | 76243.3 | — | — | — | 9.594 | 0.12 | 29 | 7.411 | 0.05 | 16 |
| LAB773 | 78332.2 | — | — | — | 9.581 | 0.17 | 29 | — | — | — |
| LAB770 | 77762.1 | — | — | — | — | — | — | 7.115 | 0.21 | 11 |
| LAB691 | 74780.3 | — | — | — | 8.991 | 0.22 | 21 | 6.746 | 0.23 | 5 |
| CONT. | — | — | — | — | 7.425 | — | — | 6.413 | — | — |
| LAB844 | 76787.5 | — | — | — | — | — | — | 6.167 | 0.12 | 12 |

TABLE 171-continued

Genes showing improved plant performance at Normal growth conditions under regulation of At6669 promoter (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB842 | 76350.2 | — | — | — | — | — | — | 6.752 | 0.04 | 22 |
| LAB842 | 76350.3 | — | — | — | 6.261 | 0.13 | 44 | 6.447 | 0.15 | 17 |
| LAB841 | 76804.2 | — | — | — | 6.615 | 0.12 | 53 | 6.364 | 0.21 | 15 |
| LAB829 | 76441.5 | — | — | — | — | — | — | 6.146 | 0.22 | 11 |
| LAB823 | 77027.1 | 0.549 | 0.04 | 40 | 5.836 | 0.16 | 35 | — | — | — |
| LAB823 | 77028.2 | — | — | — | — | — | — | 6.740 | 0.04 | 22 |
| LAB816 | 76717.2 | — | — | — | — | — | — | 6.195 | 0.14 | 12 |
| LAB782 | 76850.4 | 0.483 | 0.26 | 23 | — | — | — | 6.480 | 0.06 | 17 |
| LAB753 | 76440.2 | — | — | — | — | — | — | 6.111 | 0.16 | 11 |
| LAB717 | 76428.1 | — | — | — | 6.080 | 0.13 | 40 | 6.808 | 0.04 | 23 |
| LAB717 | 76428.4 | — | — | — | — | — | — | 6.708 | 0.03 | 21 |
| LAB717 | 76430.1 | 0.483 | 0.25 | 23 | 5.581 | 0.29 | 29 | 6.229 | 0.27 | 13 |
| LAB703 | 76422.2 | 0.493 | 0.18 | 25 | — | — | — | 6.322 | 0.08 | 14 |
| LAB671 | 76411.5 | — | — | — | 5.536 | 0.21 | 28 | 6.404 | 0.06 | 16 |
| LAB671 | 76411.6 | 0.443 | 0.19 | 13 | — | — | — | — | — | — |
| LAB667 | 76097.3 | — | — | — | — | — | — | 6.127 | 0.19 | 11 |
| LAB629 | 76896.2 | 0.464 | 0.10 | 18 | — | — | — | — | — | — |
| LAB629 | 76899.2 | — | — | — | — | — | — | 6.319 | 0.08 | 14 |
| CONT. | — | 0.393 | — | — | 4.335 | — | — | 5.529 | — | — |
| LAB749 | 77758.1 | — | — | — | — | — | — | 6.893 | 0.29 | 9 |
| LAB749 | 77759.4 | — | — | — | 8.134 | 0.10 | 41 | — | — | — |
| LAB682 | 77859.1 | 0.629 | 0.24 | 57 | 7.609 | 0.13 | 32 | 7.306 | 0.14 | 16 |
| CONT. | — | 0.401 | — | — | 5.760 | — | — | 6.307 | — | — |
| LAB832 | 77332.1 | 0.577 | 0.02 | 44 | 8.519 | 0.07 | 82 | 6.795 | 0.15 | 20 |
| LAB832 | 77332.4 | 0.635 | L | 59 | 7.713 | 0.13 | 65 | — | — | — |
| LAB832 | 77333.7 | 0.529 | 0.03 | 32 | 7.228 | L | 54 | 6.685 | 0.14 | 18 |
| LAB832 | 77333.8 | — | — | — | — | — | — | 6.263 | 0.15 | 10 |
| LAB770 | 77762.1 | 0.534 | 0.02 | 33 | 6.495 | 0.03 | 39 | 6.417 | 0.07 | 13 |
| LAB770 | 77763.1 | — | — | — | 5.614 | 0.09 | 20 | 6.212 | 0.19 | 10 |
| LAB770 | 77763.2 | 0.526 | L | 31 | — | — | — | — | — | — |
| LAB770 | 77765.2 | 0.503 | 0.05 | 26 | — | — | — | — | — | — |
| LAB755 | 75171.1 | — | — | — | 6.615 | 0.03 | 41 | 6.869 | L | 21 |
| LAB755 | 75172.3 | 0.443 | 0.28 | 11 | 5.257 | 0.17 | 12 | 6.198 | 0.20 | 9 |
| LAB755 | 75172.7 | 0.565 | 0.04 | 41 | 6.693 | L | 43 | 6.287 | 0.20 | 11 |
| LAB755 | 75175.1 | 0.479 | 0.30 | 20 | — | — | — | — | — | — |
| LAB722 | 76465.2 | 0.483 | 0.02 | 21 | 5.241 | 0.18 | 12 | — | — | — |
| LAB678 | 77821.4 | 0.480 | 0.11 | 20 | 5.652 | 0.19 | 21 | — | — | — |
| LAB678 | 77823.3 | 0.619 | 0.08 | 55 | 6.960 | L | 49 | 6.870 | 0.01 | 21 |
| LAB660 | 75841.3 | 0.516 | 0.30 | 29 | 6.426 | 0.06 | 37 | — | — | — |
| LAB660 | 75841.5 | — | — | — | — | — | — | 6.465 | 0.04 | 14 |
| LAB660 | 75841.6 | — | — | — | 5.369 | 0.24 | 15 | 6.285 | 0.14 | 11 |
| LAB653 | 75116.3 | 0.502 | 0.04 | 25 | 6.051 | 0.01 | 29 | 6.382 | 0.08 | 13 |
| LAB630 | 77786.2 | 0.535 | 0.06 | 34 | 7.268 | 0.12 | 55 | 6.686 | 0.02 | 18 |
| CONT. | — | 0.400 | — | — | 4.684 | — | — | 5.670 | — | — |
| LAB834 | 75891.1 | 0.656 | L | 33 | 9.746 | 0.02 | 33 | — | — | — |
| LAB834 | 75892.5 | 0.706 | 0.02 | 43 | 10.924 | L | 49 | 7.747 | 0.02 | 12 |
| LAB834 | 75893.1 | 0.537 | 0.22 | 9 | 8.914 | 0.12 | 21 | 7.534 | 0.20 | 9 |
| LAB834 | 75895.1 | 0.609 | 0.23 | 23 | 8.715 | 0.25 | 19 | — | — | — |
| LAB834 | 75895.4 | — | — | — | — | — | — | 7.731 | 0.04 | 12 |
| LAB807 | 76236.3 | 0.584 | 0.18 | 18 | 9.518 | 0.03 | 30 | 7.447 | 0.08 | 8 |
| LAB807 | 76237.1 | 0.945 | L | 91 | 12.607 | L | 72 | 8.101 | L | 17 |
| LAB807 | 76239.1 | — | — | — | — | — | — | 7.442 | 0.14 | 8 |
| LAB807 | 76240.4 | — | — | — | 8.404 | 0.26 | 14 | 7.337 | 0.16 | 6 |
| LAB726 | 76381.1 | 0.731 | 0.08 | 48 | 10.370 | 0.04 | 41 | — | — | — |
| LAB726 | 76382.1 | 0.793 | 0.04 | 61 | — | — | — | — | — | — |
| LAB726 | 76385.1 | 0.574 | 0.08 | 16 | 9.020 | 0.13 | 23 | — | — | — |
| LAB696 | 75849.2 | 0.562 | 0.29 | 14 | — | — | — | 7.675 | 0.06 | 11 |
| LAB696 | 75850.4 | 0.564 | 0.27 | 14 | 8.424 | 0.28 | 15 | — | — | — |
| LAB687 | 75043.1 | — | — | — | 8.811 | 0.10 | 20 | 7.562 | 0.04 | 9 |
| LAB687 | 75045.2 | 0.678 | 0.12 | 37 | — | — | — | — | — | — |
| LAB687 | 75046.1 | 0.618 | 0.05 | 25 | 9.211 | 0.28 | 25 | — | — | — |
| LAB687 | 75046.4 | 0.641 | 0.04 | 30 | 10.822 | L | 47 | 7.833 | 0.02 | 13 |
| LAB687 | 75047.2 | 0.611 | 0.02 | 24 | 9.130 | 0.23 | 24 | 7.488 | 0.28 | 8 |
| LAB673 | 76532.2 | 0.646 | 0.11 | 31 | 10.397 | 0.09 | 41 | 7.558 | 0.16 | 9 |
| LAB673 | 76533.1 | 0.678 | 0.10 | 37 | — | — | — | — | — | — |
| LAB673 | 76534.3 | 0.603 | 0.06 | 22 | 8.691 | 0.14 | 18 | — | — | — |
| LAB650 | 75836.1 | — | — | — | — | — | — | 7.507 | 0.12 | 9 |
| LAB650 | 75836.2 | 0.650 | L | 32 | 10.045 | 0.02 | 37 | 7.964 | 0.03 | 15 |
| LAB650 | 75838.2 | 0.674 | 0.04 | 37 | 11.304 | L | 54 | 7.963 | L | 15 |
| LAB650 | 75839.2 | 0.614 | 0.01 | 24 | 8.870 | 0.15 | 21 | 7.737 | 0.07 | 12 |
| LAB626 | 74770.1 | 0.663 | L | 34 | 9.874 | 0.01 | 34 | 7.513 | 0.07 | 9 |
| LAB626 | 74771.2 | 0.618 | 0.05 | 25 | — | — | — | — | — | — |

TABLE 171-continued

Genes showing improved plant performance at Normal growth conditions under regulation of At6669 promoter (T2 generation)

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| CONT. | — | 0.494 | — | — | 7.349 | — | — | 6.908 | — | — |
| LAB728 | 75151.2 | — | — | — | 7.053 | 0.28 | 53 | — | — | — |
| CONT. | — | — | — | — | 4.615 | — | — | — | — | — |
| LAB813 | 76243.3 | — | — | — | 6.815 | 0.28 | 25 | 7.211 | 0.04 | 21 |
| LAB813 | 76245.2 | 0.636 | 0.29 | 25 | — | — | — | — | — | — |
| LAB714 | 75139.4 | 0.627 | 0.23 | 23 | — | — | — | — | — | — |
| LAB631 | 74855.3 | — | — | — | 7.441 | 0.16 | 37 | 6.547 | 0.26 | 10 |
| CONT. | — | 0.509 | — | — | 5.441 | — | — | 5.949 | — | — |
| LAB809 | 75652.3 | — | — | — | 5.866 | 0.27 | 20 | — | — | — |
| LAB798 | 75616.2 | — | — | — | 6.006 | 0.17 | 23 | 6.467 | 0.07 | 13 |
| CONT. | — | — | — | — | 4.889 | — | — | 5.707 | — | — |
| LAB820 | 76121.2 | — | — | — | — | — | — | 7.132 | 0.24 | 15 |
| LAB820 | 76123.2 | — | — | — | 7.576 | 0.27 | 33 | 6.984 | 0.19 | 13 |
| LAB725 | 75857.2 | — | — | — | 8.502 | 0.30 | 50 | 7.242 | 0.16 | 17 |
| LAB725 | 75857.3 | — | — | — | — | — | — | 6.986 | 0.17 | 13 |
| LAB725 | 75858.3 | — | — | — | — | — | — | 6.783 | 0.29 | 10 |
| LAB657 | 75733.4 | 0.641 | 0.16 | 39 | 8.445 | 0.14 | 49 | 6.859 | 0.29 | 11 |
| LAB638 | 76092.1 | — | — | — | 8.710 | 0.17 | 53 | 7.266 | 0.14 | 17 |
| CONT. | — | 0.463 | — | — | 5.681 | — | — | 6.185 | — | — |
| LAB763 | 76262.1 | 0.700 | 0.17 | 30 | 10.551 | 0.20 | 40 | 7.339 | 0.05 | 18 |
| LAB763 | 76264.3 | — | — | — | — | — | — | 6.674 | 0.17 | 7 |
| LAB721 | 76102.3 | — | — | — | 9.848 | 0.03 | 31 | 7.728 | L | 24 |
| LAB721 | 76105.3 | — | — | — | — | — | — | 6.792 | 0.24 | 9 |
| LAB696 | 75850.2 | 0.651 | 0.24 | 21 | — | — | — | 6.954 | 0.25 | 11 |
| LAB654 | 76745.2 | 0.746 | 0.18 | 39 | 9.833 | 0.14 | 30 | 7.007 | 0.04 | 12 |
| LAB651 | 76739.3 | 0.666 | 0.28 | 24 | — | — | — | — | — | — |
| LAB635 | 76082.1 | — | — | — | — | — | — | 7.139 | 0.01 | 14 |
| LAB635 | 76085.2 | — | — | — | 8.573 | 0.23 | 14 | 7.176 | 0.11 | 15 |
| CONT. | — | 0.538 | — | — | 7.542 | — | — | 6.240 | — | — |
| LAB803 | 76760.1 | 0.495 | L | 40 | 8.459 | L | 55 | — | — | — |
| LAB799 | 77466.1 | 0.474 | 0.13 | 34 | 6.713 | 0.20 | 23 | — | — | — |
| LAB799 | 77468.3 | 0.385 | 0.29 | 9 | 6.339 | 0.28 | 16 | — | — | — |
| LAB799 | 77470.3 | 0.547 | 0.15 | 54 | — | — | — | — | — | — |
| LAB779 | 77308.1 | 0.494 | L | 39 | 7.780 | 0.03 | 42 | — | — | — |
| LAB779 | 77309.3 | 0.493 | L | 39 | 8.842 | 0.01 | 62 | 7.806 | 0.04 | 13 |
| LAB779 | 77310.3 | 0.496 | 0.15 | 40 | 6.744 | 0.04 | 23 | — | — | — |
| LAB761 | 77291.1 | 0.571 | 0.06 | 61 | 9.783 | 0.02 | 79 | 8.053 | 0.03 | 17 |
| LAB761 | 77292.8 | 0.427 | 0.27 | 21 | — | — | — | — | — | — |
| LAB761 | 77295.2 | 0.484 | 0.16 | 37 | 7.752 | 0.14 | 42 | — | — | — |
| LAB731 | 77131.2 | 0.653 | 0.05 | 84 | — | — | — | — | — | — |
| LAB731 | 77133.5 | — | — | — | 7.104 | 0.15 | 30 | — | — | — |
| LAB731 | 77134.1 | 0.546 | 0.10 | 54 | 7.595 | 0.21 | 39 | — | — | — |
| LAB727 | 76386.1 | 0.500 | L | 41 | 7.535 | 0.05 | 38 | 7.515 | 0.13 | 9 |
| LAB727 | 76386.4 | 0.543 | L | 53 | 9.748 | L | 78 | — | — | — |
| LAB727 | 76387.3 | 0.460 | L | 30 | — | — | — | — | — | — |
| LAB727 | 76389.2 | 0.507 | 0.05 | 43 | 6.639 | 0.11 | 21 | — | — | — |
| LAB617 | 76336.1 | 0.561 | L | 58 | 9.636 | L | 76 | 7.554 | 0.11 | 10 |
| LAB616 | 76732.4 | 0.503 | 0.09 | 42 | 8.151 | 0.14 | 49 | — | — | — |
| LAB616 | 76732.8 | 0.475 | 0.05 | 34 | 7.409 | 0.08 | 35 | — | — | — |
| CONT. | — | 0.354 | — | — | 5.469 | — | — | 6.898 | — | — |
| LAB825 | 76394.1 | — | — | — | — | — | — | 7.939 | 0.13 | 6 |
| LAB758 | 76490.4 | 0.691 | 0.23 | 25 | 12.982 | 0.18 | 34 | 8.283 | 0.07 | 10 |
| LAB747 | 76799.1 | — | — | — | — | — | — | 8.018 | 0.09 | 7 |
| CONT. | — | 0.553 | — | — | 9.654 | — | — | 7.502 | — | — |
| LAB620 | — | — | — | — | — | — | — | 4.328 | 0.15 | 15 |
| CONT. | — | — | — | — | — | — | — | 3.768 | — | — |

Table 171. "CONT."—Control; "Ave."—Average; "% Incr." = % increment; "p-val."—p-value, L—p < 0.01.

TABLE 172

Genes showing improved plant performance at Normal growth conditions under regulation of At6669 promoter (T1 generation)

| | Roots Coverage [cm$^2$] | | |
|---|---|---|---|
| Gene Name | Ave. | P-Val. | % Incr. |
| LAB845 | 9.6 | 0.08 | 15 |
| LAB702 | 9.4 | 0.19 | 13 |
| LAB645 | 9.6 | 0.21 | 15 |
| CONT. | 8.3 | — | — |

Table 172. "CONT."—Control; "Ave."—Average; "% Incr." = % increment; "p-val."—p-value, L- p < 0.01.

The genes listed in Tables 173-174 improved plant growth rate (leaf area, root length and root coverage growth rate) when grown at standard growth conditions. These produced plants that grew faster than control plants when grown under standard growth conditions. Plants showing fast growth rate show a better plant establishment in soil. Faster growth was observed when growth rate of leaf area and root length and coverage was measured. Plants were evaluated in T2 generation (Table 173) or T1 generation (Table 174). The genes were cloned under the regulation of a constitutive promoter (At6669; SEQ ID NO:10446). Evaluation of each gene was performed by testing the performance of different number of events. Some of the genes were evaluated in more than one seedling analysis resulting in positive results as well.

TABLE 173

Genes showing improved plant performance at Normal growth conditions under regulation of At 6669 promoter (T2 generation)

| Gene Name | Event # | RGR Of Leaf Area (cm$^2$/day) | | | RGR Of Roots Coverage (cm$^2$/day) | | | RGR Of Root Length (cm/day) | | |
|---|---|---|---|---|---|---|---|---|---|---|
| | | Ave. | P-Val. | %Incr. | Ave. | P-Val. | % Incr. | Ave. | P-Val. | % Incr. |
| LAB849 | 75686.2 | — | — | — | 1.300 | 0.03 | 48 | 0.706 | 0.11 | 17 |
| LAB849 | 75706.2 | — | — | — | 1.374 | 0.04 | 57 | 0.687 | 0.16 | 14 |
| LAB813 | 76243.3 | — | — | — | 1.159 | 0.06 | 32 | — | — | — |
| LAB773 | 78332.2 | — | — | — | 1.130 | 0.13 | 29 | — | — | — |
| LAB691 | 74780.3 | — | — | — | 1.089 | 0.20 | 24 | — | — | — |
| LAB669_H7 | 77878.9 | — | — | — | 1.161 | 0.19 | 33 | 0.725 | 0.13 | 21 |
| CONT. | | — | — | — | 0.875 | — | — | 0.601 | — | — |
| LAB817 | 75756.5 | 0.059 | 0.21 | 31 | 1.074 | 0.11 | 35 | — | — | — |
| LAB810 | 76287.1 | — | — | — | 1.020 | 0.20 | 29 | — | — | — |
| LAB799 | 77468.3 | 0.062 | 0.14 | 38 | 1.170 | 0.05 | 48 | 0.686 | 0.30 | 11 |
| LAB738 | 75163.4 | 0.078 | 0.03 | 74 | 1.373 | 0.03 | 73 | — | — | — |
| LAB701 | 75123.4 | — | — | — | 1.133 | 0.14 | 43 | — | — | — |
| CONT. | | 0.045 | — | — | 0.793 | — | — | 0.616 | — | — |
| LAB783 | 75976.2 | 0.051 | 0.14 | 35 | — | — | — | — | — | — |
| LAB749 | 77757.4 | — | — | — | — | — | — | 0.612 | 0.21 | 11 |
| LAB749 | 77758.1 | — | — | — | 0.803 | 0.25 | 20 | 0.633 | 0.23 | 15 |
| LAB749 | 77759.4 | 0.050 | 0.28 | 32 | 0.970 | 0.02 | 44 | — | — | — |
| LAB682 | 77859.1 | 0.062 | 0.01 | 64 | 0.897 | 0.12 | 34 | 0.678 | 0.15 | 23 |
| LAB682 | 77859.4 | — | — | — | — | — | — | 0.618 | 0.11 | 12 |
| CONT. | | 0.038 | — | — | 0.671 | — | — | 0.550 | — | — |
| LAB842 | 76350.2 | — | — | — | — | — | — | 0.551 | L | 23 |
| LAB842 | 76350.3 | — | — | — | 0.724 | 0.10 | 45 | — | — | — |
| LAB841 | 76804.2 | — | — | — | 0.739 | 0.10 | 48 | 0.552 | 0.09 | 23 |
| LAB827 | 76794.3 | — | — | — | — | — | — | 0.512 | 0.19 | 15 |
| LAB823 | 77027.1 | 0.052 | 0.06 | 36 | 0.650 | 0.18 | 30 | — | — | — |
| LAB823 | 77028.2 | — | — | — | — | — | — | 0.583 | 0.01 | 31 |
| LAB816 | 76717.2 | — | — | — | — | — | — | 0.519 | 0.13 | 16 |
| LAB782 | 76850.4 | 0.051 | 0.10 | 32 | 0.769 | 0.14 | 54 | 0.599 | L | 34 |
| LAB753 | 76440.2 | — | — | — | — | — | — | 0.504 | 0.28 | 13 |
| LAB742 | 76434.2 | — | — | — | 0.767 | 0.27 | 53 | — | — | — |
| LAB717 | 76428.1 | — | — | — | 0.674 | 0.14 | 35 | 0.567 | L | 27 |
| LAB717 | 76428.4 | — | — | — | 0.717 | 0.20 | 43 | 0.558 | 0.02 | 25 |
| LAB717 | 76430.1 | 0.046 | 0.25 | 20 | — | — | — | — | — | — |
| LAB703 | 76422.2 | 0.049 | 0.15 | 28 | 0.632 | 0.26 | 26 | 0.553 | 0.03 | 24 |
| LAB671 | 76411.5 | — | — | — | — | — | — | 0.542 | 0.05 | 21 |
| LAB671 | 76411.6 | — | — | — | — | — | — | 0.567 | 0.03 | 27 |
| LAB667 | 76097.3 | — | — | — | — | — | — | 0.534 | 0.18 | 20 |
| LAB629 | 76896.2 | 0.045 | 0.21 | 19 | — | — | — | — | — | — |
| LAB629 | 76899.2 | — | — | — | — | — | — | 0.511 | 0.13 | 14 |
| CONT. | | 0.038 | — | — | 0.501 | — | — | 0.447 | — | — |
| LAB832 | 77332.1 | 0.056 | L | 43 | 1.037 | L | 88 | 0.672 | 0.04 | 29 |
| LAB832 | 77332.4 | 0.059 | L | 50 | 0.935 | L | 69 | — | — | — |
| LAB832 | 77333.7 | 0.049 | 0.06 | 24 | 0.864 | L | 56 | 0.634 | 0.08 | 22 |
| LAB770 | 77762.1 | 0.054 | L | 39 | 0.789 | L | 43 | 0.639 | 0.05 | 22 |
| LAB770 | 77763.1 | — | — | — | 0.678 | 0.12 | 23 | 0.604 | 0.12 | 16 |
| LAB770 | 77763.2 | 0.051 | 0.04 | 32 | — | — | — | — | — | — |
| LAB770 | 77765.2 | 0.045 | 0.21 | 16 | — | — | — | — | — | — |
| LAB755 | 75171.1 | — | — | — | 0.802 | L | 45 | 0.668 | 0.02 | 28 |
| LAB755 | 75172.7 | 0.056 | L | 43 | 0.797 | L | 44 | 0.608 | 0.16 | 17 |
| LAB755 | 75175.1 | 0.046 | 0.24 | 17 | — | — | — | — | — | — |
| LAB722 | 76465.2 | 0.050 | 0.08 | 27 | — | — | — | — | — | — |
| LAB678 | 77821.4 | 0.045 | 0.21 | 16 | 0.681 | 0.12 | 23 | — | — | — |
| LAB678 | 77823.3 | 0.058 | L | 48 | 0.837 | L | 52 | 0.649 | 0.09 | 24 |

TABLE 173-continued

Genes showing improved plant performance at Normal growth conditions under regulation of At 6669 promoter (T2 generation)

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | %Incr. | Ave. | P-Val. | % Incr. | Ave. | P-Val. | % Incr. |
| LAB660 | 75841.3 | 0.048 | 0.15 | 24 | 0.768 | 0.04 | 39 | — | — | — |
| LAB660 | 75841.5 | — | — | — | 0.663 | 0.27 | 20 | — | — | — |
| LAB653 | 75116.3 | 0.049 | 0.05 | 26 | 0.717 | 0.06 | 30 | — | — | — |
| LAB630 | 77786.2 | 0.055 | L | 40 | 0.878 | L | 59 | 0.652 | 0.08 | 25 |
| CONT. | — | 0.039 | — | — | 0.552 | — | — | 0.522 | — | — |
| LAB834 | 75891.1 | 0.064 | L | 32 | 1.140 | 0.02 | 33 | — | — | — |
| LAB834 | 75892.5 | 0.069 | L | 41 | 1.289 | L | 50 | 0.678 | 0.26 | 10 |
| LAB834 | 75893.1 | — | — | — | 1.035 | 0.15 | 21 | 0.705 | 0.12 | 14 |
| LAB834 | 75895.1 | 0.058 | 0.25 | 20 | — | — | — | — | — | — |
| LAB834 | 75895.4 | — | — | — | — | — | — | 0.708 | 0.10 | 15 |
| LAB807 | 76236.3 | 0.059 | 0.12 | 20 | 1.117 | 0.04 | 30 | — | — | — |
| LAB807 | 76237.1 | 0.091 | L | 87 | 1.435 | L | 67 | 0.680 | 0.25 | 10 |
| LAB807 | 76239.1 | — | — | — | — | — | — | 0.685 | 0.19 | 11 |
| LAB726 | 76381.1 | 0.074 | L | 52 | 1.215 | 0.01 | 42 | — | — | — |
| LAB726 | 76382.1 | 0.079 | L | 61 | 1.287 | 0.08 | 50 | — | — | — |
| LAB726 | 76385.1 | 0.058 | 0.09 | 19 | 1.033 | 0.16 | 21 | — | — | — |
| LAB687 | 75043.1 | — | — | — | 1.010 | 0.20 | 18 | — | — | — |
| LAB687 | 75045.2 | 0.068 | 0.02 | 39 | — | — | — | — | — | — |
| LAB687 | 75046.1 | 0.064 | 0.02 | 31 | 1.069 | 0.18 | 25 | — | — | — |
| LAB687 | 75046.4 | 0.060 | 0.08 | 23 | 1.258 | L | 47 | 0.678 | 0.28 | 10 |
| LAB687 | 75047.2 | 0.061 | 0.03 | 25 | 1.057 | 0.17 | 23 | 0.683 | 0.28 | 11 |
| LAB673 | 76532.2 | 0.063 | 0.05 | 30 | 1.218 | 0.02 | 42 | 0.679 | 0.29 | 10 |
| LAB673 | 76533.1 | 0.066 | 0.03 | 35 | — | — | — | — | — | — |
| LAB673 | 76534.3 | 0.062 | 0.04 | 27 | 1.046 | 0.12 | 22 | — | — | — |
| LAB650 | 75836.2 | 0.063 | 0.02 | 30 | 1.162 | 0.03 | 36 | 0.696 | 0.19 | 13 |
| LAB650 | 75838.2 | 0.070 | L | 43 | 1.332 | L | 55 | 0.731 | 0.04 | 19 |
| LAB650 | 75839.2 | 0.060 | 0.05 | 22 | 1.025 | 0.18 | 20 | 0.698 | 0.17 | 13 |
| LAB626 | 74770.1 | 0.062 | 0.03 | 27 | 1.141 | 0.02 | 33 | — | — | — |
| LAB626 | 74771.2 | 0.062 | 0.03 | 28 | — | — | — | — | — | — |
| CONT. | — | 0.049 | — | — | 0.857 | — | — | 0.616 | — | — |
| LAB848 | 77339.2 | 0.052 | 0.27 | 32 | 0.725 | 0.25 | 34 | — | — | — |
| LAB728 | 75151.2 | 0.055 | 0.29 | 40 | 0.846 | 0.08 | 56 | — | — | — |
| CONT. | — | 0.039 | — | — | 0.541 | — | — | — | — | — |
| LAB813 | 76243.3 | — | — | — | 0.791 | 0.26 | 26 | 0.613 | 0.30 | 15 |
| LAB631 | 74855.3 | — | — | — | 0.875 | 0.11 | 40 | — | — | — |
| CONT. | — | — | — | — | 0.626 | — | — | 0.535 | — | — |
| LAB798 | 75616.2 | — | — | — | 0.719 | 0.21 | 24 | 0.573 | 0.27 | 13 |
| CONT. | — | — | — | — | 0.582 | — | — | 0.508 | — | — |
| LAB820 | 76121.2 | — | — | — | — | — | — | 0.670 | 0.16 | 24 |
| LAB820 | 76123.2 | — | — | — | 0.898 | 0.19 | 33 | 0.647 | 0.11 | 19 |
| LAB725 | 75857.2 | — | — | — | 1.027 | 0.18 | 52 | 0.678 | 0.11 | 25 |
| LAB725 | 75857.3 | — | — | — | 0.897 | 0.21 | 33 | 0.661 | 0.06 | 22 |
| LAB725 | 75858.3 | — | — | — | — | — | — | 0.623 | 0.21 | 15 |
| LAB657 | 75733.4 | 0.064 | 0.23 | 42 | 1.005 | 0.17 | 49 | — | — | — |
| LAB638 | 76092.1 | — | — | — | 1.049 | 0.09 | 55 | — | — | — |
| LAB634 | 76087.1 | — | — | — | — | — | — | 0.642 | 0.25 | 18 |
| CONT. | — | 0.045 | — | — | 0.676 | — | — | 0.542 | — | — |
| LAB763 | 76262.1 | 0.070 | 0.09 | 30 | 1.233 | 0.07 | 39 | 0.606 | 0.24 | 14 |
| LAB763 | 76264.3 | — | — | — | — | — | — | 0.612 | 0.06 | 15 |
| LAB721 | 76102.3 | 0.060 | 0.29 | 12 | 1.180 | 0.03 | 33 | 0.721 | L | 35 |
| LAB696 | 75850.2 | 0.065 | 0.17 | 22 | — | — | — | 0.665 | 0.06 | 25 |
| LAB654 | 76745.2 | 0.075 | 0.06 | 40 | 1.154 | 0.10 | 30 | 0.630 | 0.07 | 18 |
| LAB651 | 76739.3 | 0.069 | 0.11 | 28 | — | — | — | — | — | — |
| LAB635 | 76082.1 | — | — | — | — | — | — | 0.594 | 0.27 | 12 |
| CONT. | — | 0.054 | — | — | 0.887 | — | — | 0.532 | — | — |
| LAB803 | 76760.1 | 0.048 | L | 36 | 1.016 | L | 58 | — | — | — |
| LAB799 | 77466.1 | 0.047 | 0.09 | 31 | 0.797 | 0.15 | 24 | — | — | — |
| LAB799 | 77468.3 | — | — | — | 0.754 | 0.29 | 18 | — | — | — |
| LAB799 | 77470.3 | 0.057 | L | 58 | — | — | — | — | — | — |
| LAB779 | 77308.1 | 0.050 | L | 40 | 0.930 | 0.01 | 45 | — | — | — |
| LAB779 | 77309.3 | 0.052 | L | 46 | 1.059 | L | 65 | 0.712 | 0.05 | 18 |
| LAB779 | 77310.3 | 0.049 | L | 37 | 0.787 | 0.17 | 23 | — | — | — |
| LAB761 | 77291.1 | 0.058 | L | 64 | 1.170 | L | 82 | 0.736 | 0.09 | 22 |
| LAB761 | 77292.8 | 0.041 | 0.25 | 14 | — | — | — | — | — | — |
| LAB761 | 77295.2 | 0.050 | L | 40 | 0.918 | 0.02 | 43 | — | — | — |
| LAB731 | 77131.2 | 0.065 | L | 82 | 0.883 | 0.12 | 38 | — | — | — |
| LAB731 | 77133.5 | — | — | — | 0.851 | 0.08 | 33 | — | — | — |
| LAB731 | 77134.1 | 0.055 | L | 55 | 0.920 | 0.05 | 43 | — | — | — |
| LAB727 | 76386.1 | 0.047 | L | 31 | 0.885 | 0.04 | 38 | — | — | — |
| LAB727 | 76386.2 | — | — | — | 0.764 | 0.30 | 19 | — | — | — |
| LAB727 | 76386.4 | 0.054 | L | 52 | 1.164 | L | 81 | — | — | — |

TABLE 173-continued

Genes showing improved plant performance at Normal growth conditions under regulation of At 6669 promoter (T2 generation)

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | %Incr. | Ave. | P-Val. | % Incr. | Ave. | P-Val. | % Incr. |
| LAB727 | 76387.3 | 0.046 | L | 27 | — | — | — | — | — | — |
| LAB727 | 76389.2 | 0.051 | L | 42 | 0.783 | 0.19 | 22 | — | — | — |
| LAB617 | 76336.1 | 0.056 | L | 57 | 1.155 | L | 80 | — | — | — |
| LAB616 | 76732.4 | 0.052 | L | 46 | 0.972 | L | 52 | — | — | — |
| LAB616 | 76732.6 | 0.048 | 0.02 | 36 | 0.845 | 0.13 | 32 | — | — | — |
| LAB616 | 76732.8 | 0.047 | 0.02 | 30 | 0.889 | 0.04 | 39 | — | — | — |
| CONT. | — | 0.036 | — | — | 0.641 | — | — | 0.602 | — | — |
| LAB758 | 76490.4 | — | — | — | 1.533 | 0.12 | 33 | — | — | — |
| CONT. | — | — | — | — | 1.154 | — | — | — | — | — |

Table 173. "CONT."—Control; "Ave."—Average; "% Incr." = % increment; "p-val."—p-value, L—p < 0.01

TABLE 174

Genes showing improved plant performance at Normal growth conditions under regulation of At6669 promoter (T1 generation)

| | RGR Of Roots Coverage (cm²/day) | | |
|---|---|---|---|
| Gene Name | Ave. | P-Val. | % Incr. |
| LAB845 | 1.124 | 0.22 | 14 |
| LAB702 | 1.143 | 0.24 | 16 |
| LAB645 | 1.142 | 0.30 | 16 |
| CONT. | 0.988 | — | — |

Table 174. "CONT."—Control; "Ave."—Average; "% Incr." = % increment; "p-val."—p-value, L- p < 0.01.

The genes presented in Tables 175 showed a significant improvement in plant ABST. These genes produced larger plant biomass (plant fresh and dry weight) when grown under high salinity conditions (assay 4), compared to control plants. Larger plant biomass under this growth conditions indicates the high ability of the plant to better metabolize the nutrients present in the medium. Plants were evaluated in T2 generation (Table 175). The genes were cloned under the regulation of a constitutive promoter (At6669; SEQ ID NO:10446). The evaluation of each gene was performed by testing the performance of different number of events. Some of the genes were evaluated in more than one seedling analysis resulting in positive results as well.

TABLE 175

Genes showing improved plant performance at High Salinity growth conditions under regulation of At6669 promoter (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB843 | 77710.5 | 4.7 | 0.24 | 18 | — | — | — |
| LAB783 | 75977.3 | — | — | — | 102.3 | 0.28 | 13 |
| LAB767 | 77704.2 | 4.9 | 0.26 | 23 | 128.9 | 0.07 | 42 |
| LAB749 | 77759.4 | 5.1 | 0.04 | 27 | 120.0 | 0.03 | 32 |
| LAB682 | 77856.4 | 5.0 | 0.18 | 24 | 149.7 | 0.02 | 65 |
| LAB682 | 77859.1 | 6.0 | L | 50 | 121.0 | 0.03 | 34 |
| LAB627 | 77694.1 | — | — | — | 110.5 | 0.10 | 22 |
| LAB627 | 77695.3 | — | — | — | 188.8 | L | 108 |
| CONT. | — | 4.0 | — | — | 90.6 | — | — |
| LAB832 | 77333.7 | 5.9 | 0.10 | 43 | 116.4 | 0.15 | 60 |
| LAB755 | 75171.2 | — | — | — | 128.1 | 0.07 | 76 |
| LAB660 | 75841.5 | 6.5 | 0.10 | 55 | 132.5 | 0.12 | 82 |
| LAB630 | 77787.1 | — | — | — | 100.6 | 0.27 | 38 |
| LAB630 | 77789.1 | 5.1 | 0.25 | 22 | 128.7 | 0.12 | 77 |
| CONT. | — | 4.2 | — | — | 72.7 | — | — |
| LAB814 | 76705.3 | 7.7 | 0.08 | 63 | 151.9 | 0.20 | 41 |
| LAB763 | 76262.1 | 6.8 | 0.14 | 44 | 144.1 | 0.26 | 34 |
| LAB763 | 76264.3 | 7.5 | 0.09 | 57 | — | — | — |
| CONT. | — | 4.7 | — | — | 107.5 | — | — |
| LAB836 | 75981.1 | — | — | — | 125.3 | 0.10 | 37 |
| LAB771 | 75873.2 | 5.5 | 0.26 | 36 | 142.2 | 0.09 | 55 |
| LAB661 | 75268.3 | — | — | — | 114.3 | 0.26 | 25 |
| CONT. | — | 4.0 | — | — | 91.6 | — | — |
| LAB831 | 76251.3 | — | — | — | 76.1 | 0.18 | 23 |
| LAB831 | 76255.1 | 10.4 | 0.13 | 247 | 180.4 | 0.19 | 193 |
| LAB809 | 75651.3 | 4.8 | 0.15 | 59 | 98.5 | 0.08 | 60 |
| LAB809 | 75652.3 | 6.0 | 0.03 | 99 | 114.7 | 0.02 | 86 |
| LAB798 | 75616.1 | — | — | — | 73.9 | 0.22 | 20 |
| LAB664 | 76224.4 | — | — | — | 104.2 | 0.07 | 69 |
| LAB664 | 76224.6 | — | — | — | 76.4 | 0.16 | 24 |
| LAB655 | 75119.5 | 3.9 | 0.27 | 31 | 87.4 | 0.06 | 42 |

TABLE 175-continued

Genes showing improved plant performance at High Salinity growth conditions under regulation of At6669 promoter (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB655 | 75120.1 | 4.8 | 0.24 | 60 | 100.3 | 0.2.3 | 63 |
| LAB655 | 75121.3 | 4.2 | 0.29 | 39 | 96.7 | 0.03 | 57 |
| LAB640 | 76266.4 | 4.9 | 0.23 | 62 | — | — | — |
| CONT. | — | 3.0 | — | — | 61.6 | — | — |
| LAB616 | 76732.8 | 5.1 | 0.30 | 57 | — | — | — |
| CONT. | — | 3.2 | — | — | — | — | — |

Table 175. "CONT."—Control; "Ave."—Average; "% Incr." = % increment; "p-val."—p-value; L—p < 0.01.

The genes presented in Table 176 showed a significant improvement in plant ABST. These genes produced larger leaf area and root biomass (leaf area, root length and root coverage) when grown under high salinity growth conditions (assay 4), compared to control plants. Plants producing larger root biomass have better possibilities to absorb larger amount of water from soil. Plants were evaluated in T2 generation (Table 176). The genes were cloned under the regulation of a constitutive promoter (At6669; SEQ ID NO:10446). The evaluation of each gene was performed by testing the performance of different number of events. Some of the genes were evaluated in more than one seedling analysis resulting in positive results as well.

TABLE 176

Genes showing improved plant performance at high salinity growth conditions under regulation of At6669 promoter (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB820 | 76121.3 | 0.320 | 0.09 | 22 | — | — | — | 4.845 | 0.10 | 9 |
| LAB725 | 75857.3 | 0.365 | 0.02 | 39 | — | — | — | 4.993 | 0.05 | 11 |
| LAB725 | 75860.2 | 0.324 | 0.13 | 24 | — | — | — | — | — | — |
| LAB657 | 75733.4 | 0.438 | L | 67 | — | — | — | 5.004 | 0.02 | 11 |
| LAB638 | 76092.2 | — | — | — | — | — | — | 4.999 | 0.10 | 11 |
| LAB634 | 76086.4 | 0.316 | 0.12 | 21 | — | — | — | — | — | — |
| LAB634 | 76087.1 | 0.386 | 0.07 | 47 | — | — | — | — | — | — |
| CONT. | — | 0.262 | — | — | — | — | — | 4.491 | — | — |
| LAB843 | 77707.2 | 0.445 | 0.09 | 46 | — | — | — | — | — | — |
| LAB843 | 77710.4 | 0.435 | 0.30 | 43 | 5.921 | 0.02 | 41 | — | — | — |
| LAB843 | 77710.5 | 0.386 | 0.13 | 27 | 5.934 | 0.17 | 42 | — | — | — |
| LAB805 | 76116.1 | 0.343 | 0.02 | 13 | — | — | — | — | — | — |
| LAB805 | 76117.4 | 0.421 | L | 39 | 5.366 | 0.06 | 28 | — | — | — |
| LAB805 | 76120.4 | 0.433 | 0.29 | 43 | — | — | — | — | — | — |
| LAB783 | 75976.2 | 0.418 | 0.05 | 38 | 6.673 | 0.03 | 59 | 5.145 | 0.04 | 13 |
| LAB783 | 75977.3 | 0.388 | 0.27 | 28 | — | — | — | — | — | — |
| LAB767 | 77704.2 | 0.476 | 0.03 | 57 | 6.389 | L | 52 | 5.581 | L | 22 |
| LAB749 | 77756.2 | 0.438 | L | 44 | 4.819 | 0.24 | 15 | — | — | — |
| LAB749 | 77757.4 | 0.495 | 0.03 | 63 | 6.199 | L | 48 | — | — | — |
| LAB749 | 77758.1 | 0.395 | 0.05 | 30 | 6.607 | 0.07 | 58 | 5.586 | 0.03 | 23 |
| LAB749 | 77759.4 | 0.523 | 0.12 | 72 | 8.949 | 0.02 | 113 | 6.170 | L | 35 |
| LAB682 | 77856.4 | 0.539 | L | 77 | 7.506 | 0.07 | 79 | 5.454 | 0.15 | 20 |
| LAB682 | 77859.1 | 0.509 | L | 68 | 7.564 | 0.02 | 80 | 5.366 | L | 18 |
| LAB627 | 77694.1 | 0.342 | 0.02 | 13 | 5.665 | 0.17 | 35 | — | — | — |
| LAB627 | 77695.3 | 0.654 | 0.08 | 115 | 9.146 | 0.08 | 118 | 5.501 | 0.15 | 21 |
| CONT. | — | 0.304 | — | — | 4.193 | — | — | 4.559 | — | — |
| LAB814 | 76705.3 | — | — | — | 8.392 | 0.28 | 42 | — | — | — |
| LAB763 | 76265.4 | — | — | — | — | — | — | 6.154 | 0.25 | 17 |
| CONT. | — | — | — | — | 5.927 | — | — | 5.255 | — | — |
| LAB832 | 77333.8 | — | — | — | 7.269 | 0.22 | 30 | 5.383 | 0.27 | 13 |
| LAB755 | 75171.2 | — | — | — | — | — | — | 5.131 | 0.14 | 8 |
| CONT. | — | — | — | — | 5.590 | — | — | 4.743 | — | — |
| LAB836 | 75981.1 | 0.521 | 0.02 | 32 | — | — | — | — | — | — |
| LAB813 | 76242.2 | — | — | — | — | — | — | 5.954 | 0.25 | 16 |
| LAB771 | 75873.2 | 0.462 | 0.07 | 17 | — | — | — | — | — | — |
| CONT. | — | 0.395 | — | — | — | — | — | 5.135 | — | — |
| LAB831 | 76255.1 | 0.489 | 0.15 | 72 | — | — | — | 5.393 | 0.28 | 20 |
| LAB809 | 75651.3 | — | — | — | 5.408 | 0.29 | 25 | 5.368 | 0.03 | 19 |
| LAB809 | 75652.3 | 0.387 | 0.04 | 36 | — | — | — | — | — | — |
| LAB664 | 76224.4 | 0.374 | 0.06 | 31 | — | — | — | — | — | — |
| LAB664 | 76224.6 | — | — | — | — | — | — | 4.940 | 0.18 | 10 |
| LAB655 | 75119.5 | 0.351 | 0.12 | 23 | — | — | — | — | — | — |
| LAB655 | 75120.1 | — | — | — | 5.988 | 0.23 | 39 | — | — | — |

TABLE 176-continued

Genes showing improved plant performance at high salinity growth conditions under regulation of At6669 promoter (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB640 | 76266.4 | 0.373 | 0.06 | 31 | — | — | — | 4.860 | 0.28 | 8 |
| CONT. | — | 0.285 | — | — | 4.310 | — | — | 4.504 | — | — |
| LAB616 | 76732.8 | 0.444 | 0.02 | 51 | — | — | — | — | — | — |
| CONT. | — | 0.294 | — | — | — | — | — | — | — | — |

Table 176. "CONT."—Control; "Ave."—Average; "% Incr." = % increment; "p-val."—p-value, L—p < 0.01.

The genes presented in Table 177 showed a significant improvement in plant ABST. These genes improved plant growth rate (leaf area, root length and root coverage growth rate) when grown under high salinity growth conditions (assay 4), compared to control plants. Plants showing fast growth rate show a better plant establishment in soil. Faster growth was observed when growth rate of leaf area and root length and coverage was measured. Plants were evaluated in T2 generation (Table 177). The genes were cloned under the regulation of a constitutive promoter (At6669; SEQ ID NO:10446). Evaluation of each gene was performed by testing the performance of different number of events. Some of the genes were evaluated in more than one seedling analysis resulting in positive results as well.

TABLE 177

Genes showing improved plant performance at high salinity conditions under regulation of At6669 promoter (T2 generation)

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB820 | 76121.2 | 0.028 | 0.15 | 71 | — | — | — | — | — | — |
| LAB820 | 76121.3 | 0.030 | 0.04 | 82 | — | — | — | 0.398 | L | 24 |
| LAB725 | 75857.2 | 0.023 | 0.24 | 41 | — | — | — | — | — | — |
| LAB725 | 75857.3 | 0.032 | L | 95 | — | — | — | 0.395 | 0.02 | 23 |
| LAB725 | 75860.2 | 0.029 | 0.03 | 81 | — | — | — | — | — | — |
| LAB657 | 75733.4 | 0.038 | L | 134 | — | — | — | 0.384 | L | 19 |
| LAB638 | 76092.2 | — | — | — | — | — | — | 0.393 | 0.02 | 22 |
| LAB634 | 76086.4 | 0.029 | 0.03 | 80 | — | — | — | — | — | — |
| LAB634 | 76087.1 | 0.036 | L | 121 | — | — | — | — | — | — |
| CONT. | — | 0.016 | — | — | — | — | — | 0.321 | — | — |
| LAB843 | 77707.2 | 0.041 | 0.02 | 51 | — | — | — | — | — | — |
| LAB843 | 77710.4 | 0.040 | 0.02 | 47 | 0.706 | 0.07 | 42 | — | — | — |
| LAB843 | 77710.5 | 0.033 | 0.18 | 22 | 0.704 | 0.07 | 41 | — | — | — |
| LAB805 | 76117.4 | 0.040 | L | 48 | 0.651 | 0.17 | 31 | — | — | — |
| LAB805 | 76120.4 | 0.039 | 0.03 | 45 | — | — | — | — | — | — |
| LAB783 | 75976.2 | 0.039 | L | 44 | 0.809 | L | 62 | 0.469 | 0.04 | 23 |
| LAB783 | 75977.3 | 0.035 | 0.12 | 31 | — | — | — | — | — | — |
| LAB767 | 77704.2 | 0.046 | L | 70 | 0.761 | L | 53 | 0.449 | 0.08 | 17 |
| LAB749 | 77756.2 | 0.039 | L | 45 | — | — | — | — | — | — |
| LAB749 | 77757.4 | 0.046 | L | 69 | 0.742 | 0.04 | 49 | 0.438 | 0.25 | 15 |
| LAB749 | 77758.1 | 0.036 | 0.03 | 32 | 0.790 | 0.01 | 59 | 0.468 | 0.04 | 22 |
| LAB749 | 77759.4 | 0.048 | L | 80 | 1.077 | L | 116 | 0.566 | L | 48 |
| LAB682 | 77856.4 | 0.050 | L | 87 | 0.894 | L | 79 | 0.486 | 0.08 | 27 |
| LAB682 | 77859.1 | 0.048 | L | 78 | 0.901 | L | 81 | 0.456 | 0.05 | 19 |
| LAB627 | 77694.1 | 0.032 | 0.19 | 19 | 0.669 | 0.14 | 34 | — | — | — |
| LAB627 | 77695.3 | 0.063 | L | 135 | 1.103 | L | 121 | 0.497 | 0.02 | 30 |
| CONT. | — | 0.027 | — | — | 0.498 | — | — | 0.383 | — | — |
| LAB814 | 76705.3 | — | — | — | 0.996 | 0.24 | 42 | 0.496 | 0.29 | 21 |
| LAB763 | 76265.4 | — | — | — | — | — | — | 0.513 | 0.12 | 25 |
| CONT. | — | — | — | — | 0.702 | — | — | 0.412 | — | — |
| LAB832 | 77333.8 | — | — | — | 0.876 | 0.21 | 29 | — | — | — |
| CONT. | — | — | — | — | 0.677 | — | — | — | — | — |
| LAB836 | 75981.1 | 0.050 | 0.05 | 32 | — | — | — | — | — | — |
| LAB771 | 75873.2 | 0.046 | 0.18 | 20 | — | — | — | — | — | — |
| CONT. | — | 0.038 | — | — | — | — | — | — | — | — |
| LAB831 | 76255.1 | 0.043 | 0.02 | 71 | 0.761 | 0.20 | 50 | 0.459 | 0.16 | 24 |
| LAB809 | 75651.3 | — | — | — | 0.639 | 0.20 | 26 | 0.430 | 0.21 | 16 |
| LAB809 | 75652.3 | 0.033 | 0.10 | 33 | — | — | — | — | — | — |
| LAB664 | 76224.4 | 0.034 | 0.07 | 35 | 0.725 | 0.22 | 42 | 0.475 | 0.13 | 28 |
| LAB655 | 75119.5 | 0.032 | 0.10 | 28 | — | — | — | — | — | — |
| LAB655 | 75120.1 | 0.042 | 0.17 | 68 | 0.719 | 0.17 | 41 | — | — | — |

TABLE 177-continued

Genes showing improved plant performance at high salinity conditions under regulation of At6669 promoter (T2 generation)

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB640 | 76266.4 | 0.032 | 0.16 | 27 | — | — | — | — | — | — |
| CONT. | — | 0.025 | — | — | 0.509 | — | — | 0.371 | — | — |
| LAB616 | 76732.8 | 0.043 | 0.01 | 72 | — | — | — | — | — | — |
| CONT. | — | 0.025 | — | — | — | — | — | — | — | — |

Table 177. "CONT."—Control; "Ave."—Average; "% Incr." = % increment; "p-val."—p-value, L—p < 0.01.

The genes presented in Tables 178-179 showed a significant improvement in plant NUE since they produced larger plant biomass (plant fresh and dry weight) in T2 generation (Table 178) or T1 generation (Table 179) when grown under limiting nitrogen growth conditions (assay 5), compared to control plants that were grown under identical growth conditions. Larger plant biomass under these growth conditions indicates the high ability of the plant to better metabolize the nutrients present in the medium. The genes were cloned under the regulation of a constitutive promoter (At6669; SEQ ID NO:10446). The evaluation of each gene was performed by testing the performance of different number of events. Some of the genes were evaluated in more than one seedling analysis resulting in positive results as well.

TABLE 178

Genes showing improved plant performance at Low Nitrogen growth conditions under regulation of At6669 promoter (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB849 | 75706.2 | 5.4 | 0.10 | 26 | 254.1 | 0.28 | 99 |
| LAB836 | 75984.4 | 5.5 | 0.10 | 30 | 280.6 | 0.26 | 120 |
| LAB773 | 78332.2 | 4.9 | 0.19 | 14 | 261.9 | 0.26 | 105 |
| LAB771 | 75873.4 | 5.6 | 0.08 | 32 | — | — | — |
| LAB771 | 75875.1 | — | — | — | 264.1 | 0.25 | 107 |
| LAB727 | 76386.1 | 5.6 | 0.06 | 31 | — | — | — |
| LAB727 | 76386.2 | 5.2 | 0.05 | 23 | — | — | — |
| LAB727 | 76387.1 | 5.6 | 0.06 | 33 | — | — | — |
| LAB702 | 78293.8 | 5.9 | 0.12 | 38 | — | — | — |
| LAB700 | 77192.2 | 6.4 | 0.07 | 50 | — | — | — |
| LAB691 | 74780.3 | 5.3 | 0.04 | 24 | — | — | — |
| LAB691 | 74782.3 | 5.9 | 0.03 | 38 | 273.4 | 0.23 | 114 |
| LAB688 | 75827.2 | 6.4 | L | 50 | — | — | — |
| LAB669_H7 | 77878.9 | 5.5 | 0.03 | 28 | — | — | — |
| LAB669_H7 | 77880.2 | 4.9 | 0.26 | 16 | — | — | — |
| LAB661 | 75272.1 | 5.6 | 0.04 | 31 | 297.9 | 0.16 | 133 |
| CONT. | — | 4.3 | — | — | 127.7 | — | — |
| LAB810 | 76287.1 | 6.0 | 0.27 | 23 | 97.2 | 0.06 | 27 |
| LAB799 | 77468.3 | — | — | — | 105.3 | 0.06 | 37 |
| LAB779 | 77306.4 | 7.7 | 0.26 | 60 | — | — | — |
| LAB779 | 77308.1 | — | — | — | 89.3 | 0.16 | 16 |
| LAB738 | 75163.4 | — | — | — | 92.5 | 0.24 | 21 |
| LAB731 | 77131.2 | — | — | — | 90.2 | 0.12 | 18 |
| LAB721 | 76102.3 | — | — | — | 89.3 | 0.09 | 16 |
| LAB641 | 77225.2 | 6.9 | 0.12 | 44 | 108.0 | 0.11 | 41 |
| LAB635 | 76084.5 | — | — | — | 113.1 | 0.18 | 47 |
| LAB631 | 74856.6 | — | — | — | 111.4 | 0.10 | 45 |
| CONT. | — | 4.8 | — | — | 76.7 | — | — |
| LAB844 | 76787.4 | 5.3 | L | 95 | 77.2 | L | 48 |
| LAB844 | 76789.3 | 4.4 | 0.01 | 61 | 68.7 | 0.05 | 31 |
| LAB842 | 76348.1 | 5.2 | L | 89 | 97.8 | L | 87 |
| LAB842 | 76350.2 | — | — | — | 58.8 | 0.17 | 12 |
| LAB842 | 76350.3 | 3.4 | 0.01 | 24 | 62.3 | 0.15 | 19 |
| LAB841 | 76804.2 | 4.3 | 0.02 | 58 | 73.4 | 0.09 | 40 |
| LAB841 | 76804.6 | 3.4 | 0.01 | 25 | — | — | — |
| LAB829 | 76441.5 | 3.7 | 0.29 | 35 | 71.1 | 0.19 | 36 |
| LAB829 | 76442.2 | 3.0 | 0.23 | 11 | — | — | — |
| LAB829 | 76443.1 | 3.1 | 0.19 | 14 | 60.7 | 0.14 | 16 |
| LAB827 | 76791.2 | 6.0 | L | 118 | 88.6 | L | 69 |
| LAB827 | 76794.3 | 3.4 | 0.08 | 26 | 70.0 | 0.06 | 34 |
| LAB823 | 77027.1 | 5.1 | 0.04 | 87 | 78.6 | 0.09 | 50 |
| LAB823 | 77028.2 | 3.4 | 0.16 | 27 | 67.9 | 0.02 | 30 |
| LAB816 | 76718.3 | 3.4 | 0.08 | 25 | 62.1 | 0.04 | 19 |
| LAB816 | 76719.1 | 5.5 | L | 100 | 79.8 | L | 52 |

TABLE 178-continued

Genes showing improved plant performance at Low Nitrogen growth conditions under regulation of At6669 promoter (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB782 | 76847.1 | 3.9 | 0.02 | 43 | 63.1 | 0.12 | 21 |
| LAB782 | 76848.6 | 5.9 | L | 115 | 91.4 | L | 75 |
| LAB782 | 76850.4 | 4.7 | 0.10 | 72 | 81.6 | 0.04 | 56 |
| LAB753 | 76438.4 | 3.9 | 0.01 | 43 | 74.3 | 0.11 | 42 |
| LAB753 | 76439.3 | 4.1 | L | 51 | 66.3 | 0.02 | 27 |
| LAB751 | 76930.2 | 4.0 | L | 48 | 69.6 | L | 33 |
| LAB742 | 76432.1 | 3.4 | 0.16 | 24 | 68.3 | 0.04 | 31 |
| LAB742 | 76434.2 | 3.1 | 0.08 | 14 | — | — | — |
| LAB742 | 76434.3 | 3.4 | L | 23 | 62.1 | 0.22 | 19 |
| LAB717 | 76428.1 | 3.2 | 0.06 | 17 | — | — | — |
| LAB717 | 76428.4 | 3.1 | 0.24 | 16 | — | — | — |
| LAB717 | 76430.1 | 3.4 | 0.05 | 25 | — | — | — |
| LAB703 | 76422.2 | 3.6 | L | 30 | 71.9 | L | 37 |
| LAB703 | 76422.4 | 4.6 | 0.09 | 70 | 75.3 | 0.12 | 44 |
| LAB703 | 76425.1 | 3.8 | L | 38 | 68.5 | 0.02 | 31 |
| LAB671 | 76411.1 | 4.3 | 0.02 | 57 | 83.1 | 0.02 | 59 |
| LAB671 | 76411.5 | 4.3 | L | 57 | 72.3 | 0.07 | 38 |
| LAB667 | 76096.1 | 3.8 | 0.02 | 38 | 65.6 | 0.11 | 25 |
| LAB629 | 76899.1 | 3.3 | 0.12 | 21 | 66.0 | 0.07 | 26 |
| LAB629 | 76899.2 | 3.4 | 0.13 | 26 | 65.2 | 0.13 | 25 |
| CONT. | — | 2.7 | — | — | 52.3 | — | — |
| LAB820 | 76121.1 | 6.1 | 0.08 | 34 | 183.4 | 0.13 | 101 |
| LAB820 | 76121.2 | 5.5 | 0.19 | 22 | 105.0 | 0.20 | 15 |
| LAB820 | 76122.2 | 6.1 | 0.06 | 35 | 138.6 | 0.11 | 52 |
| LAB781 | 75334.1 | 5.3 | 0.25 | 18 | 109.5 | 0.13 | 20 |
| LAB750 | 75447.2 | 5.6 | 0.20 | 24 | — | — | — |
| LAB750 | 75448.1 | — | — | — | 144.6 | 0.25 | 58 |
| LAB725 | 75857.1 | — | — | — | 117.7 | 0.17 | 29 |
| LAB657 | 75732.2 | 5.6 | 0.09 | 23 | 181.5 | 0.17 | 99 |
| LAB657 | 75732.5 | — | — | — | 126.2 | L | 38 |
| LAB638 | 76092.1 | 6.7 | L | 48 | 116.2 | 0.06 | 27 |
| CONT. | — | 4.5 | — | — | 91.2 | — | — |
| LAB834 | 75891.1 | — | — | — | 168.6 | 0.28 | 53 |
| LAB834 | 75892.5 | 5.8 | 0.02 | 29 | — | — | — |
| LAB834 | 75895.4 | 5.6 | 0.04 | 27 | — | — | — |
| LAB807 | 76236.3 | 5.3 | 0.13 | 20 | — | — | — |
| LAB807 | 76237.1 | 6.9 | 0.03 | 56 | 153.5 | 0.25 | 39 |
| LAB807 | 76239.1 | — | — | — | 159.2 | 0.27 | 45 |
| LAB726 | 76381.1 | 6.3 | 0.04 | 43 | — | — | — |
| LAB726 | 76382.1 | 6.1 | 0.05 | 38 | — | — | — |
| LAB696 | 75850.4 | 6.5 | 0.06 | 46 | 147.6 | 0.20 | 34 |
| LAB687 | 75046.1 | — | — | — | 159.7 | 0.02 | 45 |
| LAB687 | 75046.4 | 6.6 | L | 48 | 150.3 | 0.06 | 36 |
| LAB650 | 75836.2 | 6.0 | 0.03 | 35 | — | — | — |
| LAB650 | 75838.2 | 5.9 | 0.10 | 32 | — | — | — |
| LAB650 | 75839.2 | — | — | — | 153.8 | 0.11 | 40 |
| LAB626 | 74770.1 | 6.2 | 0.02 | 39 | — | — | — |
| LAB626 | 74771.2 | 6.6 | L | 49 | — | — | — |
| CONT. | — | 4.5 | — | — | 110.1 | — | — |
| LAB848 | 77339.2 | 5.2 | 0.10 | 33 | 88.0 | 0.07 | 22 |
| LAB848 | 77339.4 | 5.0 | 0.08 | 27 | 80.4 | 0.30 | 11 |
| LAB811 | 76345.4 | 4.5 | 0.09 | 17 | 91.2 | 0.04 | 26 |
| LAB811 | 78053.6 | — | — | — | 87.4 | 0.26 | 21 |
| LAB785 | 77997.3 | 4.5 | 0.09 | 16 | — | — | — |
| LAB785 | 77998.1 | 4.8 | 0.06 | 24 | — | — | — |
| LAB728 | 75150.2 | 4.5 | 0.23 | 15 | 84.8 | 0.18 | 17 |
| LAB728 | 75151.2 | — | — | — | 90.8 | 0.10 | 26 |
| LAB692 | 76418.1 | — | — | — | 82.4 | 0.21 | 14 |
| LAB692 | 76418.4 | — | — | — | 88.8 | 0.05 | 23 |
| LAB692 | 78068.2 | 4.9 | 0.01 | 25 | 81.0 | 0.25 | 12 |
| LAB692 | 78069.7 | — | — | — | 86.0 | 0.27 | 19 |
| LAB672 | 77698.1 | 5.0 | 0.01 | 29 | 81.9 | 0.25 | 13 |
| LAB672 | 77698.3 | 5.0 | 0.04 | 29 | 89.0 | 0.05 | 23 |
| LAB672 | 77699.1 | — | — | — | 85.1 | 0.21 | 18 |
| LAB672 | 77699.2 | 4.8 | 0.04 | 23 | 94.5 | 0.03 | 31 |
| LAB672 | 77700.1 | 5.0 | L | 28 | 88.5 | 0.07 | 23 |
| LAB662 | 77296.3 | 5.2 | 0.02 | 32 | 94.4 | 0.07 | 31 |
| LAB662 | 77299.2 | 5.0 | 0.03 | 29 | 81.8 | 0.25 | 13 |
| LAB633 | 74828.2 | 5.5 | 0.02 | 40 | 91.1 | 0.12 | 26 |
| LAB633 | 74828.4 | 4.4 | 0.24 | 12 | 95.9 | 0.03 | 33 |
| CONT. | — | 3.9 | — | — | 72.2 | — | — |
| LAB850 | 77714.2 | 5.3 | 0.17 | 18 | — | — | — |
| LAB850 | 77714.3 | 5.3 | 0.28 | 18 | 131.5 | 0.09 | 45 |

TABLE 178-continued

Genes showing improved plant performance at Low Nitrogen growth conditions under regulation of At6669 promoter (T2 generation)

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LAB825 | 76392.1 | 5.7 | 0.08 | 26 | — | — | — |
| LAB793 | 75755.1 | — | — | — | 129.5 | 0.25 | 43 |
| LAB765 | 76114.3 | 5.6 | 0.06 | 24 | 115.8 | 0.14 | 28 |
| LAB760 | 75863.1 | 5.5 | 0.19 | 23 | 116.5 | 0.10 | 29 |
| LAB760 | 75865.3 | — | — | — | 116.8 | 0.15 | 29 |
| LAB758 | 76490.4 | 5.6 | 0.07 | 25 | 146.1 | 0.08 | 62 |
| LAB747 | 76796.1 | 5.3 | 0.28 | 17 | — | — | — |
| LAB735 | 77323.1 | 6.5 | 0.02 | 45 | — | — | — |
| LAB735 | 77325.5 | — | — | — | 147.8 | 0.07 | 63 |
| LAB723 | 77282.2 | 5.8 | 0.17 | 29 | 137.1 | 0.29 | 52 |
| LAB723 | 77282.3 | 5.2 | 0.15 | 17 | — | — | — |
| LAB711 | 77076.1 | — | — | — | 125.0 | 0.25 | 38 |
| LAB711 | 77079.4 | 6.0 | 0.11 | 35 | — | — | — |
| LAB710 | 76365.1 | 6.3 | 0.05 | 42 | 129.1 | 0.08 | 43 |
| LAB698 | 76202.2 | — | — | — | 117.0 | 0.23 | 29 |
| LAB698 | 76204.1 | 5.2 | 0.16 | 15 | — | — | — |
| LAB625 | 76472.1 | 5.2 | 0.22 | 15 | — | — | — |
| CONT. | — | 4.5 | — | — | 90.4 | — | — |
| LAB849 | 75706.2 | — | — | — | 77.1 | 0.25 | 16 |
| LAB817 | 75758.1 | 5.5 | 0.29 | 22 | 83.3 | 0.14 | 25 |
| LAB799 | 77468.1 | — | — | — | 85.3 | 0.22 | 28 |
| LAB799 | 77470.3 | — | — | — | 81.4 | 0.23 | 22 |
| LAB714 | 75137.2 | 5.5 | 0.13 | 21 | 75.3 | 0.15 | 13 |
| LAB709 | 75427.8 | 5.2 | 0.26 | 13 | 84.2 | 0.05 | 27 |
| LAB701 | 75123.4 | 5.5 | 0.26 | 20 | 87.8 | 0.02 | 32 |
| LAB701 | 75124.1 | 5.8 | 0.19 | 28 | 81.7 | 0.04 | 23 |
| LAB684 | 75278.4 | — | — | — | 75.0 | 0.24 | 13 |
| LAB661 | 75272.1 | 5.5 | 0.28 | 21 | 78.0 | 0.24 | 17 |
| LAB654 | 76742.3 | 5.2 | 0.23 | 15 | 89.6 | 0.05 | 35 |
| LAB654 | 76745.1 | 5.8 | 0.21 | 27 | 73.0 | 0.28 | 10 |
| LAB651 | 76738.2 | — | — | — | 76.1 | 0.19 | 14 |
| LAB628 | 75499.1 | — | — | — | 83.1 | 0.05 | 25 |
| CONT. | — | 4.5 | — | — | 66.5 | — | — |

Table 178. "CONT."—Control; "Ave."—Average; "% Incr." = % increment; "p-val."—p-value, L—p < 0.01.

TABLE 179

Genes showing improved plant performance at Low Nitrogen growth conditions under regulation of At6669 promoter (T1 generation)

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LAB702 | 8.2 | 0.24 | 14 | 195.4 | 0.11 | 29 |
| LAB647 | 7.9 | 0.21 | 10 | — | — | — |
| LAB645 | 8.5 | 0.02 | 18 | 199.3 | 0.22 | 31 |
| CONT. | 7.2 | — | — | 151.8 | — | — |
| LAB821 | 7.5 | 0.15 | 22 | 149.2 | 0.04 | 39 |
| CONT. | 6.1 | — | — | 107.5 | — | — |

Table 179. "CONT."—Control; "Ave."—Average; "% Incr." = % increment; "p-val."—p-value, L—p < 0.01.

The genes presented in Tables 180-181 showed a significant improvement in plant NUE since they improved leaf and root performance when grown at low nitrogen conditions (assay 5). These genes produced larger leaf area and root biomass (leaf area, root length and root coverage) when grown under low nitrogen growth conditions, compared to control plants. Plants producing larger root biomass have better possibilities to absorb larger amount of water and nitrogen from soil. Plants producing larger leafs have better ability to produce assimilates. Plants were evaluated in T2 generation (Table 180) or T1 generation (Table 181). The genes were cloned under the regulation of a constitutive promoter (At6669; SEQ ID NO:10446). The evaluation of each gene was performed by testing the performance of different number of events. Some of the genes were evaluated in more than one seedling analysis resulting in positive results as well.

TABLE 180

Genes showing improved plant performance at Low Nitrogen growth conditions under regulation of At6669 promoter (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB817 | 75756.5 | — | — | — | 13.489 | 0.26 | 23 | 7.380 | 0.06 | 15 |
| LAB817 | 75758.1 | — | — | — | 13.205 | 0.29 | 20 | 7.154 | 0.19 | 12 |
| LAB810 | 76287.1 | 0.471 | 0.28 | 11 | — | — | — | 7.053 | 0.26 | 10 |
| LAB803 | 76760.1 | 0.485 | 0.24 | 14 | 16.859 | 0.20 | 54 | 7.234 | 0.14 | 13 |
| LAB799 | 77468.3 | — | — | — | 15.018 | 0.11 | 37 | 7.206 | 0.14 | 12 |
| LAB779 | 77306.4 | — | — | — | 13.031 | 0.30 | 19 | — | — | — |
| LAB779 | 77309.3 | — | — | — | 15.635 | 0.08 | 42 | — | — | — |
| LAB738 | 75163.4 | 0.483 | 0.26 | 13 | — | — | — | 7.241 | 0.13 | 13 |
| LAB721 | 76102.3 | 0.503 | 0.09 | 18 | 14.133 | 0.14 | 29 | 6.973 | 0.23 | 9 |
| LAB641 | 77225.2 | 0.490 | 0.25 | 15 | — | — | — | — | — | — |
| LAB631 | 74856.6 | — | — | — | 14.689 | 0.23 | 34 | 7.042 | 0.21 | 10 |
| LAB617 | 76336.1 | — | — | — | — | — | — | 7.254 | 0.09 | 13 |
| CONT. | — | 0.426 | — | — | 10.973 | — | — | 6.408 | — | — |
| LAB849 | 75706.2 | — | — | — | 14.097 | 0.03 | 23 | — | — | — |
| LAB836 | 75984.4 | — | — | — | 13.140 | 0.14 | 14 | — | — | — |
| LAB813 | 76243.3 | — | — | — | 12.626 | 0.21 | 10 | — | — | — |
| LAB773 | 78332.2 | — | — | — | 13.788 | 0.13 | 20 | 7.493 | 0.14 | 5 |
| LAB771 | 75873.2 | — | — | — | 12.865 | 0.13 | 12 | — | — | — |
| LAB771 | 75873.4 | — | — | — | 13.329 | 0.24 | 16 | — | — | — |
| LAB771 | 75875.1 | 0.521 | 0.27 | 6 | — | — | — | — | — | — |
| LAB727 | 76386.1 | 0.569 | 0.03 | 16 | 14.528 | 0.02 | 26 | 7.764 | L | 8 |
| LAB727 | 76386.2 | — | — | — | 14.075 | 0.17 | 22 | — | — | — |
| LAB727 | 76387.1 | — | — | — | 14.026 | L | 22 | — | — | — |
| LAB702 | 78293.8 | 0.598 | 0.14 | 22 | 14.508 | 0.19 | 26 | 7.579 | 0.19 | 6 |
| LAB700 | 77192.2 | 0.551 | 0.04 | 13 | 16.202 | 0.10 | 41 | — | — | — |
| LAB700 | 77195.3 | — | — | — | 13.565 | 0.05 | 18 | — | — | — |
| LAB691 | 74782.3 | 0.540 | 0.11 | 10 | 13.916 | 0.15 | 21 | — | — | — |
| LAB688 | 75827.2 | — | — | — | 14.166 | 0.10 | 23 | — | — | — |
| LAB669_H7 | 77878.2 | — | — | — | 13.005 | 0.19 | 13 | — | — | — |
| LAB669_H7 | 77878.9 | 0.536 | 0.16 | 10 | 14.635 | 0.05 | 27 | 7.643 | 0.18 | 7 |
| LAB669_H7 | 77880.2 | 0.549 | 0.27 | 12 | 13.612 | 0.30 | 18 | — | — | — |
| LAB628 | 75496.5 | — | — | — | 13.368 | 0.29 | 16 | — | — | — |
| CONT. | — | 0.490 | — | — | 11.493 | — | — | 7.163 | — | — |
| LAB844 | 76787.4 | 0.471 | L | 47 | 9.195 | 0.16 | 47 | — | — | — |
| LAB844 | 76789.3 | 0.389 | 0.03 | 21 | 8.157 | 0.25 | 31 | — | — | — |
| LAB842 | 76348.1 | 0.510 | L | 59 | 11.503 | L | 84 | 7.463 | L | 24 |
| LAB842 | 76350.2 | 0.346 | 0.21 | 8 | — | — | — | 6.702 | 0.08 | 12 |
| LAB842 | 76350.3 | 0.380 | 0.02 | 19 | 7.319 | 0.28 | 17 | — | — | — |
| LAB841 | 76804.2 | 0.436 | 0.01 | 36 | 8.628 | 0.08 | 38 | 6.464 | 0.18 | 8 |
| LAB841 | 76804.6 | 0.386 | L | 20 | 7.227 | 0.05 | 16 | 6.509 | 0.06 | 8 |
| LAB829 | 76441.5 | 0.420 | 0.17 | 31 | 9.470 | 0.08 | 52 | 7.050 | 0.02 | 18 |
| LAB829 | 76442.2 | 0.376 | L | 17 | 7.832 | L | 25 | 6.732 | L | 12 |
| LAB829 | 76443.1 | 0.357 | 0.07 | 11 | 7.775 | 0.04 | 24 | — | — | — |
| LAB827 | 76791.2 | 0.430 | 0.22 | 34 | 13.957 | L | 123 | 7.432 | L | 24 |
| LAB827 | 76794.3 | 0.399 | 0.02 | 24 | 7.698 | 0.06 | 23 | 6.475 | 0.12 | 8 |
| LAB823 | 77026.4 | 0.390 | 0.26 | 22 | — | — | — | — | — | — |
| LAB823 | 77027.1 | 0.453 | L | 41 | 10.460 | 0.04 | 68 | 6.665 | 0.06 | 11 |
| LAB823 | 77028.2 | 0.403 | 0.03 | 26 | 8.458 | 0.02 | 35 | 7.315 | L | 22 |
| LAB816 | 76717.2 | 0.384 | 0.09 | 20 | 8.092 | 0.13 | 30 | 6.747 | 0.06 | 12 |
| LAB816 | 76718.3 | 0.350 | 0.13 | 9 | 9.385 | L | 50 | 6.638 | 0.02 | 11 |
| LAB816 | 76719.1 | — | — | — | 12.716 | 0.01 | 104 | 7.175 | L | 20 |
| LAB782 | 76848.6 | 0.478 | L | 49 | 12.055 | L | 93 | 7.217 | L | 20 |
| LAB782 | 76850.4 | 0.467 | 0.01 | 46 | 9.867 | L | 58 | 7.119 | L | 19 |
| LAB753 | 76438.4 | 0.428 | 0.07 | 34 | — | — | — | — | — | — |
| LAB753 | 76439.3 | 0.398 | L | 24 | 8.250 | 0.04 | 32 | — | — | — |
| LAB753 | 76440.2 | — | — | — | 7.286 | 0.08 | 17 | — | — | — |
| LAB751 | 76928.2 | 0.372 | 0.09 | 16 | — | — | — | — | — | — |
| LAB751 | 76929.2 | 0.342 | 0.19 | 7 | 7.652 | 0.02 | 23 | 6.560 | 0.02 | 9 |
| LAB751 | 76930.2 | 0.435 | L | 36 | 8.470 | L | 36 | 6.425 | 0.05 | 7 |
| LAB742 | 76432.1 | 0.381 | 0.15 | 19 | — | — | — | — | — | — |
| LAB742 | 76434.3 | 0.378 | 0.05 | 18 | — | — | — | — | — | — |
| LAB717 | 76428.1 | 0.374 | 0.02 | 17 | 7.748 | 0.15 | 24 | 6.926 | L | 15 |
| LAB717 | 76428.4 | 0.373 | 0.23 | 16 | 8.190 | 0.12 | 31 | 6.739 | 0.08 | 12 |
| LAB717 | 76430.1 | 0.412 | 0.02 | 29 | 7.364 | 0.29 | 18 | — | — | — |
| LAB703 | 76422.2 | 0.386 | 0.03 | 20 | 7.385 | 0.18 | 18 | 6.540 | 0.22 | 9 |
| LAB703 | 76422.4 | 0.472 | 0.08 | 47 | 11.313 | 0.06 | 81 | 7.173 | 0.04 | 20 |
| LAB703 | 76425.1 | 0.407 | 0.01 | 27 | 7.494 | 0.23 | 20 | 6.428 | 0.29 | 7 |
| LAB671 | 76411.1 | 0.458 | L | 43 | 8.991 | 0.13 | 44 | 6.848 | 0.19 | 14 |
| LAB671 | 76411.5 | 0.446 | L | 39 | 11.056 | L | 77 | 7.049 | L | 17 |
| LAB667 | 76096.1 | 0.459 | L | 43 | 9.440 | 0.04 | 51 | 6.622 | 0.10 | 10 |
| LAB667 | 76097.3 | 0.349 | 0.27 | 9 | 7.724 | 0.01 | 24 | 6.471 | 0.05 | 8 |
| LAB629 | 76896.2 | 0.387 | 0.23 | 21 | — | — | — | — | — | — |
| LAB629 | 76899.1 | 0.379 | 0.03 | 18 | 8.452 | 0.15 | 35 | 6.588 | 0.06 | 10 |

TABLE 180-continued

Genes showing improved plant performance at Low Nitrogen growth conditions under regulation of At6669 promoter (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB629 | 76899.2 | 0.429 | L | 34 | 7.866 | 0.03 | 26 | 6.900 | 0.02 | 15 |
| CONT. | — | 0.321 | — | — | 6.245 | — | — | 6.000 | — | — |
| LAB820 | 76121.1 | 0.551 | 0.03 | 24 | 15.500 | 0.07 | 33 | 7.712 | L | 10 |
| LAB820 | 76121.2 | 0.487 | 0.15 | 10 | 13.353 | 0.09 | 14 | 7.419 | 0.27 | 5 |
| LAB820 | 76122.2 | 0.604 | L | 36 | 17.317 | L | 48 | 7.894 | L | 12 |
| LAB781 | 75334.1 | 0.543 | L | 23 | 14.190 | 0.29 | 22 | 7.639 | 0.02 | 9 |
| LAB781 | 75335.1 | 0.473 | 0.29 | 7 | — | — | — | — | — | — |
| LAB755 | 75171.2 | 0.509 | 0.14 | 15 | 13.144 | 0.19 | 13 | 7.877 | L | 12 |
| LAB750 | 75447.2 | 0.519 | L | 17 | 14.431 | 0.26 | 24 | — | — | — |
| LAB750 | 75448.1 | — | — | — | — | — | — | 7.298 | 0.19 | 4 |
| LAB747 | 76799.1 | 0.497 | 0.08 | 12 | — | — | — | — | — | — |
| LAB725 | 75857.1 | 0.500 | 0.16 | 13 | — | — | — | — | — | — |
| LAB725 | 75859.1 | 0.541 | 0.02 | 22 | — | — | — | — | — | — |
| LAB657 | 75732.2 | 0.505 | 0.02 | 14 | 14.793 | 0.10 | 27 | 7.803 | L | 11 |
| LAB657 | 75732.5 | 0.551 | 0.12 | 24 | — | — | — | — | — | — |
| LAB638 | 76092.1 | 0.524 | 0.01 | 18 | 15.885 | L | 36 | 7.449 | 0.24 | 6 |
| LAB638 | 76092.2 | 0.492 | 0.23 | 11 | — | — | — | 7.774 | 0.03 | 10 |
| LAB638 | 76095.1 | 0.519 | 0.07 | 17 | — | — | — | 7.692 | L | 9 |
| LAB623 | 75097.1 | 0.491 | 0.09 | 11 | — | — | — | 7.389 | 0.28 | 5 |
| LAB617 | 76336.1 | 0.542 | 0.02 | 22 | — | — | — | 7.733 | 0.08 | 10 |
| CONT. | — | 0.444 | — | — | 11.671 | — | — | 7.036 | — | — |
| LAB834 | 75891.1 | 0.531 | 0.04 | 26 | 12.885 | 0.02 | 26 | 7.129 | 0.06 | 8 |
| LAB834 | 75892.5 | 0.506 | 0.04 | 20 | 15.302 | 0.06 | 50 | 7.366 | 0.03 | 11 |
| LAB834 | 75893.1 | 0.514 | 0.08 | 22 | 12.167 | 0.13 | 19 | — | — | — |
| LAB834 | 75895.1 | 0.505 | 0.03 | 20 | 11.194 | 0.26 | 10 | — | — | — |
| LAB834 | 75895.4 | 0.491 | 0.23 | 17 | 13.794 | 0.06 | 35 | 7.284 | 0.05 | 10 |
| LAB807 | 76236.3 | 0.486 | 0.03 | 15 | 12.459 | 0.16 | 22 | — | — | — |
| LAB807 | 76237.1 | 0.555 | L | 32 | 15.978 | 0.05 | 57 | 7.415 | 0.02 | 12 |
| LAB807 | 76239.1 | 0.506 | 0.01 | 20 | 13.500 | 0.06 | 32 | 7.496 | L | 13 |
| LAB807 | 76240.4 | 0.473 | 0.01 | 12 | — | — | — | — | — | — |
| LAB726 | 76381.1 | 0.475 | L | 13 | 15.821 | L | 55 | 7.430 | L | 12 |
| LAB726 | 76382.1 | 0.606 | 0.07 | 44 | 13.801 | 0.08 | 35 | 7.524 | L | 14 |
| LAB726 | 76382.2 | 0.441 | 0.30 | 5 | — | — | — | — | — | — |
| LAB726 | 76385.1 | 0.486 | L | 15 | — | — | — | 7.419 | L | 12 |
| LAB696 | 75849.2 | 0.542 | 0.05 | 29 | 11.300 | 0.26 | 11 | 7.353 | 0.17 | 11 |
| LAB696 | 75850.2 | — | — | — | 12.764 | L | 25 | 7.192 | 0.13 | 9 |
| LAB696 | 75850.4 | 0.503 | 0.02 | 20 | 17.559 | 0.02 | 72 | 7.829 | L | 18 |
| LAB687 | 75043.1 | — | — | — | 12.099 | 0.03 | 19 | 7.115 | 0.05 | 8 |
| LAB687 | 75046.1 | 0.498 | 0.02 | 18 | 13.567 | 0.09 | 33 | 7.368 | 0.04 | 11 |
| LAB687 | 75046.4 | 0.512 | 0.02 | 21 | 16.421 | L | 61 | 7.357 | 0.02 | 11 |
| LAB673 | 76533.1 | 0.440 | 0.22 | 5 | — | — | — | — | — | — |
| LAB673 | 76540.2 | 0.495 | 0.10 | 17 | — | — | — | — | — | — |
| LAB650 | 75836.1 | 0.461 | 0.04 | 10 | — | — | — | — | — | — |
| LAB650 | 75836.2 | 0.486 | 0.03 | 15 | 13.521 | 0.01 | 32 | 6.994 | 0.03 | 6 |
| LAB650 | 75838.1 | — | — | — | 12.076 | 0.04 | 18 | 6.931 | 0.30 | 5 |
| LAB650 | 75838.2 | 0.482 | 0.14 | 14 | 14.586 | 0.04 | 43 | 7.394 | L | 12 |
| LAB650 | 75839.2 | 0.471 | 0.06 | 12 | 11.902 | 0.07 | 17 | 7.025 | 0.07 | 6 |
| LAB626 | 74770.1 | — | — | — | 14.036 | 0.11 | 37 | 7.242 | 0.14 | 10 |
| LAB626 | 74771.2 | 0.475 | L | 13 | 15.173 | L | 49 | 7.038 | 0.04 | 6 |
| LAB626 | 74771.3 | — | — | — | — | — | — | 6.960 | 0.17 | 5 |
| CONT. | — | 0.421 | — | — | 10.210 | — | — | 6.610 | — | — |
| LAB848 | 77336.7 | — | — | — | 9.694 | 0.09 | 24 | 6.777 | 0.15 | 11 |
| LAB848 | 77339.2 | 0.475 | 0.10 | 18 | 13.015 | L | 66 | 7.433 | 0.01 | 22 |
| LAB848 | 77339.3 | 0.451 | 0.28 | 12 | 10.170 | 0.13 | 30 | 6.918 | 0.12 | 13 |
| LAB848 | 77339.4 | — | — | — | 11.455 | 0.05 | 46 | 6.829 | 0.17 | 12 |
| LAB811 | 76343.1 | — | — | — | 10.681 | 0.13 | 36 | 7.149 | 0.05 | 17 |
| LAB811 | 76345.3 | — | — | — | 10.760 | 0.02 | 37 | — | — | — |
| LAB811 | 76345.4 | 0.542 | L | 34 | 12.819 | L | 63 | 7.946 | L | 30 |
| LAB811 | 78053.6 | 0.461 | 0.17 | 14 | 12.229 | L | 56 | 7.017 | 0.01 | 25 |
| LAB811 | 78054.5 | — | — | — | 9.674 | 0.13 | 23 | — | — | — |
| LAB785 | 77998.1 | — | — | — | 10.069 | 0.06 | 28 | — | — | — |
| LAB728 | 75147.1 | — | — | — | 9.915 | 0.21 | 26 | — | — | — |
| LAB728 | 75150.2 | — | — | — | 14.093 | 0.02 | 80 | 6.898 | 0.13 | 13 |
| LAB728 | 75151.2 | — | — | — | 12.036 | 0.17 | 53 | 6.996 | 0.16 | 14 |
| LAB728 | 75152.2 | — | — | — | 10.154 | 0.07 | 29 | — | — | — |
| LAB692 | 76418.1 | 0.469 | 0.14 | 16 | — | — | — | — | — | — |
| LAB692 | 76418.4 | — | — | — | 9.034 | 0.27 | 15 | — | — | — |
| LAB692 | 78068.2 | 0.535 | 0.01 | 32 | 14.228 | L | 81 | 7.942 | L | 30 |
| LAB692 | 78069.5 | — | — | — | — | — | — | 6.824 | 0.16 | 12 |
| LAB692 | 78069.7 | 0.462 | 0.21 | 14 | 11.533 | 0.07 | 47 | 6.914 | 0.10 | 13 |
| LAB676 | 77271.2 | — | — | — | 9.733 | 0.22 | 24 | 6.768 | 0.17 | 11 |
| LAB676 | 77275.1 | — | — | — | 10.240 | 0.19 | 31 | — | — | — |
| LAB676 | 77275.3 | 0.450 | 0.30 | 12 | 10.579 | 0.05 | 35 | 7.022 | 0.07 | 15 |

TABLE 180-continued

Genes showing improved plant performance at Low Nitrogen growth conditions under regulation of At6669 promoter (T2 generation)

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LAB672 | 77698.1 | — | — | — | 12.177 | L | 55 | 7.053 | 0.05 | 15 |
| LAB672 | 77698.3 | — | — | — | 12.196 | L | 56 | 7.011 | 0.06 | 15 |
| LAB672 | 77699.1 | 0.474 | 0.12 | 17 | 10.182 | 0.06 | 30 | 6.584 | 0.30 | 8 |
| LAB672 | 77699.2 | 0.547 | L | 35 | 11.043 | 0.02 | 41 | 7.325 | 0.02 | 20 |
| LAB672 | 77700.1 | 0.536 | L | 33 | 11.200 | 0.11 | 43 | 7.272 | 0.03 | 19 |
| LAB662 | 77296.3 | 0.522 | 0.01 | 29 | 11.806 | L | 51 | 7.298 | 0.02 | 19 |
| LAB662 | 77298.3 | — | — | — | 11.613 | 0.02 | 48 | 6.662 | 0.24 | 9 |
| LAB662 | 77299.2 | — | — | — | 13.283 | L | 69 | 6.973 | 0.10 | 14 |
| LAB633 | 74828.2 | 0.526 | 0.03 | 30 | 15.578 | L | 99 | 7.657 | L | 25 |
| LAB633 | 74828.4 | 0.511 | 0.02 | 27 | 10.402 | 0.07 | 33 | 6.780 | 0.15 | 11 |
| LAB633 | 74831.4 | — | — | — | 11.600 | 0.13 | 48 | 7.367 | 0.05 | 21 |
| LAB633 | 74832.1 | — | — | — | 10.095 | 0.11 | 29 | — | — | — |
| LAB633 | 74833.2 | — | — | — | 9.544 | 0.16 | 22 | — | — | — |
| LAB622 | 75036.1 | — | — | — | 10.027 | 0.06 | 28 | — | — | — |
| CONT. | — | 0.404 | — | — | 7.841 | — | — | 6.110 | — | — |
| LAB850 | 77714.2 | — | — | — | 13.837 | 0.21 | 25 | — | — | — |
| LAB850 | 77714.3 | 0.486 | 0.11 | 18 | 14.480 | 0.10 | 31 | — | — | — |
| LAB825 | 76392.1 | — | — | — | 15.126 | 0.07 | 37 | — | — | — |
| LAB825 | 76394.1 | — | — | — | 13.788 | 0.08 | 25 | 7.483 | 0.12 | 7 |
| LAB793 | 75753.1 | — | — | — | 13.411 | 0.16 | 21 | — | — | — |
| LAB765 | 76113.3 | 0.476 | 0.10 | 15 | 14.622 | 0.03 | 32 | 7.491 | 0.21 | 7 |
| LAB765 | 76113.5 | 0.493 | 0.18 | 20 | 16.378 | 0.05 | 48 | — | — | — |
| LAB765 | 76114.3 | 0.582 | L | 41 | 14.719 | 0.06 | 33 | — | — | — |
| LAB760 | 75862.2 | — | — | — | 12.615 | 0.27 | 14 | — | — | — |
| LAB760 | 75865.3 | 0.491 | 0.06 | 19 | — | — | — | — | — | — |
| LAB758 | 76490.2 | 0.492 | 0.09 | 19 | — | — | — | — | — | — |
| LAB758 | 76490.4 | 0.522 | 0.02 | 27 | 15.459 | 0.01 | 40 | 7.690 | 0.09 | 10 |
| LAB754 | 77289.3 | 0.465 | 0.24 | 13 | — | — | — | — | — | — |
| LAB747 | 76796.1 | — | — | — | 14.309 | 0.12 | 29 | 7.485 | 0.13 | 7 |
| LAB747 | 76799.1 | 0.510 | 0.09 | 24 | — | — | — | — | — | — |
| LAB735 | 77323.1 | 0.465 | 0.26 | 13 | 15.428 | L | 39 | — | — | — |
| LAB723 | 77282.2 | 0.513 | 0.02 | 24 | 15.411 | 0.01 | 39 | 7.997 | 0.06 | 14 |
| LAB723 | 77282.3 | — | — | — | 13.855 | 0.11 | 25 | — | — | — |
| LAB711 | 77077.3 | — | — | — | 15.600 | 0.19 | 41 | — | — | — |
| LAB711 | 77079.4 | 0.474 | 0.17 | 15 | 15.173 | 0.02 | 37 | — | — | — |
| LAB710 | 76362.2 | 0.484 | 0.16 | 17 | 13.536 | 0.23 | 22 | — | — | — |
| LAB710 | 76365.1 | 0.527 | 0.07 | 28 | 14.684 | 0.09 | 33 | 7.659 | 0.14 | 9 |
| LAB698 | 76202.2 | 0.461 | 0.25 | 12 | — | — | — | — | — | — |
| LAB698 | 76204.1 | 0.458 | 0.22 | 11 | — | — | — | — | — | — |
| LAB663 | 77048.1 | — | — | — | 14.175 | 0.06 | 28 | 7.474 | 0.17 | 6 |
| LAB656 | 77316.1 | — | — | — | — | — | — | 7.638 | 0.06 | 9 |
| LAB656 | 77320.5 | — | — | — | 14.043 | 0.07 | 27 | — | — | — |
| LAB625 | 76451.1 | 0.482 | 0.08 | 17 | — | — | — | — | — | — |
| LAB625 | 76452.1 | — | — | — | 15.092 | 0.20 | 36 | — | — | — |
| LAB625 | 76472.1 | 0.486 | 0.13 | 18 | 13.634 | 0.08 | 23 | — | — | — |
| CONT. | — | 0.412 | — | — | 11.066 | — | — | 7.018 | — | — |
| LAB817 | 75756.5 | — | — | — | — | — | — | 6.446 | 0.07 | 11 |
| LAB810 | 76287.1 | 0.461 | 0.29 | 17 | 12.056 | 0.16 | 41 | 6.646 | 0.09 | 15 |
| LAB799 | 77468.3 | 0.447 | 0.10 | 13 | 11.681 | 0.16 | 37 | 6.744 | 0.04 | 16 |
| LAB738 | 75163.2 | 0.438 | 0.29 | 11 | — | — | — | 6.594 | 0.03 | 14 |
| LAB714 | 75137.2 | 0.458 | 0.18 | 16 | 12.210 | 0.01 | 43 | 6.876 | 0.01 | 19 |
| LAB709 | 75427.8 | 0.439 | 0.24 | 11 | 10.770 | 0.29 | 26 | 6.719 | 0.04 | 16 |
| LAB701 | 75123.4 | 0.487 | 0.05 | 23 | 13.244 | 0.15 | 55 | 6.666 | 0.06 | 15 |
| LAB701 | 75124.1 | 0.451 | 0.03 | 14 | 13.271 | 0.11 | 55 | 6.521 | 0.13 | 13 |
| LAB684 | 75274.2 | — | — | — | — | — | — | 6.946 | 0.05 | 20 |
| LAB661 | 75272.1 | — | — | — | 13.001 | 0.01 | 52 | 6.691 | 0.03 | 15 |
| LAB654 | 76742.3 | — | — | — | 11.114 | 0.05 | 30 | 6.439 | 0.08 | 11 |
| LAB654 | 76745.1 | 0.439 | 0.13 | 11 | — | — | — | 6.364 | 0.19 | 10 |
| LAB631 | 74856.6 | — | — | — | 10.699 | 0.22 | 25 | — | — | — |
| LAB628 | 75496.5 | — | — | — | 10.708 | 0.25 | 25 | 6.613 | 0.06 | 14 |
| LAB628 | 75499.1 | 0.466 | 0.06 | 18 | 12.502 | 0.02 | 46 | 6.861 | 0.01 | 18 |
| CONT. | — | 0.395 | — | — | 8.543 | — | — | 5.794 | — | — |

Table 180. "CONT."—Control; "Ave."—Average; "% Incr." = % increment; "p-val."—p-value, L—p < 0.01.

TABLE 181

Genes showing improved plant performance at Low Nitrogen growth conditions under regulation of At6669 promoter (T1 generation)

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LAB745 | 0.525 | L | 17 | 15.341 | 0.19 | 37 | 6.741 | 0.06 | 11 |
| LAB734 | 0.499 | 0.29 | 11 | — | — | — | — | — | — |
| LAB685 | 0.533 | 0.13 | 19 | — | — | — | — | — | — |
| CONT. | 0.449 | — | — | 11.159 | — | — | 6.047 | — | — |

Table 181. "CONT."—Control; "Ave."—Average; "% Incr." = % increment; "p-val."—p-value, L—p < 0.01.

The genes presented in Tables 182-183 showed a significant improvement in plant NUE. These genes improved plant growth rate (leaf area, root length and root coverage growth rate) when grown under low nitrogen growth conditions (assay 5), compared to control plants. Plants showing fast growth rate show a better plant establishment in soil. Faster growth was observed when growth rate of leaf area and root length and coverage was measured. Plants were evaluated in T2 generation (Table 182) or T1 generation (Table 183). The genes were cloned under the regulation of a constitutive promoter (At6669; SEQ ID NO:10446). Evaluation of each gene was performed by testing the performance of different number of events. Some of the genes were evaluated in more than one seedling analysis resulting in positive results as well.

TABLE 182

Genes showing improved plant performance at Low Nitrogen growth conditions under regulation of At6669 promoter (T2 generation)

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB803 | 76760.1 | — | — | — | 2.026 | 0.08 | 54 | — | — | — |
| LAB799 | 77468.3 | — | — | — | 1.804 | 0.12 | 37 | — | — | — |
| LAB779 | 77309.3 | — | — | — | 1.895 | 0.08 | 44 | — | — | — |
| LAB721 | 76102.3 | — | — | — | 1.713 | 0.18 | 30 | — | — | — |
| LAB631 | 74856.6 | — | — | — | 1.784 | 0.17 | 36 | — | — | — |
| CONT. | — | — | — | — | 1.314 | — | — | — | — | — |
| LAB849 | 75706.2 | — | — | — | 1.699 | 0.04 | 22 | — | — | — |
| LAB836 | 75984.4 | — | — | — | 1.611 | 0.13 | 16 | — | — | — |
| LAB773 | 78332.2 | — | — | — | 1.660 | 0.09 | 19 | — | — | — |
| LAB771 | 75873.2 | — | — | — | 1.574 | 0.18 | 13 | — | — | — |
| LAB771 | 75873.4 | — | — | — | 1.614 | 0.18 | 16 | — | — | — |
| LAB727 | 76386.1 | 0.051 | 0.29 | 11 | 1.759 | L | 27 | — | — | — |
| LAB727 | 76386.2 | — | — | — | 1.723 | 0.06 | 24 | — | — | — |
| LAB727 | 76387.1 | — | — | — | 1.710 | 0.02 | 23 | — | — | — |
| LAB702 | 78293.8 | 0.057 | 0.06 | 25 | 1.750 | 0.05 | 26 | — | — | — |
| LAB700 | 77192.2 | — | — | — | 2.004 | L | 44 | 0.780 | 0.02 | 13 |
| LAB700 | 77194.1 | — | — | — | 1.610 | 0.18 | 16 | — | — | — |
| LAB700 | 77195.3 | — | — | — | 1.654 | 0.08 | 19 | — | — | — |
| LAB691 | 74782.3 | — | — | — | 1.638 | 0.12 | 18 | — | — | — |
| LAB688 | 75827.2 | — | — | — | 1.710 | 0.04 | 23 | — | — | — |
| LAB684 | 75274.2 | — | — | — | 1.566 | 0.25 | 13 | — | — | — |
| LAB669_H7 | 77878.2 | — | — | — | 1.601 | 0.16 | 15 | — | — | — |
| LAB669_H7 | 77878.9 | — | — | — | 1.784 | 0.01 | 28 | 0.750 | 0.15 | 9 |
| LAB669_H7 | 77880.2 | — | — | — | 1.671 | 0.12 | 20 | — | — | — |
| LAB661 | 75272.1 | — | — | — | 1.610 | 0.22 | 16 | — | — | — |
| LAB628 | 75496.5 | — | — | — | 1.621 | 0.21 | 17 | — | — | — |
| CONT. | — | 0.045 | — | — | 1.390 | — | — | 0.688 | — | — |
| LAB844 | 76787.4 | 0.043 | L | 43 | 1.094 | 0.03 | 46 | — | — | — |
| LAB844 | 76789.3 | 0.037 | 0.14 | 22 | 0.984 | 0.07 | 32 | — | — | — |
| LAB842 | 76348.1 | 0.044 | L | 47 | 1.352 | L | 81 | 0.627 | 0.02 | 19 |
| LAB842 | 76350.2 | — | — | — | — | — | — | 0.598 | 0.16 | 13 |
| LAB842 | 76350.3 | 0.035 | 0.25 | 15 | — | — | — | — | — | — |
| LAB841 | 76804.2 | 0.040 | 0.04 | 32 | 0.997 | 0.04 | 33 | — | — | — |
| LAB841 | 76804.6 | 0.038 | 0.06 | 25 | 0.881 | 0.19 | 18 | 0.627 | 0.02 | 19 |
| LAB829 | 76441.5 | 0.038 | 0.21 | 24 | 1.104 | 0.02 | 48 | 0.590 | 0.22 | 12 |
| LAB829 | 76442.2 | — | — | — | 0.933 | 0.06 | 25 | 0.577 | 0.24 | 9 |
| LAB829 | 76443.1 | — | — | — | 0.931 | 0.08 | 24 | — | — | — |
| LAB827 | 76791.9 | 0.037 | 0.25 | 22 | 1.668 | L | 123 | 0.666 | L | 26 |
| LAB827 | 76794.3 | 0.039 | 0.05 | 27 | 0.922 | 0.11 | 23 | 0.600 | 0.14 | 13 |
| LAB823 | 77027.1 | 0.039 | 0.05 | 30 | 1.246 | L | 67 | 0.585 | 0.22 | 11 |
| LAB823 | 77028.2 | 0.040 | 0.02 | 33 | 0.991 | 0.03 | 32 | 0.642 | 1 | 22 |
| LAB816 | 76717.2 | 0.036 | 0.26 | 17 | 0.970 | 0.06 | 30 | 0.590 | 0.21 | 12 |
| LAB816 | 76718.3 | — | — | — | 1.129 | L | 51 | 0.597 | 0.11 | 13 |
| LAB816 | 76719.1 | — | — | — | 1.510 | L | 102 | 0.607 | 0.08 | 15 |

TABLE 182-continued

Genes showing improved plant performance at Low Nitrogen growth conditions under regulation of At6669 promoter (T2 generation)

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB782 | 76848.6 | 0.043 | L | 43 | 1.445 | L | 93 | 0.664 | L | 26 |
| LAB782 | 76850.4 | 0.046 | L | 53 | 1.188 | L | 59 | 0.659 | L | 25 |
| LAB753 | 76438.4 | 0.036 | 0.25 | 18 | — | — | — | — | — | — |
| LAB753 | 76439.3 | 0.035 | 0.20 | 16 | 1.012 | 0.03 | 35 | 0.589 | 0.20 | 11 |
| LAB753 | 76440.2 | — | — | — | 0.867 | 0.22 | 16 | — | — | — |
| LAB751 | 76929.2 | — | — | — | 0.901 | 0.12 | 20 | — | — | — |
| LAB751 | 76930.2 | 0.039 | 0.04 | 29 | 0.969 | 0.04 | 30 | — | — | — |
| LAB742 | 76434.3 | 0.037 | 0.12 | 21 | — | — | — | — | — | — |
| LAB717 | 76428.1 | — | — | — | 0.913 | 0.12 | 22 | 0.574 | 0.28 | 9 |
| LAB717 | 76428.4 | — | — | — | 0.950 | 0.10 | 27 | 0.591 | 0.17 | 12 |
| LAB717 | 76430.1 | 0.038 | 0.07 | 25 | — | — | — | — | — | — |
| LAB703 | 76422.2 | — | — | — | 0.874 | 0.23 | 17 | 0.577 | 0.29 | 9 |
| LAB703 | 76422.4 | 0.045 | 0.01 | 47 | 1.324 | L | 77 | 0.647 | 0.03 | 22 |
| LAB703 | 76425.1 | 0.039 | 0.05 | 27 | 0.889 | 0.20 | 19 | — | — | — |
| LAB671 | 76411.1 | 0.039 | 0.07 | 28 | 1.034 | 0.03 | 38 | 0.588 | 0.29 | 11 |
| LAB671 | 76411.5 | 0.041 | 0.01 | 34 | 1.288 | L | 72 | 0.620 | 0.04 | 17 |
| LAB667 | 76096.1 | 0.042 | L | 39 | 1.106 | L | 48 | — | — | — |
| LAB667 | 76097.3 | — | — | — | 0.920 | 0.10 | 23 | 0.574 | 0.29 | 9 |
| LAB629 | 76899.1 | 0.036 | 0.15 | 18 | 1.023 | 0.03 | 37 | 0.585 | 0.19 | 11 |
| LAB629 | 76899.2 | 0.041 | 0.01 | 35 | 0.944 | 0.05 | 26 | 0.593 | 0.14 | 12 |
| CONT. | — | 0.030 | — | — | 0.748 | — | — | 0.529 | — | — |
| LAB834 | 75891.1 | 0.052 | L | 32 | 1.517 | 0.03 | 26 | — | — | — |
| LAB834 | 75892.5 | 0.046 | 0.06 | 17 | 1.846 | L | 54 | 0.674 | 0.01 | 16 |
| LAB834 | 75893.1 | 0.048 | 0.04 | 22 | 1.445 | 0.10 | 20 | — | — | — |
| LAB834 | 75895.1 | 0.048 | 0.02 | 22 | — | — | — | 0.617 | 0.26 | 6 |
| LAB834 | 75895.4 | 0.047 | 0.11 | 19 | 1.656 | L | 38 | 0.647 | 0.09 | 12 |
| LAB807 | 76236.3 | 0.046 | 0.05 | 17 | 1.488 | 0.07 | 24 | — | — | — |
| LAB807 | 76237.1 | 0.045 | 0.14 | 14 | 1.922 | L | 60 | 0.651 | 0.06 | 12 |
| LAB807 | 76239.1 | 0.049 | 0.02 | 24 | 1.607 | 0.02 | 34 | 0.685 | L | 18 |
| LAB807 | 76240.4 | 0.044 | 0.20 | 11 | 1.365 | 0.28 | 14 | — | — | — |
| LAB726 | 76381.1 | — | — | — | 1.897 | L | 58 | 0.633 | 0.09 | 9 |
| LAB726 | 76382.1 | 0.054 | L | 36 | 1.643 | 0.01 | 37 | 0.649 | 0.05 | 12 |
| LAB726 | 76385.1 | 0.050 | L | 25 | — | — | — | 0.692 | L | 19 |
| LAB696 | 75849.2 | 0.051 | L | 29 | — | — | — | — | — | — |
| LAB696 | 75850.2 | — | — | — | 1.524 | 0.03 | 27 | 0.653 | 0.05 | 13 |
| LAB696 | 75850.4 | 0.043 | 0.28 | 9 | 2.116 | L | 76 | 0.710 | L | 22 |
| LAB687 | 75043.1 | — | — | — | 1.442 | 0.09 | 20 | — | — | — |
| LAB687 | 75046.1 | 0.046 | 0.09 | 15 | 1.600 | 0.02 | 33 | 0.634 | 0.13 | 9 |
| LAB687 | 75046.4 | — | — | — | 1.942 | L | 62 | — | — | — |
| LAB687 | 75047.2 | — | — | — | 1.410 | 0.24 | 18 | 0.614 | 0.30 | 6 |
| LAB673 | 76533.1 | — | — | — | 1.380 | 0.28 | 15 | 0.651 | 0.07 | 12 |
| LAB673 | 76540.2 | 0.045 | 0.14 | 14 | — | — | — | — | — | — |
| LAB650 | 75836.1 | 0.044 | 0.14 | 11 | — | — | — | — | — | — |
| LAB650 | 75836.2 | — | — | — | 1.614 | L | 35 | 0.627 | 0.10 | 8 |
| LAB650 | 75838.1 | — | — | — | 1.456 | 0.08 | 21 | 0.620 | 0.28 | 7 |
| LAB650 | 75838.2 | 0.046 | 0.08 | 17 | 1.764 | L | 47 | 0.658 | 0.02 | 13 |
| LAB650 | 75839.2 | 0.046 | 0.07 | 15 | 1.411 | 0.13 | 18 | 0.616 | 0.23 | 6 |
| LAB626 | 74770.1 | — | — | — | 1.692 | L | 41 | 0.649 | 0.05 | 12 |
| LAB626 | 74771.2 | — | — | — | 1.837 | L | 53 | 0.671 | L | 16 |
| CONT. | — | 0.040 | — | — | 1.199 | — | — | 0.580 | — | — |
| LAB848 | 77336.5 | — | — | — | — | — | — | 0.642 | 0.21 | 16 |
| LAB848 | 77336.7 | — | — | — | 1.186 | 0.14 | 26 | 0.697 | 0.04 | 26 |
| LAB848 | 77339.2 | 0.046 | 0.29 | 18 | 1.572 | L | 67 | 0.678 | 0.07 | 22 |
| LAB848 | 77339.3 | — | — | — | 1.236 | 0.11 | 31 | 0.657 | 0.13 | 19 |
| LAB848 | 77339.4 | — | — | — | 1.387 | 0.02 | 47 | — | — | — |
| LAB811 | 76343.1 | — | — | — | 1.268 | 0.09 | 34 | — | — | — |
| LAB811 | 76345.3 | — | — | — | 1.314 | 0.04 | 39 | 0.652 | 0.14 | 18 |
| LAB811 | 76345.4 | 0.054 | 0.03 | 40 | 1.561 | L | 65 | 0.753 | L | 36 |
| LAB811 | 78053.6 | 0.046 | 0.23 | 20 | 1.494 | L | 58 | 0.729 | 0.01 | 32 |
| LAB811 | 78054.5 | — | — | — | 1.187 | 0.16 | 26 | 0.632 | 0.24 | 14 |
| LAB785 | 77997.3 | — | — | — | 1.184 | 0.23 | 26 | — | — | — |
| LAB785 | 77998.1 | — | — | — | 1.232 | 0.10 | 31 | 0.649 | 0.16 | 17 |
| LAB728 | 75147.1 | — | — | — | 1.205 | 0.17 | 28 | — | — | — |
| LAB728 | 75150.2 | — | — | — | 1.723 | L | 83 | 0.673 | 0.09 | 21 |
| LAB728 | 75151.2 | — | — | — | 1.471 | 0.03 | 56 | 0.678 | 0.10 | 22 |
| LAB728 | 75152.2 | — | — | — | 1.241 | 0.10 | 32 | — | — | — |
| LAB692 | 76418.1 | 0.048 | 0.14 | 25 | — | — | — | — | — | — |
| LAB692 | 76418.4 | — | — | — | — | — | — | 0.625 | 0.28 | 13 |
| LAB692 | 78068.2 | 0.050 | 0.08 | 29 | 1.742 | L | 85 | 0.744 | L | 34 |
| LAB692 | 78069.7 | — | — | — | 1.413 | 0.03 | 50 | 0.668 | 0.15 | 21 |
| LAB676 | 77271.2 | — | — | — | 1.174 | 0.21 | 24 | 0.666 | 0.09 | 20 |
| LAB676 | 77275.1 | — | — | — | 1.250 | 0.12 | 33 | 0.641 | 0.20 | 16 |

TABLE 182-continued

Genes showing improved plant performance at Low Nitrogen growth conditions under regulation of At6669 promoter (T2 generation)

| | | RGR Of Leaf Area (cm²/day) | | | RGR Of Roots Coverage (cm²/day) | | | RGR Of Root Length (cm/day) | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LAB676 | 77275.3 | — | — | — | 1.284 | 0.05 | 36 | 0.663 | 0.11 | 20 |
| LAB672 | 77698.1 | — | — | — | 1.487 | L | 58 | 0.671 | 0.08 | 21 |
| LAB672 | 77698.3 | — | — | — | 1.485 | L | 57 | 0.647 | 0.16 | 17 |
| LAB672 | 77699.1 | 0.050 | 0.10 | 28 | 1.249 | 0.09 | 32 | 0.679 | 0.07 | 22 |
| LAB672 | 77699.2 | 0.054 | 0.03 | 39 | 1.343 | 0.03 | 42 | 0.694 | 0.03 | 25 |
| LAB672 | 77700.1 | 0.052 | 0.06 | 34 | 1.312 | 0.08 | 39 | 0.656 | 0.14 | 18 |
| LAB662 | 77296.3 | 0.053 | 0.04 | 36 | 1.438 | L | 53 | 0.705 | 0.02 | 27 |
| LAB662 | 77298.3 | — | — | — | 1.418 | 0.01 | 50 | 0.641 | 0.18 | 16 |
| LAB662 | 77299.2 | — | — | — | 1.623 | L | 72 | 0.666 | 0.10 | 20 |
| LAB662 | 77299.4 | — | — | — | — | — | — | 0.639 | 0.21 | 15 |
| LAB633 | 74828.2 | 0.048 | 0.16 | 25 | 1.892 | L | 101 | 0.716 | 0.02 | 29 |
| LAB633 | 74828.4 | 0.051 | 0.07 | 31 | 1.261 | 0.08 | 34 | 0.639 | 0.20 | 15 |
| LAB633 | 74831.4 | — | — | — | 1.408 | 0.03 | 49 | 0.689 | 0.07 | 24 |
| LAB633 | 74832.1 | — | — | — | 1.229 | 0.16 | 30 | — | — | — |
| LAB633 | 74833.2 | — | — | — | 1.155 | 0.22 | 23 | — | — | — |
| LAB622 | 75036.1 | — | — | — | 1.227 | 0.11 | 30 | 0.687 | 0.05 | 24 |
| LAB622 | 75037.3 | — | — | — | — | — | — | 0.635 | 0.23 | 15 |
| CONT. | — | 0.039 | — | — | 0.943 | — | — | 0.554 | — | — |
| LAB820 | 76121.1 | 0.048 | 0.21 | 12 | 1.729 | 0.11 | 23 | — | — | — |
| LAB820 | 76121.2 | — | — | — | 1.601 | 0.19 | 14 | — | — | — |
| LAB820 | 76122.2 | 0.052 | 0.02 | 21 | 2.035 | L | 44 | — | — | — |
| LAB781 | 75334.1 | 0.051 | 0.02 | 19 | 1.723 | 0.17 | 22 | 0.722 | 0.27 | 9 |
| LAB755 | 75171.2 | 0.047 | 0.27 | 10 | — | — | — | — | — | — |
| LAB750 | 75447.2 | 0.048 | 0.08 | 13 | 1.764 | 0.15 | 25 | 0.726 | 0.25 | 9 |
| LAB725 | 75859.1 | 0.049 | 0.06 | 15 | — | — | — | — | — | — |
| LAB657 | 75732.2 | 0.046 | 0.28 | 7 | 1.764 | 0.05 | 25 | — | — | — |
| LAB638 | 76092.1 | — | — | — | 1.873 | 0.01 | 33 | — | — | — |
| LAB638 | 76092.2 | 0.047 | 0.26 | 11 | — | — | — | — | — | — |
| LAB617 | 76336.1 | 0.048 | 0.26 | 11 | — | — | — | — | — | — |
| CONT. | — | 0.043 | — | — | 1.409 | — | — | 0.663 | — | — |
| LAB817 | 75756.5 | — | — | — | — | — | — | 0.632 | 0.24 | 13 |
| LAB810 | 76287.1 | 0.044 | 0.21 | 20 | 1.483 | 0.07 | 42 | 0.678 | 0.08 | 22 |
| LAB799 | 77468.3 | 0.041 | 0.26 | 14 | 1.436 | 0.10 | 37 | 0.650 | 0.17 | 17 |
| LAB799 | 77470.3 | — | — | — | 1.365 | 0.23 | 31 | — | — | — |
| LAB738 | 75163.2 | — | — | — | — | — | — | 0.643 | 0.18 | 15 |
| LAB714 | 75137.2 | 0.042 | 0.22 | 17 | 1.496 | 0.03 | 43 | 0.647 | 0.17 | 16 |
| LAB709 | 75427.8 | — | — | — | 1.318 | 0.22 | 26 | 0.645 | 0.19 | 16 |
| LAB701 | 75123.4 | 0.043 | 0.15 | 20 | 1.630 | 0.03 | 56 | 0.653 | 0.16 | 17 |
| LAB701 | 75124.1 | — | — | — | 1.629 | 0.03 | 56 | — | — | — |
| LAB684 | 75274.2 | — | — | — | — | — | — | 0.671 | 0.12 | 20 |
| LAB661 | 75272.1 | — | — | — | 1.598 | 0.02 | 53 | 0.637 | 0.23 | 14 |
| LAB654 | 76742.3 | — | — | — | 1.362 | 0.17 | 30 | — | — | — |
| LAB631 | 74856.6 | — | — | — | 1.318 | 0.22 | 26 | — | — | — |
| LAB628 | 75496.3 | — | — | — | 1.386 | 0.18 | 33 | — | — | — |
| LAB628 | 75496.5 | — | — | — | 1.309 | 0.23 | 25 | 0.628 | 0.29 | 12 |
| LAB628 | 75499.1 | 0.043 | 0.12 | 20 | 1.536 | 0.03 | 47 | 0.661 | 0.11 | 19 |
| CONT. | — | 0.036 | — | — | 1.045 | — | — | 0.558 | — | — |
| LAB850 | 77714.2 | — | — | — | 1.703 | 0.14 | 29 | — | — | — |
| LAB850 | 77714.3 | — | — | — | 1.758 | 0.09 | 33 | — | — | — |
| LAB825 | 76392.1 | — | — | — | 1.838 | 0.05 | 39 | — | — | — |
| LAB825 | 76394.1 | — | — | — | 1.639 | 0.17 | 24 | — | — | — |
| LAB793 | 75753.1 | — | — | — | 1.617 | 0.21 | 22 | — | — | — |
| LAB765 | 76113.3 | — | — | — | 1.769 | 0.05 | 34 | — | — | — |
| LAB765 | 76113.5 | — | — | — | 1.980 | 0.03 | 50 | — | — | — |
| LAB765 | 76114.3 | 0.051 | 0.08 | 26 | 1.767 | 0.06 | 34 | — | — | — |
| LAB758 | 76490.4 | 0.048 | 0.27 | 17 | 1.876 | 0.02 | 42 | — | — | — |
| LAB747 | 76796.1 | — | — | — | 1.746 | 0.13 | 32 | — | — | — |
| LAB747 | 76799.1 | 0.048 | 0.28 | 19 | — | — | — | — | — | — |
| LAB735 | 77323.1 | — | — | — | 1.860 | 0.05 | 41 | — | — | — |
| LAB723 | 77282.2 | — | — | — | 1.848 | 0.05 | 40 | — | — | — |
| LAB723 | 77282.3 | — | — | — | 1.681 | 0.17 | 27 | — | — | — |
| LAB711 | 77077.3 | — | — | — | 1.900 | 0.06 | 44 | — | — | — |
| LAB711 | 77079.4 | — | — | — | 1.852 | 0.03 | 40 | — | — | — |
| LAB710 | 76362.2 | — | — | — | 1.614 | 0.24 | 22 | — | — | — |
| LAB710 | 76365.1 | 0.049 | 0.21 | 21 | 1.781 | 0.07 | 35 | — | — | — |
| LAB698 | 76204.1 | — | — | — | 1.692 | 0.27 | 28 | — | — | — |

TABLE 182-continued

Genes showing improved plant performance at Low Nitrogen growth conditions under regulation of At6669 promoter (T2 generation)

| Gene Name | Event # | RGR Of Leaf Area (cm²/day) | | | RGR Of Roots Coverage (cm²/day) | | | RGR Of Root Length (cm/day) | | |
|---|---|---|---|---|---|---|---|---|---|---|
| | | Ave. | P-Val. | % Incr. | Ave. | P-Val. | % Incr. | Ave. | P-Val. | % Incr. |
| LAB663 | 77046.1 | — | — | — | 1.696 | 0.19 | 28 | — | — | — |
| LAB663 | 77048.1 | — | — | — | 1.704 | 0.10 | 29 | — | — | — |
| LAB656 | 77316.1 | — | — | — | — | — | — | 0.751 | 0.28 | 13 |
| LAB656 | 77320.5 | — | — | — | 1.711 | 0.15 | 30 | — | — | — |
| LAB625 | 76452.1 | — | — | — | 1.785 | 0.12 | 35 | — | — | — |
| LAB625 | 76472.1 | — | — | — | 1.647 | 0.30 | 25 | — | — | — |
| CONT. | — | 0.040 | — | — | 1.320 | — | — | 0.667 | — | — |

Table 182. "CONT."—Control; "Ave."—Average; "% Incr." = % increment; "p-val."—p-value, L—p < 0.01.

TABLE 183

Genes showing improved plant performance at Low Nitrogen growth conditions under regulation of At6669 promoter (T1 generation)

| Gene Name | RGR Of Leaf Area cm²/day | | | RGR Of Roots Coverage (cm²/day) | | |
|---|---|---|---|---|---|---|
| | Ave. | P-Val. | % Incr. | Ave. | P-Val. | % Incr. |
| LAB745 | 0.044 | 0.13 | 16 | 1.841 | 0.10 | 34 |
| LAB734 | 0.043 | 0.26 | 13 | — | — | — |
| LAB685 | 0.048 | 0.03 | 26 | — | — | — |
| CONT. | 0.038 | — | — | 1.373 | — | — |

Table 183. "CONT."—Control; "Ave."—Average; "% Incr." = % increment; "p-val."—p-value, L—p < 0.01.

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (11093 sequences)

SEQ ID NO: 1 - DNA, 2358 bp, Arabidopsis thaliana
tacgtacacacatctttttctctgtctttaagagttaacgaaaacaccattagatttaagtcacatgtggctcttttgcatgttctgtcataaacacgtccatttcattcatcctcttcttcttcttctccttctatcctctgttttttgccctctctctttgtttagtggctgtggtcgtttgtatttggtgaaacataatttaaaaacaagtgcggctatctttaactctggccgacacatcggcggattcgactgtggtcggatcaagaagtgcttcctttttttccggcgtcgtttcttcttttatattcatcgatttggtgctctcgcaacttccaatagattacggctaatttctaaaatgaagatattaccatgctttggatttatccgtagaaagaaaaataaggggaattcaaaacctcagaaaacgcagagaatacttcagatcagacttgaagagccagtgaagcctttggagaatgatgagcctaacaacaaggacagtcctatcaagcacgagtcatatgacggcgaagatgaacgtgacgataaggattcaacgaaccgtgagttttctaaattccacgttcacgaacgagccgttgaatctgtgaaaagcaaggaggaagtcacagatacttctgaaaacggcgatgacaatgacgaggatgaaggaggtcacgtcagtgatcctggattaggcaaaactacggcttgggtgacgtctcctaagcttaaacgatcttgctccactctcagcaagtttaatggccggttccatggttctgatctccatgacctgaaagagaccgttccagttagtaatgaatcagtgaggtctcatagaagtgcagatagagtgatgctcaagaaacattcgtcgatgcagatacttccctctgggagccggcggctctggtggaagttgttcctatggagccataggaaccttcacaaacaccgtgtctcgctaaagtcacagcctttaaacaagaaccagcagtctggatacacctctgactttgctgagcacaaccaatccagccatgaagaagaatctacaaactattgcgctgatttcaccaaccagtcatcaaacttgtggcctcatcataatcagtgggtcgcgttctctgccgagtcctcgtcaatgaagcgagtggacgagtgggtaagaggactggatgtcgaaaccgtggttccagtgaacgaggataaggatgtcttggccatcttcccaacctctcctaatactgagagatcacccttaggaaatgtggttcagtccggaaacgtctcagaggctatagtgcacgcaaatagccttattcaatcgctgagcaaatcatcgagcgtggctcacatctcgagcatcggcttgaaagctatcccgagcatctcacattttaccagcctcaagtcgattgatctatcaaacaacttcatagttcaaattactcctgcatcgcttcctaagggcctccacgcgttgaacctttccaagaacaagatcagtgttatcgaaggactaagagatttgacacgcctaagagtactcgatctaagttacaaccgaatttctcgcattggacaaggtttatcaaactgtacactgatcaaagaactatacctagctgggaacaagatcagcaatgtagaaggcttacacagattgctgaaacttattgttcttgatcttagtttcaacaagatcgccaccaccaaagcaataggccagcttgtagccaactacaactctctcgttgctttgaacatcctcggaaacccgatccagaacaatgtaggcgaggaccagctacgcaagaccgtttccagccttctccctaagctagtttaccataacaagcagctcattaagccacaacgagccagggaagttctcaaagatagtgtagcgagagctgcgtttggtggtggagattctttgcaccacaggcgcaaaagaacatccaccaagagtgttgttggatcagcctcccctagcgttcaccaccgaggccacattgcaaaaggacgtggatccaaaaacagaagccaacgtcaactaagaaaaacttcagctgcagggacgccatcacattgaattgttctttttgtttgaatctcatgaattggccaatgcaaattgcaaagccatctccattctttgattttataattcagcatcttttctaacgcttatgtttccggttcggtttcaattctggtttactgtctttttactttttagttgatccggttctcggaaacatgtaaaaccgaataacactttccggtttaactcaattttggagatttttcatataatcaatttcaaaaagaatcgtaact

SEQ ID NO: 2 - DNA, 961 bp, Arabidopsis thaliana
actacctaccgaaactcaattcgacgtttagaaaacgtgtcgcttcttctgatctcagcttcaaaattcgagaaagagtgatcgggaaaaataatcatcggcaatgggttggtataccagtttcttagtagtggtggcgtccttagccgtcggagttatattctcgccggagacattcggatcgttgacgaatggagagaattcggcgaagatttcgatattcctgaagctagctcatctactcagtttcgctacagcttggggagctgctctctgggctaccttcatcggaggaatcatcatgttcaagaatttaccgaggcatcagtttggtaatcttcagagcaagttgtttccagcttacttcactttggttggttcttgctgcgcaatttcactctctgcttttggttatttgcatccatggaagtcatcttctacggtcgagaaatatcagatagggtttctcctatccgcttttgctttcaatctcaccaatttgtttgtcttcactcccatgaccatcgatatgatgaaacaaaggcacaaagtagagagggaaaacaacattggagatgaagttggttggtccaagaacagagaaaaggcaaagagtatcccaaagctagctgctatgaacaagaagtttggaatgattcacgggttatcatcccttgctaacatcttttcatttggaagccttgctatgcattcttggtatctagctgggaagttgaatctctagtttcctcctcaatactcatcttgtcacaaaggtctgaccttttacgcccccttaatgaataaatctcttgcatttcctcgccaatccctttgtaagattgtgtcagactccaaacatatttcagtgaaatcatgaaagaaattgttaccaagcactcttgtacgaagatacttcctgtctttctctaaaaataatccatgtttgatagattctatt

SEQ ID NO: 3 - DNA, 1303 bp, Arabidopsis thaliana
acatcagagggaacttggaggacacagagaagcgcaaattatcagacagagtgagaacgaagaagaagaaagcacaggatgctaagcttgagatattcattaccttatcttcttcttcaaacaagggaatcatcaactaagctcttcaccaaaaagcctaacaatgttgtggtttgtgcggcgagaggtccaagacctcggtctcctcgtgtatggaaaacaaggaagaggattggaactatctctaaagctgccaaaatgattgcttgtataaaaggattgtcgaatgttaaagaagaagtttatggagcgcttgattccttcattgcttgggaattagagttccctcttgttatagttaagaaggcattagttatacttgaagatgaaaaagaatggaagaagattattcaggtgacaaaatggatgctgagtaaaggccaaggaagaacaatgggaacttacttctcattactaaatgctttagcagaagataatcgccttgacgaagctgaggaattgtggaacaaattgttcatggaacatttagaaggaactcctagaaagttcttcaacaaaatgatctctatatattacaagagagatatgcaccaaaagctcttcgaggtctttgctgacatggaggagcttggagtgaaaccgaatgttgcgattgtgtctatggttggaaaagtgtttgtgaaactagagatgaaggataagtacgagaaactgatgaagaaatatcctccaccacagtgggagtttagatacatcaaaggaagacgtgttaaggtcaaggcaaagcagctgaatgagctaagcgaaggtgaaggtggtttaagcagcgacgaagataagattgacaatgagattgagagtgaagaagaagatggtgaggatctcagtgaagaggaagaagatgaaaaagaacttttgggtggaagtcaaggacagattacttctagagaacccagtcttgatcatttggactcttcatgagcttttgagatcgtatctaccgttgaatcatctataaggaaaatagatagacggccaaggttcttcaaagaagctttctggggctgagcttgggtttctgacgaaaacatgaccagaaaagttttgaactatctgagcttaagagtcaaaacaaggtatagatttgaagagtcaactaaaaagagtattaaactcagcaaaaagattaaatactgtaaaatcttttagtacgactgtgtaagctctgaaaacaaaaattattgtataatttcagacaataatttcagatcaacgttaacta

SEQ ID NO: 4 - DNA, 1168 bp, Arabidopsis thaliana
caccacagattgttttttttttcattttatcttgagaagaaccacacacacccagagagagacagagattcatcgatatggcggtttcttgcaaccactctgcgattctcttctctccatcatccaccgctggttcctcctccgttacttcttcctcgtcgctcatcggctttcctcgtttccaaacgctgcgtttcaaatcaagaagcgtttattcgaaatctagagcttcttctcctgtctcggcattgccttcacgttctctagaagctctgattttcgattgcgacggcgtgattctcgaatccgagaatctacaccgtcaagcttacaacgatgctttctcgcatttcgatgttcgatgtcctccttcttcctctgcgtctctcgattggagcctcgagttctacgataagtttcagaatctagtcggaggtgggaaaccgaaaatgcgttggtatttcaaagaaaatggatggccaacttccaccatttttgactctcctcctcagaatgacgatgatcgagccaagttaatcgatactcttcaggattggaaaactgagaggtataaagaaatcataaaatcaggaagtgtagaaccaagacctggtgtaataagactaatggatgaagcaaaagctgctgggaaaaaactagctgtttgttctgcagctacaaagagttcagtaatcttatgtctcgagaatctaatcgatatcgagcggttccaaggacttgattgcttccttgcaggggatgatgttaaggagaaaaaacccgatccttcgatatatattacagctgccgagaagctaggtgtttcagtgaaagactgtttggtcgtagaggacagtgtgattggcctgcaggctgctacaaaagcagggatgtcatgtgtgatcacgtacacttcttcaacctctgatcagaatttcaatgatgcgattgccgtataccctgatctcagcaatgtgaaattgaaggacttggaaactctgcttcaaacaatagtcactgcagcttaagacatttgtctcctattcatttctgactgttcttctgcaactgtacatttgttgtttatgtttgataaaattttcattaataagaaaagaagattcaaatgtataaaaatagcagtacaatacaatcaagacctaccctg

SEQ ID NO: 5 - DNA, 1651 bp, Hordeum vulgare
gcgacagtgtaaacaccggcgattccccactcgctcatcagtcccggcccagctcgccgccatggccgccggcgacgagttccgcccgctggacgaggcctccctcgtggcctacatccgggcgaccccggcgctggccgccagcctcggcggccgcgtcgacgccctctccgtcaaggaggtcggcgacggcaacctcaacttcgtctacatcgtcacatccgacgccggctccgtcgtcgtcaagcaggcgctgccgtacatccggtgcgtgggggactcgtggccgatgacgagggagcgggcctacttcgaggcgtcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtccactacccgctcctcgcccaccacatggccgactacatggccaacaccctcttcttcacctccctcctctacaactccaccacccaccacaagaaacaagttgctcgctactgcgagaacgtggagatgtgcaggctcacggagcaggtcgtgttctcggacccatacatggtctccaaatacaatcgctggaactcgccgttcctcgacaaggacgccgaagcagttcgggaggatgatgggctcaagttggaaattgctgaactgaagtcgatgtttattgagagagcccaggctctgattcatggggatctccatactggttccatcatggtgaccccagattccactcaagtgatcgatccagagtttgccttctacgcgccgatgggttacgacattggggctttcttggggaacctgattctggcgtactttgcacaggatgggcatgctgatcaagcaaatgaccgtaaagcttataagcaatggatactgaagaccatcgaagaatcgtggaatttgttccagcagaaatttttgggactctggaataaacacaaagatgggaatggggaggcatacctgcctgccatatacaacaacccggagcttttgggcgttgtacagaagaagtacatgacagatttacttcatgatagtcttggatttggttcggccaaaatgatcaggagaattgttggaattgcccatgtggaggattttgactcaatcgaggatgccagcaagagagcatcatgtgagcgccgcgcgcttgattgtgccaaggcaatcctgaagggccgacgccagttcgagagcattgagcaagtgattgcgcacgtccgatcagtaactcatgactgagaaaaccagcccgcctgttcggggtttccggttgaggagaccttcctttggttgttatcaggattgagcacccacgctcaagtatggagatgtgttgttcattgtgaaacatccttgggtccatgtggcttatgtgggctgcagcgattcctatacttgggtcgagaacatcctgtgtgtatttctagtgtaaggcaggcggccttgcatcatagatgtgtgttgaataacagaatgtacaatgtatctgaacgttgtacaattatcagtagatacaggcctggttgccaccaataaaaccctatgtgggtgggttttgccaag

SEQ ID NO: 6 - DNA, 2825 bp, Hordeum vulgare
ggaggggcctttgatgatattttaccatagacaacatcacagctccgtctcctcctccccattgccgcgccagccagaccacccgagcctccccaccctaaaccctagccgccgccgccgccgccgccgccgatggcgaagcgcccgcgcaacttccgggcggtgcggtccaactccttcgagtcctacctccggcgggtcatatccgaggccgggctcgccgtgccgggctgctgcgccgatgacgtcgccgccgcgctccgctcccgccacccggacctgcgccgcaagcagcacgccccgctcgtggccgccgtccgccgcgccctcctcaccatccccctcgcccccgcccccggcgccggctccgactccgacatggactcccgcgcctcctccccctcctcccgccgccgccaccgcgcccacgccaccgcctcctcctccacctcctactccgagcacgacgacgacgacgacgacgccccctcccctccccccgccttcgacgtcaccaaggccatgctccgcacccgctacgcctccctcacgcccaggaaggagcccgcggccgccgccgcagccgcagcaagccagcagctcgagatcgagctcaactcggagaagccccgccggcgcgtcacgaccgatggcggcggcggcggcgaccccaagcaggaggcaggggccagcgaaggaggcggcggcggaggggccaaggggcccaggttttctgatcttggggggatggagacggtgattgacgagctgatgatggaggttgtggttcccctgtgccacccggagctgccgctgcggctcggggttcggcctgtggcagggattctgctgcacgggccgccaggctgcgggaaaaccacgctcgcccacgcaatcgccaacgagactggcgtgccattctacaagatatcggcgccggaagtcgtatctggtgtctctggagcttctgaggaaaatatcagagtcttgtttaagaaggcgtacagaactgctccctcaattgtatttatagacgagatagatgcaattgcgtccaagagggagaatttgcaacgtgaaatggagcggcggatagttacacagttaatgacatgcatggatgaattccaccagaatgttggatcggatggtggtgacttggactcgcaatcatctgaaaagaaacctggctatgtcattgtcatcggagctaccaataggcctgatgctgttgaccaagcgcttcggagaccagggaggtttgatcgagaaatatctcttggtgttccagatgagattggacggaaacagattttgaagatgcttactcagaacctaacactggagaaagaccaatttgacctgttcaagatagcaagggctaccccaggatttgttggcgcagacttgaaggcattagtagataaagcagggaatctggcaatgaagagaataattgttgaaagaaaaaaacagagtggtgggggtgatgtaaacagcaagcaggactggtggaggcatccttggagtgaagatgagatggacagcctgtgtattactatggatgactttgaggaagcagccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgcaagctgggtttttgctgtttggacctccaggctgtgggaaaactctaatagcaaaagcagttgcgcatgatgcaggggcaaattttattcacattaaggggcctgagctactgaacaagtatgttggggagagtgaatcagaagtaaggaaaatattcacccgtgcaaggattaactccccatgcatcctatttttcgacgagatagatgctctgacaacaaaaagagggaaagagggaggatgggttgttgaacgcctcctaaaccagttacttgttgaactcgatggtgcagatcagcgtcatggtgtttatgttattggagctacgaacagaattgatgttatagatgaggctgttctacggcctggtagatttgggaagaaacattttgtacctttacctggtgctgatgagcgggttgcgatattgaaagcacatactgaaaagaaaactctctcggaagatgttgatttggaaacaattgcacgtcgagaggagtgcaataatctcactggtgctgacctggcatcactggtgaacgaagcagccatggcagcgttggaagagaggtgcgaattcctggcgaaaggggactcgtcaatgagtactgacttgactaataagataaaactgcagcactttgagcatgctctatctaaagtaaagccctcagtatcagaacagcaaaggaaacacttcgacgcgctgtcaaagaaatattcagccaactgatccatcgccgtgcttacaaggaccatactgtagccttgtttctacttcccctgttccaaaataaatgtctcaaccttgtactagctctagtataaaattgtactaagcctctagacaattattttggggcggagggagtattatttttgctcataccatagcttggtgtagagattgcgtgtgctgaccctctacactaaagctatgcaattttggtagtgagggacttgttttcggtgtttggaaaatatgaactcgttatgcttgttgtacggcttttaccggtgctccgtccccttgtaatgttttgaattgagaaacacggagaaactttttgtggactg

SEQ ID NO: 7 - DNA, 1140 bp, Hordeum vulgare
ggatcatacgagaggggcaagaagaaggagcgcagcacacgccaccaccgcagcgagcgccaggccaggccaggccggagaagaagcctagacctagacctagacctagaccctctcctcccctctccggcgacgcaggcaggcagggtctcggatcggatctcgtcggcggagatgaggcccgtgttcgtggggaacctggactacgacacccgccactcggagctcgaccacctcttctaccgctacggcaggatccaacgcatcgacatgaagtcagggtttgcttttgtctactttgaggatgaacgtgatggtgatgatgccatacgggctctggatggttatccctttggcccagggagacgcagactttcagtggagtggtcacggggcgaccgtggaaccagacgtgatgaccgtgatggctatagtaaaccaccagtgaatactaagcccaccaagacactgtttgtaattaactttgacccaatcaacacaagagtcagtgatcttgaacggcattttggtccatttgggaggatttcaaatgttcggataaggaagaactttgcttttgtgcaatttgaaactcaggaagaagcctcaaaagcactagatgctactcatttgacgaagttactggacagggtgatttctgttgagtatgccttcagggatgatagtgaaccaggtgacaagtatgacaggccaagtagaggtgctggtggttatggaaggcaggatgacagttcatatcgccgttctgttagcccagtgtaccgaaggtcacgacctagtcctgactatggtcgtccagtgagtcctcagtatggtgcatatggcaggagcaggagtcctgtccgtgatcgctatcgaagccgatctcctgtccagcgctcaagatccccagctcccaacagaaggggttatgactaatcgagaatcatctcggttatggcagtgaggccgcctccatctgctgttccagctctagcattagtaaacaagaacacttctgtagctgacaccgtgttataagaagttggacatgtcctccgacacctgctttgccctgtgtgctaagaagttatacctatactttgacaccagctttgtgcctaaattgtgtcgttttcg

SEQ ID NO: 8 - DNA, 2039 bp, Hordeum vulgare
cactcatcagcttcgcgcaggccagatccaccctcgcctagtctcctccatggccgccgacgccgacacggcggccgccgcacgtgccctcctcctcctcgccgtctccgtcgcggcgctcctccgcgccggcgaggcctcggtgcacgagtacaccggcctcggcttcctcaacaagggcaatgccttcatcctccacgcaggcagcgagggcctctacgcccccgtctcccccgccaatgccaccgccgaggaggaggacgacgaggccgccgccgccgccgcccccgacgccttcatacggtttgacaagattacttttaggaggccagaggaggccaatgattctgtgaaagagactagttcatctaaggttcagatacttgtctttgaaatagaagatcgtgaaatgattggtggatcggcgtatggaggtcaaaaagcaatttgttgtacatcagatcttgcaaagttgggagcttgcgtcgaaggctctgtcatctaccgcccgtcgcaggtgaatcctggttggccacagttgtttgttgcttcttttgatggaagtgatctgattgcaacgctgccttcaaggaccattccagtaaagaaaactgggatgtacaatatgtactttatacactgtgacccggcacttgctggactggaaatcgacgggaaaaccatatggaaaaatcctactggctaccttccaggtcggatggcacctcttaagaacttttttggactgatgtcatttgctttcgtgatacttggtatctattggttttatcaatacatgaagttctggcgagaggttcttccacttcagaactgtattactcttgttattacattgggcatgcttgagatggcattgtggtattttgaatatgctgagttcaatgagactggagttcgggcaaaggccatcacattttgggctgtaacatttgggactattaaaagaacagtggctcgtcttattattctcattgtctcgatggggtatggagttgtgaggcctactttgggtggtctgacatcgaaagtggtcatgcttggaggaacattctttgtagctacagaaattcttgagctagtggaaaatctaggcactgtgaatgatctgtctggaaaagctcgtctatttttagtctatccagtggccatcttggatgcttcattcattgtttggatatttatttctctagccaagacccttagccaacttcaggcaagaaggttgatggccaaacttgacatttataggaaattcactattgcattggccattactgttctggtatctattggctggattggctatgagatctacttcaaatcgactgatgtgttcaatgagcggtggcagtatgcatggataattcctgctttctggcatgccctatcattctcacttctttgcgtcatttcctacctgtgggcaccttctcagagctcaatgagatttaccaatgatgcaagtgaaaaatttgatcgagaagacagcctatcattaataaggccaaggcccattgtttccaagaacgggtggagcgtaacttccgcaccagatgccaaagcaacgaacaacacgaacaccgtggcatcttttgacgaagacgacgaggaaaacaaaagggagtgacgcatctgccgaaggagagagcattccacccacataagatcccttgaattggatgtgctagaacagttttggtatttagcagaggacaggccgtgctaattctagtcgtttggatacggtccttggaggcgtttctttcatgttaaatccgttatccctccactaggtttattcacacagagcctgcatcactgtagtctgtaaggatgattatatgtgataggaacaattcatctgaggcgttattttgggatgtatggtgtataatggtttcatttgtagatctcatgttgcttctagtttatgtgaagactgatgttggcagcaagtgcaattatttattgctacaaatgtgtcgaaatttccattttggtttcagcatcccaagatt

SEQ ID NO: 9 - DNA, 1599 bp, Hordeum vulgare
gtgagcgacgcgaccactcgagagctccaacgcggaacggcgatgtggcgggcgaggcggtggccacggccgcgatggttctcgtccggcacggcggcggcgggggccgatccgggccatccggcgcggcgtcgggtggcggcgctgtgggggaacggggaccacgggcggctggggctgggggcgctggagtcgcggtggagcccaacggcgtgccccttcttcctcgcgcgccccgccgacccgcctgcctccctctcctgcggcggcgcccacaccctcttcctcaccgagggcgggcgcgtgtttgctacggggctgaacgactttgggcagctcgggataggctcctcgatgcctcatactctggaccctgttgaagtctctgggtttcacgagaaagttgtacaaatttcagctggcaaccatcattcttgtgcagtaacagcggatggtgagctcttcgtttggggcaaaaattcgagtggccagcttggccttggcaaaagtgcaggaaaagtagtctctaccccaagaaaggttgactacttggctgatgttagagtgaaaatgactgctttgggatcagagcactcaattgttgttacagaggatggtgaagccttgagttggggagctgctggtggtggtagacttggacatggccataaatctagcttcctgggattcgctatgacctcaaatgaatatactccaaggttgatcaaaaaccttgatggcatcaagattaaaaggatagctgcgggaatgctgcactcagcttgcattgacgaaaaaggtactgtgttcatctttgggcagaagactgagaaggtacttggaagatcaaatgatgcacctagaccaagtgttgttgaagagatacaattttcagaagaagttgcttgtggaggttatcatacttgcgctgtaacagatcgtggagatttgtattcttggggttcaaatgaaaatggctgccttggtcttggaggtacaggcatggttcgcttcccggaagttgtaagcagttcattatttaagcttcctgtatctaaggtatcctgtggttggaagcacacagctgtaatttcaggtgaagatatctacacgtggggctggggcggtgccaacggtacattcttcgaagagggccattcttctggtgggcaattagggcatggaaacgacgtcgactattgcgagccgatgatggtagaacttcacaagaatgcaagagctgtgcatgtatcatgtggcttcaatcacaccggtgcgatactcgagtacgcggaaaactgactgctgtgtcatctgcagcactgtaagtgcaaccaggcatgtttggtactactcagtcatacctgcacaaggaaaaagaataagctgacctcgaacgagtgcatctggatgaactcgtaaaacagaattacaggttagtctagctgtatagtcttctttcatacatcttcattgtgagcttgtatctatgatatttgatggcctgtaaagaagcggtgtttgacattgcccaggctgtgtgatgcgcatggccagttcaaaatgtaaacatgatttgaactaataaaataaatcatg

SEQ ID NO: 10 - DNA, 1395 bp, Hordeum vulgare
ccctgcaccaaatacctgacccgattcctttcccccctcccccccaccatgagtgacgcacccggcgcaccagcctcagctatgggcagtggcagggagctcgccaacccaccgtcggacggcatctccaacctccgcttctccaaccacagcgaccacctcctcgtttcctcctgggacaagacggtccggctatatgacgccgaggcgaacgtgctcaaaggggagttcgcgcaccccgggcctgtgctggactgctgcttccacgacgactcctccgggtttagcgctggcgccgaccacaccgtgcggagattagcatttacttcgtcaaaggaggatgttctcgggcgtcatgatgctccagttcgttgtgtggagtactcttatgctgcaggacaagtcatcactggcagctgggataagacaattaaatgctgggatcccagaggagttagcggaccagagcggacacttgttgggacatatgctcaaccagagcgtgtatattctatgtcactggtgggaaataggttggttgtggcaacagcaggaagacatgtcagtatttatgatttgcgcaatatgtctcaacctgagcaaaaaagggaatcctctttgaaatatcaaacacgctgtgttcgatgtttccccaacggaacagggtatgctctaagttctgtggagggacgagtgtctatggagttctttgacctttctgagtcggcacaatctaaaaagtatgctttcaagtgtcaccggaaatctgagtctggcagggacactgtttatcctgtcaatgccattgcattccatccaatatacggcacatttgccactggaggccatgatggatttgtgaacgtgtgggatggcacgaacaagaagagattgtatcagtactcaaagtacgcgtcaagcattgcctctctgtcgttcagtaaggatgggcatctgcttgctgtggcatcaagctatggctacgaagagggagagaaaccccacgagcctgatgcaatatttatccgtggggtgaatgaagtggaggttaagccgaagcccaaggcattggccgcgccgcagtagtaccgcaaccatttggcaagaaggtagtcaaacgtatcaggtgtgttgtctgggagaagacattatgcggagagcaaatgcgaggcgtttctttatctggttaactttgtagtgtcaattgcactagttgacggaatcccttctctatgttggagtcaaatggcagtatccatatctgaccatttctgtgtgttgtttggcatatattaatgtctagaaatagttgcttgggagtggtcatattccagctcgttttatattttgatgcagaaactgttaaacttggagtagtatttagcttataaccga

SEQ ID NO: 11 - DNA, 1317 bp, Hordeum vulgare
cagcagcagcagcacctcgaggacccaaacccgactacccgagcgagaagcggtgacgatagagcacggggggcagcacagctcgggagcaatggagagggcgacgccggtgcggagcccgcacacctcgacggccgacctgctcacgtggtcggccacgggcgccggcgccccctccgcctcgccggccgccccgtcccgccccagtctcaagccggctggggggatcacgccggccatgttcggcgcgccggtgagcgagcacgacgccgaggatctgagcaacagtgaaaggagactgatgtccggttcaaagatgaaggaaatgactgggagtgggatatttgctgaaaagagtgagaatagtgattcagagtcttcaaatcctgcaaacagaacttctgtgaggatgtatcagcaaactgtaactggagtaagtcagatctcatttagcgcagatggaagcgtttctccaaagaagccatcctcactgcctgaggtggctaagcagcgagagcttagtggcacattcgagactgatgctgaagctaaaattaataagcagctttctgaagccaagaacaaggagctcagcggaagcaatatctttggtccacctcctgagacccctgcaaggccactagctgctcgtaatatggagctacaaggaaacgtagattttgcacttccacaacgaagaagcgtgcacacatcagtgaaagtatccaatcctgctggaggtccaagcaacatcacgttcagtgaggatcctgtaacgaagacagcaaagaaaattcacaaccagaagttccaagagctgacaggcaataacatctttaacgaggatgctcctcctggctcagctgacaagtctctgagctcagcaaagcttaaggagatgagcggcaatgacatattctccgatggaaaggcgtcttcgcgagactacctcggcggtgtccggaagccccctggtggcgagagcagcattgcactcatctaattatggtagactgctctagtcgggactggctagtacgtcctcctcatttcaggtgctcttctcggccttccggggtctagatgatgattcgagatctgaaattatgttggatatcttagccctaatatagtgtagagtcagcaggatctgactcggttcatatcatgtacgcttgtgcgtgatctcatcctttgttttgtggtacttatgtattaatctctctgtactgagaacctgcgcaataagcttttatggactcactagttgattgcccgtggggaaaattaatatcatttttttttctcacaacgtat

SEQ ID NO: 12 - DNA, 3882 bp, Hordeum vulgare
aaaacccagacccaggttaagctcaacccggtgctagacgaccacggcacgcaccaaacctattaaaccgcttcactccttcaccgccgccgccgccattcgccgccgaaggtctgccccccacccgtcttcctcgcgccccccgccgccgccgctccccagcgcccggccgagctcgccaagatgctgcagagcaagtcgttcgtcaagaagacgaagcagggccgcgtcgtcaaggtggtccgggagcactacctccgcgacgacatcccctgcggcgccttctcctgcccctcctgcgacgcggccgcccgccgcctcaacgccgacgccgccgccatcctcgtcgtcgacaccaacgtcgtgctccaccagatcgatttgttggagaatccggcgattgaggatgtcgtggtgctgtcggtggtgctggacgaagtgaagaacaagaacctctccgtgtacaacaggctcaagacgctgtgcaccaacacggctcggaggttcttcgtgttcaccaacgagcaccacagagatacttatgtcaaggagatggttggagagagtccaaatgatcgtaatgatagagcaatccgtgttgctgctcattggtaccagagccacttgggtgacagtgccaaagtgttgctggtcacaaatgatagagataacaaacggaaagctactgaagaaggcctaaatgcagagacagttgagtcatatgtccgatcgcttgcgcagcctggtttgctcgatttggtggttgtcccaagtagcggagatgttgccatggaagatgtagaagatcttagaccatccaaaagtaaaatagtttacaatgagcataaacctatgtcagaaattacatctggtctgcgctgtggaatttatcatcaagggaagcttcgagttaatcgttacaatccatttgaagcatatgtcggaagtgagagcattggtgatgagattattatccgtgggcgttcaaatgtgaacaggtccttcgatggagatatagttgctgtagaactgttgccacaggatcagtggcacgattcaaagtcatttattgctgatgatgatgaagatgataatgaagaggatgtcaggttggttccaaatagcgctgacgatgctccacgaaacaccacttccacgcaatcaacagctggatcatcagctgcttctgtccccagtcgtccagttggacgtgttgttggtatcatcaagaggaattggaactcgtattgtggatcattggagccaatgcccatgcctgctggtagcgggggtgttgctcatgctctttttgtgtcgaaagatcgaagaattcctaagattcggatccaaactagacaacttggtaatcttttaaataaaaggattatcgttgcagttgattcatgggatgtcatgtctcgatacccatcaggacactatgtgcggactataggagatattggcgataaagaaacagaaacagaggttgtcctaatagagaatgatattaacacaagacctttctctacacaagtccttgcttgtttgccacctttgccttggacattgtcacctgaggatgtggctaatcctaataggcaagatttgcggcatgtgagagtctttagtgtggatccacctggttgtagggacattgatgatgcactacattgcacaccgcttccaaatgggaattttgaagttggagtacatattgctgatgtcactaattttgtccatcctggtacccctcttgacgaggaggcctctcaaagggcaacttctgtttatcttgttggacaacgaattgacatgctaccaaagcctctaactgaagatgtttgttctcttcgtgctgatgttgagaggctggcgttctccgtcatttgggaaatgacacctgatgctgatatcatatcctcaagatacacaaagagtgttattaagtcttgtgctgcaatgtcttatgtggaagcccaagcaagaatggatgacagtcgtttggttgatccactgactgtagacttgcggaacttaaattcattagcaaagataatgagaaatcggcgttgcgaaagaggggctctgactcttgcttcagcagaagtcaaattcgaaattgacagtgaaactcatgatccccttgacataggaatatatcaaattcgtgaggcaaaccaaatgattgaagagtttatgttggcagcaaatgtttctgttgctgagaagattttgcagcactaccccttgtgttcattgctacggcgtcatcctagcccaacaaaggagatgcttgagccattactccgtactgcctcctctgttggcctaagtctggacgtatcatcctcaaaagcattagctgaatcacttgataatgcgaagagagatgacccgtacttcaacaagcttatccggattttggcaactagatgcatgacacaagcagtttacttttgcagtggagatttgagcttgtctgagtattaccattatgggcttgcatctgctctgtacactcatttcacttctcctattcgcagatatgcagatgttgtggtgcataggttgctagctgctgctctagatattgcgaaacttccaccagtcttccaggatggtccacaactcacaggcatcgctgacaacttgaattataggcaccgaaatgcccaaatggcaagcagagcatcggttgagctccacactctcatatatttcaggacaaggcctgtggatactgaagctagaatagtaaagatcaaggcaaatggtttcatagtcttcgtaccgaagtttggcatagaaggtcccatctatcttacggcgaagggagacaaaggggctgactgggtagtagacgaggtgcaccagaaagtaaccaagcctggaacaaacataagctatgctgtgttgcagagtgttatgatccatatggaagtggtcgagcctcagcctcaccgcccaaagctacagctcaccctcatatgaacaacaaatgtacaaatgaattgtaacattagtgcattcaccctttttccgctacggcattgtaccagggtccattcttcaattcaacaaattttggtgattttatgatattgtcaaatcagcctggaattcctctttacagagctgtgtaaaaatctcgctttattgatgctaaaaatctatcatgccctgctgctttgcgttcaccagtcgctcatctctgggcactcttataatgtgcttgaaacacactgtaaaaatgtgatgatgcaaagttttctagctgaagagagcctcaggacacgagtgacatgaacaccgtcgaccagagtgttagcgccagggctgcaaccaggtgcgtccagaggaagacgatggagcactcctcctccccaacatcaaacagctgggctatagtcccgacgctcatggcagggggaaccgtggattgcagcaggagaacgtagcggtacaggggcgatcttggcaggaacccgagctcgctggcggccttcaccaccccgattccgcaggcggggaggatgacgaagcgtatcgcgatgatggacatgaccaccagtggcttctgcatcgtcctgcctctgccttttgtaaggtttccgccaagtatgaggacggtgcatggtatcgcggcgtctccaagtaactttgcggtgtcttggactactcggagagggccgtcttcctccgtgacgagtggtctcagcttgtcgattgcaccgacggtaaaccctatgagtgcggcaacactgggaggtgaccacagttcattcaatatctctaacagcaaatcctttgctcttcttaagcagcgcatggggctaccgtcaacgtcgttggaaggcaaggtacaataatggcctcgtgccg

SEQ ID NO: 13 - DNA, 1139 bp, Hordeum vulgare
tccgcgcgcgccaccgcagatattttcctttttcccgcaccaagcccagcgcctttatatacgccgcgcgcccatccattccgacgcctcgctgtctctccccatctcgtctcaggtcgccatcgaagcacaagcaccggtagcactagcaggaaccccctaacgccccagcgtgagatcgcgagattgtagcttgatcgatcgaggcagggaagatcggaagaggatcgacgatgcagtcgccgtcgcactaccagtcctcctactacgccgtgctcggcgtccacccaggcgcgtccgccgccgagatacgcgccgcttaccaccgcctcgccatgaggtggcacccggataagatcgcgaatggccgtgtggatccggcgatcgcggaggaagccaagggaaggttccagaagatacacgaggcataccaggtgttgtcggatgagaagcggagggcgctctacgacgccgggatgtacgaccccctcgacgacgaccaacaagaggtcgagggcttccatgatttccttcaggagatgctctcgctcatggcgaccgttggtacagaggagcccgtgtattccctgggcgaactccaatcgatgcttgacgggatgatgcaggatttcacctccccccaaccgccaccaccaagcagcttcttcaccagcaccagttcatcgacgcggttcggcgcacccagtggcggagcgcagcagcagcgtcgatcctcctcccgcgtacggcctcaggggttcggcggctcggcatgcttcagccagacggctttctccggctgctaagcacttgcgcgatctgcatcgcagttcatacgtccgtgggtgtatacatatcctagttacaaggatctcacccgcgtgaaggcaccgaaatatgcagagaccggggaccgtggagctagcgctccaacgatgcacacatcacccactcactggatcagggaaataaaggagatggtagctagatatttccagttgagcagcaactcggaacgatcttcattgttagtttttgtttagatagttgtacatagatgatgacaatcagaagtgaagacgtgatgtttttgcactgtggtgtatttacttcaaaagcaacaacaatgacacgtgccg

SEQ ID NO: 14 - DNA, 1989 bp, Hordeum vulgare
ggtctctctcttcctaaaatttctccctctttctctctcgcctcactctctctcgtctcgtctccccccaccccgctgccgaatccccaaccaaaccccgccgtcgcaatcgtccgcacgcgcgcgcgcgggtttctgtggacgccggcgtccccggcccggattgatcccgccgctcctctcctctcctcctcccgattctcgccatccaatcaatctcttcctttgctcccttcctttcccggccgcctcctggtttcttgccgaaattgcctgccacctgtttggactctggagacgagggcgcgcgcataacttgcctcgccattgcggctgctctgctcagcccggctgcttccttggatctgctagctcgcccgcgccggcctccggggcgcgctcccccgctccaaatctcgtccttgttttggaggtcctcctgtgcggatgaggagggaatcctgacttttgctgggctccggcggttctcttcctggatccttgcggcggaggcgtgccgggatgggtttcttgatctgcgcctgcctcctccagctgctcttcttgggctcctctccggtggcggcgcagtcgccgtcgccggcgagggccctggacgcaatgctgcaggagtacgcgtaccgggccttcgtccggccgcacaccggcattgtctacaacggcaccgtgccttcggacctcgccggcgtcgcggtgtccgggctccgcctgcgcagcggcagcctgcggaggaaaggcttctccaactacttcaacttcaggatcccccctggcgtcatcgtgcagccgtacgtcgagagggtggtgctagtgtaccacagcctgggcgacctctcggagaagtactacccgctccccggctacacctatctctcgcccattctcgggctgctcgtctacgacgctgccaacttgtcagcagtgggtttgtccgagctgagcatcgtcgcgtcagggagccccatttctgtgaatttcagcaatgtcagggcggtgccgccaggcagtccagcgccgcagtgtgtgtggttcgatttggatggcgtgccacagttccgggccttggaggcaaacaacgtgtgtgcaacgtatcgccgagggcacttctccatagtggtgaactccagtgaggttgctcctgctccaggtccttcaggcgcaattgccccgccaataccgactgatggtggtcgtgataagggtagttcggacgcatggaagattgccgtcggcgttgttgggggtgtcattgcattggggctgttggctttgcttctggtatgtttcctcagatataaaaaggaaaagaagatggaggttatggaacgaaatgcagaggtcggggagactttgcgcatggcgcaggttgggcggacgcaagcgcctgtagcgttcggaacgcgaacaaaacctgtgattgagagtgagtatgttgcctagttgatttttggtgttttgcagaattcaggcaacagcagcaatgctctaagatgatgccctgagatgtggaattgtccaccggtcagttgaggcagaaagcattccatatcagtgagggtgctgtgaattgctaggtttagggttcagctgctgctccttgcgggtagcaaattcttttggcggttcttattaggacttgaattgttctgcaatggttactgttgatgttcatagtcgcctgttccttgttgggttcgtctgcaagcaagcaatggagaagagatatttatcatgccagatttggaatcctttgattattttttcattggtgtattcaaaaggaaaatgggcctggcaataaagcaggtaatattcattgaacatgagattgtgctattccagtgaacttcatacaggctccaattcaattccattttggtgccttttagcttctcctgtttggacacatgtttaatacaatgtaaatgtttactcatttagtttggtttggtaactaatctgcttatt

SEQ ID NO: 15 - DNA, 1615 bp, Hordeum vulgare
ctctgctataaatcttgccccggacgccgcacgcaaaatccagaaatccccaatcccaaacctagtacactgcactgtagcaggagtgcgagatggtggtgaagagcgcaggaggaggaggaggcggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgcaaggtccacttagactacatagaagcaggtgcaaacattataattactgcatcgtatcaggctaccattcaagggttcgaggccaagggattttcaaaagaacaaggtgaaaatttgctaacaaagagtgttgagattgcacatgaagcacgtgagatgtttctgaaggaacatccagatcaatccaccgccttgcgtcctattctggttgccgcttccatcggaagttatggggcttatcttgctgatggctctgagtacagtggggattatggtgaagccggaacacttgagttcctgaaagattttcatcggcgaagacttcaggttcttgcagaagcacggcctgatttgattgcttttgaaacaatccccaataaattggaagctcaggcttatgttgaacttcttgacgaatgcaacataaatatcccttcatggttttccttcaactcaaaagatggagttaatgttgtgagtggggactcattaatcgaatgtgctaatattgctaatgcatgtgcaaaggttggtgcagttggtataaactgcacgcctccaagatttattcatagcctgatactctccattcggaaggtcacagacaagccaattctgatatatcccaacagtggagaaagatatgatgccgagaaaaaggagtgggtggaatccactggtgtgtcagacggcgatttcgtttcttatgtaggcgagtggtgcaaagatggggctgcccttatcgggggctgctgcaggacaactccaaacaccatcagagcaataagtagatctcttaaccaatactaccctgcggcttaggtatttgcggcacagagttgtaccctccttcagactggttactcctggtgttatgttgccaacatgccctggagatttagtaatagctgcgtgacgttctcctgcaaaatgagatagctgtgcacttacatttgcgaaacggcggtgtgtctctagcgaacagtaagatgtagctgctgtaccaaggagtgatagcaagcagtaacagcgaagttgtactaaggagtgagtgaaatgatctgcggcgaagttcacaaccccttattacctattaagacagtttgaggcaatgtatgttatacagattctgagttgttatggagatattaacctgcaataagctgctatgttgttgtgtaccaatgctgtcttgtgggtaccctgttttattgtaccataagttttatctgagctactatgtatgtatttccctttgaaaacgaagaattttactgagggttctttcatcactgatatacaaaattgccaac

SEQ ID NO: 16 - DNA, 1106 bp, Hordeum vulgare
ccacttacctacagcctacaaccaactgagacgaacgactgccgtcgtcctgctcgcaagttgtaaccaccgcgaacctcatcttcgccggagacaggaactgatggcggcagctgccatgagctacgtgcatgcggacgtggagaacctcaaggcgacggagctgaggctcggcctgccgggcgtcgaggagaccgccaaggtgccgtcgccgccgtccacgcccagggccggcagcaagcgcgcgctcgccggggagcaccgcgaggaggagcccaagaccgcgcccccggccgccaaggcgcaggtcgttgggtggccgccggtgaggtcctacaggaagagctgcttccagcaggcgagcagcaagaccaagccggccgcgccggcacccgtggcggtgaagcaggaggaggccgccgttaccgcggcgccgcccgccgccgcagccgcgggaggctcgctgtacgtgaaggtgagcatggacggtgcaccctacctgaggaagatcgacctcaagatgtacaagggctaccgcgagctcagagaggccctggaggccatgttcctcggcttctccggcgacgcaggcagcgtgaacccgtcggacttcgccgtcacctacgaggacaaggacggcgacctcatgctcgtcggcgacgtgcccttcgagatgttcatgagcacttgcaagaggctgaggatcatgaagggatccgaggcaagaggcctaggatcatcaaaggagtgaaacggaatcgatctatgaagaacacgcgacatgccatgggtgcatgtgtgcaacatggaggaattcttttgttcttttgggcatgttgtcgaactcgtctaccacagtgcatgctactcttcaaggcaaagaagaaggaaaagacgcaagctgattcgagtggagttttattttcattttgtttttttttaaaataggtgttagcaacacaaaaggagtggagatcagttcgagttgaatcggatctccatgtgtgtttgtacaaagaaaacagctttctttccgagttaagctatgtcaatggttggttggtgtctcccttgagtttggttattatcaaagattgcaaggaaat

SEQ ID NO: 17 - DNA, 1075 bp, Hordeum vulgare
tcctgcaagcgcgagaagttagctgatctctgaactcaggcatcctccacacctgcaaaaccaaaggatttaagtgaagaagcaggcagagatatcgccggaggcacgcacgcgcgatggccaccatctcttcttgcagccgcctgtgcggcggcggcagcaccgccttccaccgtcgacgcagccggcctgcgcgggccaccgtcgtcacctgccggagattctcggccgtcgtccgcgcggccgcctctgccaccgcagcggcgcccgcgtccaccgtgcctcaaaccaaggagtgcaagcttccgacgtgggcggagttcgagctggggaagtcgccggtgtactggaagaccaccaacggtcttcctccagccccgggagagggcctgaagatattctacaacccagggacgaccaagctgacacccaacgagcagttcggcatcgccttcaacgggggctttaaccagcccatcatgtgcggcggcgagccgaggcagatgacgctgcaagagagggggaaagcctgcccccccatctacaccatcaggatacgggtgccgcagcatgccatgacactggttttctccttcaccaacggaagcgaatgggacggggcttacaccctcaaattcaaggtccccaaaccatggctcaacaagcctctgagcttcttcaacgaggggctggctgacgagctcaacatggagggcgcctgcgacagggccatctttccggatgaaaacatcgtcatcacgagctgcgatatcggcggcttctacgaggagggaggagaccggtgcaagctggacatcgtgaccgggtgcatggaccggacctcgcacatgttcgacccactggccaccatcgacgacggctcctgcccgctggactctgattcggaggagtgaccggaccagcgccaagatgacatgagcagcagcttcgcaatatgtacttactataaaacaaagagggggagccacgattgctcgatgtgtcctcttctctttgtttatacttgtataaaaatggatttgtgatgcaattaaaggaagaaggatagtacaat

SEQ ID NO: 18 - DNA, 934 bp, Hordeum vulgare
tctcctccttctctcccctccctcacctccactcgtcgccgtccagtctccggcgagatccccgccgctcccccgccggcagccatgtcttccgtcttcagcggcgacgagaccgcccccttcttcggcttcctcggcgccgcggccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccatacttcctcttcgacggctacgcccacctctcctccggcctcgcctgcggcctcgccggcctcgccgccggcatggccatcggcatcgtcggcgacgccggcgtcagggccaacgcacagcagcccaagctgttcgtcggaatgatcctcatcctcatctttgccgaagcccttgccctgtacggcctcattgtcggcatcatcctctcctcgcgtgccggccaatcccgcgccgactagaacaaagcgcttgcaagcaaggagcacacggtccatcattgtattatgtttcaaagggtttatttcttcctagagacttgtttggcattatgctgtggttccttcttttgtgttcatgctcctcggcggaggaacataatgtgggtgggatcatagggatttccacgccctccatctgtaattttattctatccggcaacgcaaagctacctgtatctactcgtacttagcacctgttgtatttattatttggaataataatcggcgatgagccgtttgggacgtggtgatgaataagcaaagctagacctagtttcacctttgtgtgtgattcttgtctagattcattttg

SEQ ID NO: 19 - DNA, 1530 bp, Hordeum vulgare
accgatttctcctccctcctctccatccttaaccaggaagatatcatcggcgtcggcatcgcgtagatagatagatagcgccaccggaaagttgcttttgctgctgctgctatatatctcttgcggcctgtggcatcgtggaggaggatcaattgccgctggcttaaggaaggaagagctgaattggttatccggcgagtcatccagggagctaggccaaggatatatacgtacatggaggcgccggcggccagaggaggaggagcggtggcgtccgtggtggtggtggtggtggtgatggcgatggcggcggcgacggcgcgggcgcagctgcaggtcgggtactacgacacgctgtgcccggcggcggagatcatcgtgcagcaggaggtcagcaagggggtgtccggcagccccggcaccgccgccggcctcctccggctccacttccacgactgcttcgtcaggggttgcgacgggtcggtgctggtggactcgacggcggggaaccaggcggagaaggacgcgccgcccaactcgagcctgcgggggttcgaggtgatcgacgcggccaagacgcggctggagcaggcctgctacggcgtcgtctcctgcgccgacgtgctcgccttcgccgccagagacgccctcgccctggttggcggcaactcgtaccaggtgccggcggggcgacgagacggcaacgtctcggtggccggggagaccaacgggaacctgccgccgccgaccgccaacgtgaaccagctcaaccagatcttcggctccaaaggcctcacccaggcccagatggtcgcgctctcaggggcgcacacggtggggatggcgcagtgcagctccttcagcagccggctctactcgtacgggaccagcggcgggaaggaccccagcatggacccgacctacctggccacgctcagcacgcagtgcccgcagtccggagccagccagcccgtcgccatggaccccgtcacccccaacaccttcgacaccaactactacgccaacgtcgccgccaaccgcggcctgctcgcctccgaccaggcgctgctcgccgacaacagcaccgccgcccaggtcctcggctacaccaccaaccccggcaccttccagaccgacttcgccaacgccatggtcgccatgggcgccatcggcgtgctcaccggcaacaccggcaccatcaggacaaactgcagggtcgtcggctgatcgatcgagcgtgtgattgaactgaattgtactatggagtagataggtatagtgtactgtaaactgtttggtcgatctgtactcgctagctcttagcttagcttagccccaccgtcctctctcttttctccttgatcttgcatactgtactttctttcactgcttgtgttcccttagcctctgtatgtattatctagttggaactgtatgtaatgacatgatcacatgattgggttgggtaccaatgtacccatggtgcttaataaaaagctactacagacagacgtgtgttagtctctacct

SEQ ID NO: 20 - DNA, 850 bp, Hordeum vulgare
gcccactttcgccattacccagacctcgcatctagctagttccatccaccatggccagcagcaagacgttgctcctcgccctatgcgcggcagctgcagctgcgacgctgagcccggcctccgcggcggacgacctgaccaagttcaaggtgtacttccacgacgtcctagcggggaagagcccgacggcgatccggattgcgcaggcggcatccaccaacagctcctccaccttcttcggcgcggtggtggccatagacgacccgctcaccaccagccccgccgtcacgggatccgccaaatccaaggacgaggtgggccgcgcgcaggggacctacacgttcgccgaccaggccaccttcgggctcctcatgaacatgaacttcgtgttcaccgccggggagtacaagggcagcagcctgaccatctacggccgcaacgaggtgctttcggcggtgagggagatgagcatcctcgggggcacgggcaagttccgcatggctcgcggctacgtccaggcgagcaccgtggactccggcgccaactccggcgagaccgtcgtcgagtacaccgtatacgtcaaggcggctgcggcttagcggctgctgtcgggcggaaaatattgtcatattttgcttggaataaatggacttttgcagatttgttgcgtttgttatcgtgaattcgtaatggatgatggacatttacggatttgagtgatgtctggtgtctttggtttgtggctttagtgtgatcgcttgagctctttggaagatagatctgtttggttctgcatctagtaatgtttcgttttatcacacaatattattatacatgtctaaagttagta

SEQ ID NO: 21 - DNA, 2251 bp, Hordeum vulgare
cagctcctttctcccttccgctggcgcgccttgctctgcacctcctcgccgtcgatctctgtctaccggcggacctcctcgctgtcgctgctgccgaggctgtttgttgcccacccagtagattgtgaattgcaatagacgaaacgcacattgcccacaatggctctaacgctcttacgagggatcagaacgcaaaccttatttggagcaaatgcaggcctgttctgtaccactcgacgtcatccgctagcccacttcacaactagggtggagagtgtgcagaccagtgagcccaaatcagtgcgcaaatcaattcaacaagccaccaaggaggcagcggagcacaagacacaaggttttgaagcggtgatcggcattgagacccatgtccagctctcgaccatcacaaaggcgttttgctcctgcccatacgactatggatcccagccaaacagcactgtttgccccacctgcatgggccaccccgggacattgccggttctgaacgcaaaggttgttgaatgtgctgtcaagctaggcctcgctctcaactgtgagatttccatgacatccaagtttgatcgaaagcagtacttctatccagaccttcccaagggataccagatttcgcagtttgacattccgattgctgagaagggttaccttgatttggatattccaatggagtttggtggtggtcacaggcgatttggggtcacgcgggttcacatggaagaagatgctggcaagctgcttcactctgaatcagggagtttttctcaggttgacctaaatagagccggcgtccctttgctagagattgtctcagagccagatatgaggacaggcatagaggctgctgagtatggtgctgagatacaaagggttgttagatacctgggagtgggcaatggcaacatgcaggaaggttccctccgctgtgatgtgaatgtatctgtccggcctattggacaatcagaattcggtacaaaggttgaaataaagaatatgaactcattttctgaaataagtagggcaatagattatgagatatcccgacagattcttcttcacaaagaaagccaggctgacaaaattgtacaagaaacccgtctatgggatgaatcttctcagaaaacttttacaatgcggaaaaaggagggacttgccgactacagatattttcctgagcctgatcttcctgaagttgttctgactagtgagtacattgatgaaattcgtaattcaatgccggagcttccagaggcaaagcgtaggcgttatgagaacatggggctcagcatgcaagatgttattttccttgctaatgacgatattgttgctcatttcttcgattctacacttgagcgtggtgctgatgcaaagctggctgctaattggatcatgggtgacattacggcttatctgaagaatgaaaagctctctattgatgaaattaaattaacacctcttgagctttctgaactgattgcattcataaagaatggtactatcagtgggaagattggcaaggagattcttgttgagctcattactaaaggcggaactgtcaagtcggtgatagaggagaaagatttggttcagatagcagatccagcagcaattgaggccatggtagataaagtactcgccgagaatccaaagcaacttgagcagtatcgggctgggaaaaccaagttgcagggatttttcgctgggcaggtgatgaaagcatcgaaaggtaaagcaagtcctgttttattgaacaaaatcctcggggagaagttgaagggtaattaaaattgccgaggtgtttcggcacagagagaatatcttgcccttgatgagtgaaccatcagattacaactaaagtgaaaccccgtagcagaatcacattcttttgtaaaaacacttacttggagtttggagtgttgattacctttcgctctcttttcactacagagtggattttggaaaagcaatccagttcacatgacacaaagatgaaggatatgcatggtatgtgtttgagctgataatagactggaatggtgtggtgtgcagatgaatcagttgcgtatgcttacatgtttttactcgtcgtcttttttgcatttgatcttatgcagctgtaaactcatttgtaaattggatacatcagtatcatgaatgcggctgtacttattgaagtattattaagtttagtcattgagttgttccagcgttagcatatcaaaaaaaaaaaaaaaaa

SEQ ID NO: 22 - DNA, 1498 bp, Hordeum vulgare
aattccagatcgccgcggggacgcgcaaacgaaacacacgcgcccctctctcccgcggcgcccgtttcaccgtagagagaatccctcctcctcctccctcgccgccgcggcattcccccgagcaccctccgcgcgttgcgcgagcgcggcagccatgggctcgctcccggtgctctccctgccggaatgcgcggcgcctccgcaggagggggcgcgggcgacggtagcggcgccggacctggctgcgctcttccgcgcgcagcggcgccacctcgaccacttcttcgaccggctcgacatgccgcaggcggcggcgttcgcgcaggcgctgctggacgcgcccggggccgtcttcttcacgggcgtcggcaagtccggcatcgtggcgcgcaagctggcgcagacgctcgcctccctcggcttcgcgcgcgccgggttcctctcccccgtcgacgcgctccacggcgacatcggctccctcttccccggggacgtcctcgtgctgctctccaagtccggggcatccgacgagctgctcgcgctcgtgccatgcgcgcgcgccaagggcgcgcgcctcatctccctcacctccgcggcatccggcgcagactgcccgctcgccgccgcatgcgacctcaacgtgcacctcccgctgcagggggaggtctgccccttcggcctcgcgcccgtcacctccaccgccatacagatggtcttcggcgacaccgtcgtcgccgccatcatggaggcgcgccgcctcaccagggaccagtacgcggccaaccaccccgccgggaaaatcggaaagaccctcatcttcaaggttaaggatgtcatgaagaaacaaaatgatcttccattgtgcaaggagggagatatgataatggatcaacttactgagctcactagtaaaggttgtggctgtcttcttgtggttgatgatgagtatcatttgattggaactttcaccgacggagacctccggcgtacactcaaggcaagcgggccagctattttcagtctaacagttggagagatgtgcaacaggaacccaaggacaatcaccgcgggtgcaatggcggttgaagccatggagaagatggagtcgcccccttcacctgtgcagttcctgcctgtcgtcgatgacaagaacgttgtgtctgggatcattacactgcatggtttggtctctgctggattgtaactggttctttgtgtgtagcctgccccggttcttcgtgtttctttgtgtgtagcctgccccggtttttcgtggttctttgtgcctgcttggtcctcccaagacatcagataaattcttgtgaatctgatcggcatcatcttatcgctgttgtagcatctgtagtctagatatgtggagattatgtgttcgaaggcacactaccagtatcatcccatagcccctctatagtgtttttgttaagaggaatatgtgggaccttgttcaagcagggttgaggttaaataaatcttaagt

SEQ ID NO: 23 - DNA, 618 bp, Hordeum vulgare
ctttccaattgaccagtcgcctgcctccgcccccttcgcgaagtttccccgctccacaattccgccatggccggcggcggcatcttcagcagggcgctgagctacgtcgtcaacgagttcctcgtggagggcctcgcaaacaaccgtgccttccagaggtttgctgtgaggaccaacaagactttggagaatctctcaaccaaagctaaacaagtgagggaggaggtgtcggagcaatttaaggatgctcgcggacccgatgatcgcttcaagcagtgatacctgctatcagcgctcctggttgtctgttcttgttctggttttggatgccatccgcaagcgtccattgtataaaatccggatctaaattatcttattttctatttagaaattgagaactagaggcagagcactgttagatttctgtagcctgcccaacggaactaattctagaggagagactctccttggctgggccttggttttacaaatttctatgatgcttaatgttgttttatgagtaatgccatgtaccattcgcagtctatctgttgttatgcccttgcttggcaaatctgtgtaactgactgcgttcataacctggaaagtttttgacgc

SEQ ID NO: 24 - DNA, 1196 bp, Hordeum vulgare
taacgcgactgcctgttcttccccaataatgcgcggcatcgcctccgctggaacgctccaccccaggccatctgcggctgtccgatcaaaatccaacgcggcagaccgccccaccctccacctccggcggtcaccggaaaactctctgccgtccatccgccgcagcggccgcctcatgcctcctcttaccgcggccgccctggccaccagcagcggcgccgaatccttcagcgagctggcctctgccgacgatttcgcggccatcgcatctcccgacggccacatctccgtcatcggcttcggctcccttctctccgagcggagcgcgaggagcacgttcccggagctggaggggttccgtgtggcggcgctgcgcgggttccggcgcgtcttcgcccacgccgccccaatattcttcgagcgcggcatcgccattgaggccactaaggagttctcaagcttaagcgtggagcactgcgagggcgaaatgatagttgtcactgtgtttgaaatcaaggaggaggaggtgccagcattcattgagagggagctcgagttcagatttcttgcggtggtccctgaagggctggacggagtgccttttccaaatcaagctgttgtctgtgcacgctatagtgatgaagagtatttccgagtgagatgcaaaggaagcaaagagatatataatcagcactatggacgatacaacattgataaaatatggagggatgatattttgccctgtcgtctatatctcaggcactgtgttcttgccgccaagaatctgggagaagcagcatatagcaacttcttggaccacacctatctgggtgaccggagaaccacgataagggaatacttggccacgaccggagctggcatcatggaagaggagccaccggagatgctaaaaagccgctatggcggctaactcgacgacgactctcagggccacggccatcacaaattgaaattctcacttgtgtgactgctgcctacgaaatcggcagtcagatatgaacggggttgcgccaaataatgcatgatgctgcagtgcagaatatctaagattgcgattgttttccgcgcaaattattggcgccaaacgctgtgatctgtgatcctgttttgattgatgtacactgctaaggcaataattgtgactatttcccatcataacatgaggacgaaatgca

SEQ ID NO: 25 - DNA, 700 bp, Hordeum vulgare
acattattccgcttaccacatttccatctataaaagcccttccaacctctggcactcccttctcagttacaaggcgttcagaggcagccgccaaacacacacagacatacatgggatccttgggccctgccgtgagcgtgagcatggccaaggccagcggcggcacggcggccgtcggcggccagcagcagcagcagccggagcgcggcgcgttcagctgcggcttccggatgccgctgcactacccgcggtacaggaaggcggactacgaggcgatgccggagtggcgcgtcgactgcctgctccgggagtacggcctccccgtcgccggcgacgtcgaggacaagaggaggttcgccatgggcgccttcctctggcccggccagtactgatccaccatcttacatctcgccactcggagcagatcaggccggtcagcaagccagcgcctggcagaggctgatcagcaatggcagaagcaacatcacgtacatccatccccatgtatgaacaaaagagagcttgtgacgatattatattcttatatctatcattctaatagtaatctccaattctctccgtagagaatacatatgatgtttcttggagtatatgtaagcagtggaagaaggacttgtttctgatattcatacgtgtaatgtagtgcttcttaggtaccgtgcgaccttgatcgtttggc

SEQ ID NO: 26 - DNA, 2082 bp, Hordeum vulgare
gatctcctccgccttcctttggccccttgcgtctcgcgtcggcctcttaacggccgctcggcctcacgccagcgccgggctgtacctttcgctcgcctccgcctccatgcagcaccgctcgccggcggcggccacggcctccggagctgcctccactgcggccgccatggcgccaggcgtcagcggcgtcgagcctgcggtgacgctcgaccaggtgccgcgctggagcgaccccgaccagcgcctgtacacgccgtcctcctcgcccgccgccgctgatgccgcggacgggggatccgagcccgcagcgtccgccttcctctccttctccgacccgctaaccggcgacgacggcggcgccgccggtggtggccgcgcgggtgcctcgcgcttccccgtggaccacgagatcaactccaggatctacctctggcggggacacccctggaacatggaggtcgatgccgtcgtcaactccaccaacgagagcttggacgaggcgcacagtagtcctgggctgcactctgcagcaggttcagggctcgccgaggagtgcgccaccttgggagggtgccgaactgggatggcaaagatgaccaatgcatacgatcttcctgcgaggaaggtcatccatacagtgggacccaaatatgctgtcaagtatcacacagctgcggaaaatgcacttagtcattgctatcggtcatgtttggaactactcattgaggacggccttgaaagcatcgcaatgggttgcatatacacggaagctaaaaactatcctcgtgaaccagctgcccatgtggcaataaggactgttagacgttttctggagaaacagaaaggcaagatagctggtgttattttttgtattacatcatcatctgatacagagatatacaaaagattgcttccgctatatttccctcgggacaagcaagaggaagagactgcggtatcaaaacttccagctgatgtcggagatgagaatggtgaaactgtaatagatgaaaggaaaataagaataagacctttgcctgctggtgcagcagatagaacagtgcctgcagctcctcttgatcttcctgttgagtctggattggcatcaagcaggaatgcattcaaattggattcgtatttggacccttcatttatgtcattaattaaagacccagatgtgcggcgcaaggagcagtgggaaaaatcttctcaagctcaaaagggatttaattatgctaggttgcttggatatggtgatataggtttccctccattgtctgctgccgaggaatattcacttcattcacgataccttgcaaaagcaaattcccttaatctttcagagatcgctgagatgaaaataatctatcgtggtggagttgatagtgaagggcgcccagttatggttgttgttggtgcacactttcttcttcgctgcctggatcttgaacggtttgttctacatgtagtgaaggagtttgaacctttgattcagaagccgtatactattgtctatctccactcagcagcatcattacaaccgcaaccagatttaggatttatgaaacggatacaacaaatattaggtcggaaacaccagcggaaccttcatgggatttatatgctccacccaaccttggggttgagaacagctattctggggatgcagcttttaattgatggagaggtatggaagaaagttgtgtatgttgacaggctcgtgcaactgttcagatatgttccacgcgaacaattaactattccagattttgtctttcagcatgatttggaggtgaatggtggtaggggcatgattgtggacccaagaacaaaacatatctatcagagaccatctggttgattcatgtcatctatgcagtccaaagctcacacttgccttttcaagtctttgtataattactcctttgttgatatttctcttttccctttgtaactagtttaggagttctattcctttcattcgttcctcagccttcagggaaggggattattgtttgtatatgttaatttctacagctgaaataaagtggcgtctcagtgctcattggttcaagttctaac

SEQ ID NO: 27 - DNA, 1320 bp, Hordeum vulgare
atccacacgaagttgcaaagcaacagctagcgcacatcggaagcagcagcagccatgaagctctgcttctgcctcgccgttgtgaccctggccgcgcttctctcgtccgaggccgtggtcgcctgcatcgacgtgggcttctacgacaggacctgcccgtccgccgagaccctggtgcagcagaccgtggccgccgccttcggcaacgactccggcgtcgccccggccatcatccgcctccacttccacgactgcttcgtcaagggctgcgacggctccgtgctgatcgactccacgcctggcaacaaggcggagaaggactcggggcccaacttccccagcctccgcttctttgacgtggtggaccgcgccaaggcggccctcgaggcgcaatgccccggcgtcgtctcctgcgccgacgtcctcgccttcgcggctcgggacagcgtcgttctgtcgggcggcctcgggtaccaggtgcccgcagggcggcgggacggccgcgtgtccaccgaagcggacgcgctcaacaacctgcccggaccaacgtccaccgcctccgacctggtcgccggcttcgccgccaagaacctcaccgtcgaggacatcgtcgtcctctccggcgcccacaccatcggcgtctcccactgcagcagcttcaccgagaggatctacaacttcccaaacacaaccgatgggattgatccgaagctgagcaaggcgtacgcgttcttgctcaagggcatctgcccgcccaacagcaaccagacgttcccgacgacgacgaccctcatggacctcatcacgccgacgaggttcgacaacaagtactacgtggggctgaccaacaacctggggctcttccagtcggacgcggcgctgctgaccaacgccaccatgaagtcgctggtcgactccttcgtgcgcagcgaggcggcgttccggaccaggttcgccaggtccatgctcaagatggggcagatcgaggtgctctccggggcacagggcgagatcaggcgcaactgcagggtcatcaaccctaccaacgccactagtgccggcgccgttcaccatcatcttctcccgggatcatcaggttcttcaggatccaaccaggtggctgcaagctgattagttggtggtcactagagatatgtgtacgtgcagtgtgcatgaggtcgagtgctctagtgatgcaataaattatctgatgttttgtctgatcgatcgtctgtactacaatttgcgagcgtttgaaatgaagcagtcccaaaatgttcctaccacaattaagcatattcggtttctcaagttacacca

SEQ ID NO: 28 - DNA, 3688 bp, Hordeum vulgare
ggggggacaggtgaggtgaggcatggccgccagcgccagggtgcctgatcttggctccgactttgctcagaagatgctgcaggacctccgccgacgccgcgagaggctcggcttcggctcgccgtcggcgcagcagcagcagcgcacggcgtccaccgccgccgccaccgccaccgcgtctcgggatgcttgctcgaattctcagaggccagctcccagccagaggccgcagcaggcagctgctgcccctcgatcgactaggccagaagcaacgacgacaccgagacaacccagcaccagcaatgccgtccttgccagcgccgccaggccacggcgagtgcgccctgtcgccgccgccgacgccgacgcgcgcgccatcgtgccgttccagggaggaggaggaggcgcgggcggcggcaagccggagcatgcggtcgtcgcgagcggtgtcgacgtgcagatggccgcgctggccctcgcgctgagcgacggagggaagctccgaaacatcgaggtcgtggcgcgcaacggctccgtcttcttccggcagccggacgcggcccgtctgggcgttggcggcggcggcggctacctcctgccgccgccgccttctggaggagatacaggcgcgcacgctgccgaagtggcgatcggggtgcagggcctgaacgacatgctcatggccgcgtattcttccggtgggaggaggaggcccgacgacgaggcccggaagaagctcttcagagggtccatggacatggaggaggcgctgagcatgctggtcatggtccaggacgcctccaggtacatggaagggtccgggagcgggctcaaggggaaggagaaccgcaagagctcgccggcggcgcgctccgccaggatcgaggagatcgtcgacgaagattctgatgctgagcacggcaaacatgcttccatgcagatggttgtccacgacaaatttcagagccatgagagtgcagacagtaggtcagttattcagtctagtccaggcagctccaagatcaacagtgcttctggaggtgaaaaggatggctcaaaagtgaggatgcccagcgtgatcgccaagctgatggggctggagaacctgccgtcgtcgacgacgacgacgaccgccgcggagcgcaaggggacggagaggtttgtgaaacccggagccgcggcgccaagaatggaggtcagaggaaacgcgatggaccgcaaattgccgatacggatcatcgcttcagagaaggggcagcacaagattgtgttggcaggggagtggaagaatggcatgacaaactttggggagtctgaaatgggtgctgctgcactgtcgaacagttcatcacaccctgcaactggtaatagcaagcaaggaaggctaaccatgagggaggtgctgagaaagatggtggcagcagagagaggagccgatgaaagacaggtagctgatgagaggatcatccatgaggacaagactgctgccgaagaaatcaagctgcagaactccgtcgatgtcgggtgccgtgccgattcgggtaagaggatggattttctgaaaagattcaggaagaattcagacaacagacctgtcaaggaagagaagcagactgctcaagtgaagaatgcagaagttggaaagaagcaggccactggcatgagacggttgctggggagagacggcgaggcgaaatcgaggaaggcgagggagaaggttaacaaggagaaccttgccactgcagaaaccaaggctgcaggaaagaatgtgaaggctgatcagatgagaaagcaagcacagagtaaacatgtagagagacagatcacggcgaggaaaccacagaatcgccgggaaacacagagggaaacgcctagccggaagactgaaaacaagaagtcggtgatgtcagaagcaggacatatgagaaagaagcctgagtacaatctagtgacacaacaggataatgaagaacatgcaaaagaacatgacagttttagcaaaccagcagatagcacacatggcgaaggcggtttgtcggaaccattggcgattgtagtgagaagcagcagcatagctggggcagcttccttggaccaaccattacagaaaataactgaagggtctactgagaaagcaactgaaacaccgagggaaccgcagaattgtcggggaacgcagagcgaaacaccgagccggaagttggaaaacaagaagttaccgttgtcagaagcaggacatatgagaaagaaccttgagtatactgtagtggcacaacatgagaatgaaggagatgcaaatgtaaattgtactatcagttctagcaaaccagcagatagcacgaatggcgaaggcggtttgtgggaaccatcgacaatggtagtgagagacagcaccacagccgaagcagcttctttggacaaacctttgcagaaaataactgaaggaactagtgatcctacagttcctgctgagagtgttgtacaggcaagtgaggatttgaagttcctggatcagagcgcaagtgctgagataaatgatgaaagaatcaaccacacaccgagtgagactacacagatacctgaaatatttgccgaggaagaacaacaacaagagcaagaaatgatagtgaaagagcaactaaccgaggatttgaagttcttggatcagagtacgattcctgagacaaatgatgaacagatcaaccacacacctgatgaggcgacagaaatacctgaaacatttgccgaggaagaacaacagcagcaacaacaagaacgagaccaacaaatgatagtgataccggaaactttttccgagatggaggaacaacagcaacaaatgatagtgaaagagcaactaacggacggctcggatcacaccacagcgtccatcagttctgaaaatttgcagcaggatcaggagacgcatgtcgttacatgcgattctttgacagagaaccagctgctgctcatgagactgctggtaaaggatcggtacttgctcgaaaccgcaaagtcgatcgtcagagttgatgcccccgtcagtttcatggacgacgtcgccagcgcgccgaactggtcggacaagggcaacgaactcctctccgacgtggcccgggaggtgaccagaaggaaaggcaaacggagcgaggccatggaggaggtcagcgtggcgcgcgccaccaacccgaggctgcgatacctcgacgaccttgtcagagagctcgacggcgacgtcgagagcctggacatgtccaagtccaagagtgctcggcatcacggcgacaatggcgcggccgagaacctgcgtaggatactcgagggtgacattcagaatgagcaccccgacgccaactcgacgtgggatttcgggtggaaccgcgtgtgggagctgccgttggagaaggccgacgtcgtcagggatctggagaagaacatactgggcggcatcatcaccgacgtggcgagggatctcatcggagtatcggtgcggcatggctgttgtccctgcgtggcttgagtggagcggtggaggtggagtgcggcagcaggagatgagacttttagaatggtcgagctcactgggttaggataattttttgatctgcaccacgtgtattcgctgtaagtaattgctgtgaggtttcagtgtataaagaaatgtttgtgtgctcgtgtattttttact

SEQ ID NO: 29 - DNA, 2361 bp, Hordeum vulgare
atatccaaagcaaaagagaggggccgcgtcgctttgggctcgttccttcgcgatggcggcggtggcggacgcggccacggccatgaccatcgacttcctccgcgcgcgcctcctctccgagcgctccgtctcccgcgcagccaaggaccgcgccgaccagctcgccaaccgggtcgcggagctggaggagcagctccggtcggtgacggcccaacggcgggaggcggagcgggccgccgcggaggtgctcgccatcctcgactcccagggcttttccgacgccgcagattccggctcggacgacgacgcctgcggcccacccgaggcccccgaccacgggaccggcggccaggcgcgcggtgaggcggaggacgcgctgtcgggctcggagctgggaggcccgccccagcccgggggcctctcctggaagggccgcgccgcgagccccggcgcggacaggcggcatccgcatctcaaagccaggcagcggtatggccatggccacaggaggagctacttttacttgctcgccgcggattcctcgcccaagtaccagccgggccagtcctgccggaagatcaggagaaaggagccgagattgcacactgaaggtggggatgccaaggacaatgctgccgagggtctcgaggaggaccaggcaaaatctgactctactgtttgcacggatgagaagcttgatttggacggtgaggttggtcacggcgggcgaggttcttgtggtgatggaagggttgaggatgacggtgggaggtacgcaatggaggatgtgaaggatggggagatggagagagtcctcgagaatcatgctgcgctgattgggcagtatgaggcacaagaaaatgctcagagggagtgggagaagaaatttaatgggagccgggattcaacttcggatgatgtcgaccgagacagtaagttaaatcagaatgaaaaggcttgtgaacagaggggcagagctgctcagattatggatagagaagtagttggtgaagagacaccgtcaagggataaagatctctctggaaccaacagtccttccgaatgtttgttgaatgtatctgcctttggcttgtccacaaatgctccaaacgtaagtgttattgggaagtgcaaaggatctgataatgatttcgagcgggttactgcagcagttgctacacttgatgaattgcattccaggaaggatgagttagtacataaaatttatactgaaattattgaagggggtgggagtaatcgtggaagatcagcttcttcaccacaaaaaagccatagtagcagcccaactgcaggacacaatgaaggtcaaggagatggcaattcagacaatggttcaagctaccatgtgaatgcttgctcttatgagcactacggaacctcaccatcacctggaagtcctttgagtgatacccctaaaagcaaagtgtctgaatggagctcgtcatgcttccataaccatattgataaccagattgacatgcagccatcctcaagtgatgatgtgggaggtgttctaaaggcccttcaacgggccaagatgtccctcagggaaaagctgagcagggcaagtccacccaggcaagacatgttggcactaccagcacccgaggatcactacacagatgatgattcacaggccaatgatacagaattttcactttgcatgtcacaacgacttagccatgaaatattggcactgccagtatcaggagaatacctaagcaggatcagttggccaggcgatgatgcaaaaataccagttggccctgctggcttgttccggttgccaacagactcgtttccccaaaacgaggtgtgctccgctgatggctatggctcaaggttcagtttggcatcaagtcggcagaccgtcttttcaggaaaccctgctagtaatagcatgttaacttcatctcgtccgcagtatggttctggtttctcaccggatccgtattacgatcttcatagttcaatgttactgtcaatgcctacaacaaggaatgcttctttcatcccagaaattctaagatctagtgatgattcgagaaggggaatgtcttctggtgatgcaggcatgctgtcccagtatggtaatgcttatgattagtagctggagtgtagtagtaatgtatggttagaatcccaaaatagcttttgaggtagatgctatctgttgcgtcagttcttcgtgtgtcatgttgtattactatccaagaataaattttgtttgtaagcagtgtaggcttctgtcttatgccctcacgaggcaatacaaattggtactgataaggatgcgtgcaatgttttattgctatccaagaatagtaaagttgacatggc

SEQ ID NO: 30 - DNA, 2262 bp, Hordeum vulgare
ggcaagctttactgtcactcaaaagcagggagagagagagagacataaggggaaaaaaaggatgcatggtctgtggaggtgcggtggttgcttcgagcctctgcaatattttgcgacggccgttcggtgcgctgctttcgagctgcttcgccgtgatcccgatggccgaccttcccccctttatataccgccggccgccgcgatccctcctccatctcaccgcaccaccgcaccacctgccaccgacgagaagcatagtcctcctcgtcctcttagcgccatggcctgcagctgcgctcacggggtggagttcgacgccaacgtgatccggaacagcgcgctggaggacgggctcgccgggtgggcggcggtaggcgcgtgcacggagctgtcggtgcgccatgaggagccggccagggtgcccacggagaccatcaacgacgtggaggacgggtacaggccgagcggcaggtacattctcgcggcgggccgcggcggcgaggaggacggcctctgccaggccatccccgccggcgcgctcaagcccagggtcacgtaccgggtggccgggtggatcggcctcggcgacggcgccgccggggagcacgcggtgcgcgtcaacattcgtttggacggcggcgagggcggggagtgcgcgatggtggtcgagggcggcgcggtgtgcgccgaggccggcaggtggacggagatcaagggcgtgttccggctcaaagccagcccgccgtccggcgccgcggtgcacgtccagggcgcgccccccggcgtcgacgtcaaggtgatggatctccaggtgttcgccacggaccgcaaggcccgcttcaagaagctcaggaagaagactgacaaggtgcggaggcgggacgtggtgctcaagtttgccggcgccggggcgtcgtcggcggtgtcgggggcgtcgatccgggtgatgcagatggacacgagcttcgcgttcggcgcgtgcatcaacccggcggtgatccaggagccggcgttcgtggactacttcaccaagcacttcgactgggcggtgttcgagaacgagctcaagtggtaccacacggaggcggtgcaggggcagctcaactacgccgaccccgacgcgctgctcgacttctgcgaccggcacggcaagccggtgcgcgggcactgcatcttctgggccgtcgaccgcatggtgcagaagtgggtcaaggacctgcccaacgaccagctcgccgccgccgtccagggccgcctcaccagcctcctcacccgctacgccggccggttcccgcactacgacgtcaacaacgagatgctccacggcaccttcttccaggaccgcctcggcgacgacatcaacgccttcatgttcaaggagacggccaggatcgaccccggcgccgccctcttcgtcaacgactacaacgtcgagggcggcagcgaccccagcgccaccccggacaagtacatcgcgcaggtcaacgcgctcatggagaagggcgcccccgtcggcggcatcggcctgcagggccacgtcaccaaccccgccggcgagatcatctgcgacgcgctcgacaagctcgccaccaccgacctgcccgtctggctcaccgagctcgacgtgtgcgagtccgacgtctgcctgcgcgccgaggacctcgaggtggtgctccgggaggcgtacgcgcacccggccgtcgagggcgtcgtgctctgggggttcatgcaggggcacatgtggcgccaggacgcctgcctcgtcaacgccgacggcaccatcaacgacgccggccagaggttcatcaacctgcggcaggagtggacgtcgcacgcgcgcgggaagatcgacagcgacggcaacttcaagttcagagggtaccacggctcgtacgtcgtgcagctcgccacggccacggggaagatgcacaaggccttcagcgtcgacaagggggacacacctctcgtgctggacatggacgtgtgacaacggttacctactacggctattatctccgagtatatatatatatatagttatactatatatactccttggtatactaactaatactctacacacatacaagcacacattgattaatttgatctaatggggtcggcaaagggattgtaccacatactacaacaactagtatagttttgcgtttctacgtttgggtatatattgtactgttgagagattgtaatcaaggtactgtattggttaaaattaatggaaatgaatgaataaaattaacg

SEQ ID NO: 31 - DNA, 1384 bp, Brassica napus
tggtagctggcggtacggtccggaatcccgggtcgaccccgcgtccgaatactaaggagagtcatgcggatggaaacacaaggcaaagttatcacttgcagagcggctgtggcatggggagcaggagaagctctagtgatggaggatgtaaaagtggatcctcctcagagattggaagttagactacgaatcctcttcacttccatctgtcacactgatcttagcgcatggaaaggcgagaacgaggctcagcaagcataccctcgaatccttggtcatgaggctgcaggaatagtggagagcgtaggggaaggagtggaagatatgaaggcaggggatcatgtgctccctattttcaccggagaatgtggtgattgcagagtctgcaaacgagacggagccaatctttgcgagaggttccgagtggatccaatgaagaaagtgatggtaggtgatgggaagaccagattcttcaccagcaaagacaacaagcccatctaccattttcttaacacatccaccttctccgagtacacggtcatagactcggcctgtgtggtgaaggtggaccctcggtttcctctagagaagatgagcctcctcagctgcggtgtctcaactggagtgggtgcggcctggaacgtggctgatattcagcctggctccaccgtcgctatctttgggctgggcgctgttgggcttgcggtagctgagggtgcaagagcaaagggggcctcaaaaatcattgggatcgacgtcaaccctgacaagttcccattagggagagaagtggggatcaatgagttcataaacccaaaggagagtgacaagacggttcacgagagggtgatggagataactgagggaggagttgagtacagcttcgagtgtgcgggaagaattgaagcacttcgagaagcttttttatctacaaactcgggagtgggagtgacagtgttgcttggcgttcacgcaagcccacagcttctacctatccatcccatggagctcttccaaggcagatcaatcactgcctctgtttttggaggtttcaaacccaaaacacagttgcctcttctcttcacacagtgcctcgaaggtcagctcaatctagacctcttcatctctcaccagcttcctttcagtgatattaacgaagctatgcagctcctacatcagggcaaggctctccgttgtcttctccgcctctgatcatctctttcatatttcatgtgtttacaagttgtggtgatgattttattacacaagttaagttgtggtgatgatgatttgattatggtttcctgctgtattacctttgttgggtccacctccattcctacacttaattgtccttttggtcacaatacttcataaatgcgag

SEQ ID NO: 32 - DNA, 1876 bp, Gossypium hirsutum
ttgttttcttcattacacacctagctgggttagtttctattttctctgtagtttccactacaacgataagcaagcgtttcattcaaatcatctttcatttcacgaccagattgcccggccctacttcactgatcctccattggcttacccattgtaaaaatcttcgacgctattatcgaatctttttattctttttactctacagtctacagtcccaacgtttgaagttaagtcacgcatctctcttccttaaatctctgtacatcgctcttcacttcttcttagaacccctcaaaaggactgcctcaaacaaggaagtcaatgtcgttttctgagttcaggccactagacgagaactccctcatcgaatacattaaagccacgccgtctttgtcatcgaagatcggccacaactatgatggtttaaagattaaggaagttggagatggcaatcttaatttcgtctacatcatcgttggcccttctggttcttttgtaatcaagcaggcacttccctacatacgatgtattggggaatcttggcccatgactaaggaacgagcatatttcgaagcggtggcgttaaaacaacatggtgggttatgccctgaacatgttcctgaagtttatcactttgaccgtaccatgtccttgattggaatgcgatatttagagccgccccatataatcctgagaaaagggttaattgctgggattgaatatcctttgttggcggaacatatgtcagaatacatggccaagactcttttctgcacatctctcctatatcagtcaaccacagagcacaaacgtgcagttgctgaattttgtgggaatgtggaactatgcaggctcactgagcaggttgttttttctgacccctataaagtatctgaatataaccgttggacttcaccttatcttgaccgtgatgccgagactgtccgggaggataatctattgaaaattgaagtagctgaattgaaatctaagttctgtgaaagagctcaggctcttatacatggagatctccatactggttctgtaatggttacccctgattcaactcaggtcatagatccagagtttgcgttttatggaccaatgggatttgatattggtgcttttgttggaaacttgattctggctttctttgcacaagatggacatgctggtcaagggaatgacagaaaatcatacaaagagtggatattgaagacaattgaggatacttggaatcttttccaccaaaagtttaccgcactatgggacgaacacaaaaatggctctggggaggcttatcttcctgcaatttataacaatcctgagcttcagaaacttatacaggaaaagtatatgaaggaattgttccacgatactcttgggtttggtgctgctaagatgataaggagaattgtaggtgttgctcatgttgaggattttgaatcaattaaagaagctaacataagagcagattgcgagcgacgggctcttgaattaggcaagacacttctaaagaggaggcgagagtttgtgtctattagtgaagttatttcagccatgaagcacgtctaatcatgatggaaatgatggaaactgctgtgcacgtatccataaaacttttgcgcttaaatagatggaaggttttacaggatccataatttaataaagttttcatggtcctttaggcataagcctttgattgtgtgttaatgagcaaaggttcctgtctatctaacatagtgctggactggactggtgttgttgcaaaacacgattatgttttgattgtcttgattattctgaatgttacacttgactttgggcaatacagattgcatcggaagttaaatcaatgaagctttcaaatgaattt

SEQ ID NO: 33 - DNA, 1875 bp, Setaria italica
gtctcgtgcttcgcattgcaaccaatccaaaacggcaataaccctccctcccagactcccagtcccagagaagatcattcagccatcagcgcttcttcagcgggagggaagacgagacgaggcgtaaacgtaacctcgcctcccccacatggcctgggcgcgcctcgcctcccgctcccgtctccgcccagccgcctcctccgccgtcagccgagccccacgcgcctcgccgccggctccgcctccgcctccgcaggcgggacacgcggcccgcgccgcaccgcccctccggaggctcctccgtctccctcaactccattccgccgccgcggcgtcctcggcgtcgcacgcgcggcggctcggcgaccgatggcagcgcctgggggtagcgaggaggtggctcagcgacgcatccgcggcggcggaggcggcggagctggtggaggtgccactggcgcagactggggaaggcatcgccgagtgcgagctgctgcgctggttcgtgaacgagggtgaccaagtagatgaattccagccactctgtgaagtacagagtgacaaagcaactattgagataacaagtcgtttcaagggaaaagtacatcagattcactttggccctggtgacatagtgaaggttggtgaaactttattgaaaatgattgtgggtgacagccaaattgtatctccagataatatatttccatccgctgataagtcacttgaagaagagcctgcagttccttcaagtgaaggcaatattcctagtggaactctctctacaccagctgttagacatctagcaaagcagtatgggctcaacataaatgaaatcgttggaacaggtaaagatggtagggttttgaaagaagatgtgttgaattatgctgtcagcaagggtctttacaaagaacaatcgtcatctttggaagagaacattggtctaattgacttactggaggaagggaaatcattacctgatgtacccttctatgaagataagaagattcttctcaggggataccagagagcaatggtcaaatcaatgagcctggctgccaaagttccacattttcattatctggaggaaataaattgtgattctcttgtaaaactgaagaaagcatttcaaaatgagaataaagataatactatcaagcacactttccttccgttcctcataaagtcactctctatggcactgaataaatatcctatgttgaacagctctttcattgaggaaaccaatgaagttattttgaaaggatcccacaacattgggatagcaatggctacagcacatggtttagtcgtgccaaacatcaagaaagtgcagtcactatcaatattggagatcacaaaggaattggcgcgattgcatgagatggcatcacacaacaggctaagcgctgcagatattgaagatggcaccataacacttagcaacataggcgccattggtggcaagttcggctctccacttctgaacctgcctgaagttgccatcattgccctcgggcgcattcagaagcttcctcgctttgatgatgacgaaaacgtttacccttcatccataatcaatgttactgttggagccgatcaccgagttgttgatggggccacggttgcaagattctgtaatgagtggaagggcctcgtggaggagccagagctgctcttgctgcatatgcgatgatccagtaagatacctgatgcgagggattgctcaaaatttctgaagataagttgaaatggaggcattccggcatcgcaacttcacaccgaaagactattgcgaattgcgagtcacttgcgtttgtatacaaattaataatcagcgcagcttctcccctgcaaatagggatcgcatcctgt

SEQ ID NO: 34 - DNA, 1059 bp, Setaria italica
tgcccatctcgctcgcgtgaccccgtcggcttcctcctccccgccccgaccccgccgtgcaccagcggagctcgctgccgctgcccgccccgctgagaggcccgatccctgatccgcacgctgtgagcagtggtaccaagggattagcgatggcgaggcggcggccggcggtgctgctgctggtagtcgtggcgctggcggcggtcctgtcggcggcgcgatgggcggacgcgctgtcggtgacggtgaccgacaccgagtgcatccacgagtttgtgccctacgagggcgacaccgtgtccgggaacttcgtcgtcgtcgaccacgatatcttctggagctccgaccaccccggcatcgacctcacggtaacttcaccaggtggcaatactgtacatacgttgaaggggaaatctggtgaaaaatttgagtttaaagctccaaggggtggcatgtacaagttttgcttccataacccatatggagcacctgaaactgtttctttctacattcatgtcgggcacatacccaatgagcacaatttggcaaaagatgagcacttggaccccattaatgttaaaattgcagagctgaaggaagcattagagtccgtcactgctgagcagaagtacctaaaagcacgtgaagctcgtcaccgacacacaaatgagagcaccagaaagcgtgtcatgttctacacaatggcggagtaccttgctttcatggcagctagcgctttgcaagtcgtctacatccgccgcttgttcagtaaaaatgtggcatacaacagagtgtaggatacaactctactttgaaggcgtcagtggaagcagcatgtggctggaagggcaaaaaggttctctgtcaatttgacaaattgtagctctgcaccctcttttcttcttttgttagtctataagcaacacttttttaatttaatcttgtacctttagcaactcttgtgagatgtgaagtgcatttgttgtgaacatagatccataattaatcttcagaggatcatcgagaatgctgtcgccctgttacagattttgattctat

SEQ ID NO: 35 - DNA, 1752 bp, Setaria italica
cacaagtaatcatccgaaagcagaaatccccggatcgggaagggattggcaggcgtgggggccgcgtcacccgttcacccgctccattggacggacagcgacagccagagccagagcctcctccagtctccacatccccgcctcccctcccttcccgcgccgcgaatgcttgcaaggcacctaacctaaccaggacctggtttagtggagtggtgacttgccgtcgcgtcgcgtaccactgccgctattatatatcggccgtcagtgtcccccggcctagcccgatcgcggcatctcgttttcagtttgattcgagtgccggggaggggggcgatcgatggcgaagggcaacggcgctgccatggccgccgcggcggtcctcgccctggccgcgctcctgtgttcgccggccgccggggagctggcccggctggagcacacggccaagaacggcgggtcgctcagcctcctcgtcgtcggcgactggggacgcaagggcacgtacaaccaatccagggtcgccgagcagatggggaaagtcggtgagcagctcgacatcgacttcgtcatatccaccggcgacaacttctacgagaacggcctgacgggcacagatgaccaggcgttcgagcaatccttcaccgacatctacacggcgaagagcctgcaaaagccctggtacctcgttctgggaaaccatgactacaggggtgatgtgcttgcacagctcagcccagtcctgcaaaagattgacagccggttcatttgcatgaggtcgtttattgttaacgcagaaattgtggatttcttctttgttgacacgactccatttcaactgaagtactggactcaccctaaagatgatcattatgattggagagaagtggcgcctcgagaaaaatacttagccaatttgttgaaggatttggacgaggccatgaagaaatcaactgcaacgtggaagattgccgtgggacatcataccatgaggagtgtcagtgatcatggtgacaccaaggagcttctgcagctacttcttccggtcctccaggccaacggcgtcgacttctacatcaatgggcacgaccactgcctggagcacattagcagcagggacagcccgatccagtacttcacaagcggaggcggttcgaaagcatggagaggagtgttccagcccaacgaagataaccttgagttcttctatgacgggcaagggttcatgtccctccagctcgaccaaaaccaagccgagttcaccttttatgacgtcgatgggaatgagctgtaccaatatacgcggtcgagcccgatggaaacgagccacctccggccgtccggctacgccacagaggaatgagtcggatggagatcaccacgagagattagagatcggttcaggtatccgacatcactgtaaaatttgattgtggcattgtgataagcggcggagaagtgatctgagagaaaaatgtactagtactgaagtatggcgtgtagttcatccatccacggagaaggaatacctaggttcggtttatgtcgtcgtcgcttcattgtcgcttcgagcatttgtcactgccacagtcgagcatgaggaaaacgaggcaccattttccatcaccggtggaaaaccgacctattggtaagcatcatagctctcgaaaaatcaaccgggactgattattcgggattaaaggttcctctctttagtcctgggtcattcacctgggattaaaggttcaaaaaaat

SEQ ID NO: 36 - DNA, 2909 bp, Setaria italica
agttcgccgcctctccggttctcccccatctgccgccaccgccgccgcctccttgcgccaccgccgcttcagatggccgagccgccggagcaggcgtcatcggaccccaccactccgccgcaggaagacaaccaaagcaccaagacaaatagcaagaagaatcgcggcacgaagaaatcgaagcgagccggcgcctcctcgctgtgctccagcaccatggttgaggacccgttcttcgtcctcgccggcggcaaggaaggagggttcctggagttggaggagattgacgaggcggacttcgggattgttgggggatacgtggaggaagtgggagcagatgaggggaaggctggcaaggatcgggggaagaagaagaagaagaggaagcggaagcgtgggggtgatgaccaggtcttgagtggcgatggcgattcttttttgaaacaatgcgatggcgattcagtagttgagaatgagcaggagggggagaaagagaagaagaatgcgaagggaaagagggacaggaagaagaggaaggtgaaggatagtgagaagagtggggagagcggcaaggacatagctgatgacgacaatgcagaagacgtgcaagataaaaatgagaacatggaacaagataaggatgatgatcttattttgggtgaggatgatgtttttgcatggcacgaacttaggcttcaccctctgcttgtcaaggcaatgcgcaggcttggattcaaagaaccaactcctatacaaaagtcgtcctttcctgctgcagctcaccaaggcaaggatgttattggtgcagccgagacaggttctggaaagacgcttgcctttggcctccctattttgcaacgtctccttgaggagcgagaaaaggcctcaagattacaccaggaagacgaaaaaatggaggaaagtgctggggaaagccctcttcgtgctcttattttgacacccaccagggagcttgcccaacaggtatgcgatcatctaaaagaagcagccaagttcttaggaattggcgtcattcctattgttggtggtatatccatggaaaagcaagaacggcttttgaaaaacaagcctgaaattgttgttggaactcccggaagattgtgggagctcatgtcgatgaacaatcaacacctagttgagctgcattcattgtcattcttcgtgttggatgaggctgatagaatgatcgaacgaggccatttccacgaattacaatctatcattgagatgctcccgctgactaatggttctgatgaacaagctgcaagaacaatgccaaactgtgagactgtgccaatcttgcaaataaagaagaggcaaacctttgttttctcagccacacttgcactttcatctaatttccggaagaagctgaagcgtggcttatctacttcaaaggcgtcgactgatgatgtaagctctattgaagccctgtcgaagaaggctggaatgaaaccaaatgcagaaatagttgatctgacaaaggcttcaatcttgcctgagaaacttgaagaatcttttattgagtgcagtgaagaggataaggatgcctatctgtattatatactgagtgttcatgggcaaggtcgagcaataattttttgtacatcaatcgctgcattacgccacatttcctccatattgcgcattcttggtattaatgccttgacaaaccatgctcaaatgcaacaaagggctcgcatgaaggccgtggatcgtttccgtggaagtgagaattccattttggtcgcaactgatggatttgcaaggggtatggattttgatgatgtgcgaacagttatccattaccagttgccacattcaactgatgtttatatccacagaagtggaaggacagcacgcaaatcattggctggctgcagcattgcattaatctcttctgctgacaagtcgaagttttactctctttgtaagtcattgtcaaaggagaacctccagcaatttcctatagatcatgcttacatgcctgcagtaatgaataggctctcgcttgctcggcagattgacaagattacacgcaaaaattcacaggaaaatgctaacaaatcctggcttcagaggaatgctgaatccatgggattgatattggagaccagtgacagtgaagaagaacgtgtaaagggccacaagcaacgaaaggcaacttctgcacatctccaaaagcttcaacaggaattgagtgatcttttgcaacgcccgttgcagcctaatactttttcacgacgctatttggctggggctggaatttcaccattacttcagaagcaactagaagagttggccaagagaaaagtaagcaacaatagaagcaagactgagaataaagggtctcgatttgttgttattgggcaggatcgtgtcgaacccttacaagcacttcagaattctgggcaagaggtctgtgtcaacttagacaaacaaagagaaaagcgaagacttgctcagaactggaagcaaaagaagcatgaagaaaagaaacgttcgcgggagcagaagagaaaggagaaaagaaaagctaaagcgatggactaaataacaggtgaaagatgggcctgtttgcgggaaggttaccttgcccaactgctccattcgtggaattccttcagagcctgcacgaattccttttaggaatgcactcaccaatgttttagccacatacatttggtgtgcggtgtgccaagttagcactaggccttaagcaagattgagtaggtgggttaatatgctgttttgcggcacaggataatgaagttagcacgggcaccgcgagatgatctctgtaacatgtggatgttatatcacatttcgtattcaaagctgctacaaatttatacatctttcgccatatcttttccctggtggtattt

SEQ ID NO: 37 - DNA, 2096 bp, Setaria italica
gcactacgcggctgttcgcgagtcaccgggcgggtccgcaggcgaaaaccctactcggctcggctccactcgccgccgcagccgcagccggagatggaggacatcgaggacgtgctaggcccggccggcctctccggcggcggggcgcctccggggctccgcctccctctctccacggtcgcggtcaagcccaagcgccggtcgtccagggtcgcgcagacaccgccccagcccgaggcccggattcctggcacgcagacgatatacgtcaagacgttcgggtgctcacataaccagagtgacagtgaatacatgtcagggcagctctcggcatttggatatgctattactgaagaacccgaaggagcagatttgtggctaattaacacatgcacggtgaaaaatcctagtcaatctgcgatgaccacccttatatcaaaatgcaagaatgcaaaaaaaccattagtagtggctggatgtgtaccgcaaggaagccagggtctcaaggagcttgaaggcattagtataattggagtgcaacagatagaccgggttgttgaagtggttgaggaaaccttaaaaggccatgaggttcggctgttgagtcggaaaacactgccctcacttgatttacctaaggtaagaaagaacaagtttattgagattcttcctattaacgtggggtgtttaggcgcctgcacatactgtaagacaaagcatgctcgtggtcatttgggaagctatactattgacagcttggtggatcgtgtgaaaattgttgtctctgaaggtgtccgagagatatggttgagcagtgaagatactggtgcttatggcagggatatcggtacaaatcttccaaatctgttgaacgcaattgttgcagagcttcctgctgaccgaagcacaatgctccgcataggcatgacaaaccctcctttcatactagagcatttgaaggagatagctgccattttgtgtcatccttgtgtttattctttcctccatgttcctgtgcaatctggaagcgatgctgttttaacgggaatgaatcgtgaatacactgttggtgagtttaggaaggtagttgacactctctgtgagcttgtccctggaatgcaaattgcgacagatattatctgtggctttcctggtgagactgatgaagattttgccgagactgttaatcttgtaaaggactatcaattccctcaagtccacatatcacagttttaccccagaccagggacacctgctgctaggatgaagaaagtgccaagcaatgatgtgaagaagcggagtcgtgaactgacttctgttttcgaatcattttcaccctaccaaggaatggaaggcaaggtagagcgaatctgggtaaccatgatagctactgatggtgttcacttggtgggacataccaagggatatatccaggtgctggtcattgccccagatagcatgctaggaacatcagcggttgtgaggatcacatcagttggacgatggtctgtattcggcgaggtaatagaaggatctgttgtagtaggagaagcacctaagcaaatcagcattgtaccgcagaaagaacacagacagaatcaggtggaggaagctgattgttgtggcgccgactcttgtggcacctgtgcatgctctgacgtggtacaaaactgcgtccctgaacaatgtaagaatacgcccgatgcacaccagaccattgatgatgttaaccgtcaggaggcaatccagtctacgcttgtgaggagaaacgtagaggggtcaacgaaagcaagtgaaagcagtgctgtaacacgatcggtaggacaggaacagcaggtgaactttgtaactaggagagggttaaatgttgacacgattctgtggtgcggcttggccctgagctttgctgcaacggtagccctgcttgttctccttaccagcaagatttcatcgacatcctccaactaggttaggctgtggttgtaactcgtaacaatttgttcttgagcgtgttgctgatcaattttggcggtttgtttagtcgatatgtatgtcgttgcaaagttgtggcactacaaataacatggatgcagaca

SEQ ID NO: 38 - DNA, 1899 bp, Setaria italica
gtcttttctccccttcccctctgctctgcacacctacgcatcgccgcctcctcctccccctctctgtccagtccagacccccagaggctagtcgtcgtcttcctcccgtcccgcaaccacctcgttcctatccgcagctaccgttcgccgcgccgcgccgcgcgtagacctgcttgatccgaccgaccgaccggcggccatggctcccctgccccgcgcggcctgcctcctccgatccgccgccgggcggctgaggtcaccgcctccgccgccggcgcggctcttatccagcgccgcggggaccgggaccggggtgggggcgggagccgggcgcgaggccgcgatcgtcgccgccgccgtggcggtggccgggtccgggctcgggctgtggctgaagccgccctcgctcgccgactccggcgagaccgaggccggcggccagatctcggtcgccggcgccggcgccggcgccgcggaggcgaggggggagaggggtcggttcctgttcgcagactcattccgcagaagggtgttctttaactacgagaagaggatacggcttctcagcccacctgaaaagatctttgagtactttgcgtctgcgaggaaaccagaaggagaagtttacatgttgcctgctgacttgatgagggcagtagtccctgttttccctccatcagagtcaactgtagtccgcgaagggcgattaaggggggaacggagccctggagagttgcattgtgctccatcgaaattcttcatgttgttcgacacaaatggcgatggcctcatctcctttgccgagtacatcttttttgtgacattgctcagcattcctgagtcaaatttcagtgtggctttcaaaatgtttgacgtcgaccacagtggggtgatcgacagagaagaatttaagaaaataatgtcactgatgcggtcttttaatagacaaggagcaacccataaggatggcttacgtattggacttaaagttggccagcctgtggaaaatggtggtgtggttgagttcttctttggtaatgatgggaatgaacctctacactatgataagttttcaaaatttttgaaggaattgcatgacgagattattcgtcttgagttcagtcattacgatgtcaagtcatcgaacacaataccagcaaaggattttgcattgtccatggttgcttctgctgacatgaatcacataaacatgctgcttgatagagttgatgatttggtcaatgatcctgatctgaaggacatgcgcatctcctttgaggagtttaaggcatttgctgatttgcgccgaagattggagccactgtcgatggccatcttcgcatatgggaaagtgaacgggttgttgacaaagcaggatctaaaacacgcggctcaacacgtttgcggggtcgacttaactgatagagtggtggacatcattttccatgtgttcgacacaaatcaggatgggaacctgagctcggaagagttcttaagagcgttacaaagacgagaaactgatattcgtcaaccaacaataccaggtcctttagggttcttgtcttgctggttcggtggtaggaagtcttcttcacttcgacagatggtgttctgattgggtccccctatgatccttgatgtaaatgtcatgtgcctttgattgtcatctcgtggtgcagaagatagccaccaagtagcggactgcagctgaccgtggaaccgattttgctgtaaatatcgccgggtggccgaagcttgcctagcagctgtaactgtaaatagtgtcttttcttttgtgtagtcctaggacggagagagtacgttggttattctcacctcatgtaaattaaaccccatatgacgaccttaaacatttgaaacattgtcaactgtgttcca

SEQ ID NO: 39 - DNA, 730 bp, Setaria italica
ctttccttctgaccccgccgccttcgctctctccgtttccggaagcttcctcctcccgtgcgccatggccggcggcaaccttttcgggcgggcgctgagctacgtcgtcaacgagttcctcgtcgagggcctcgccaacaaccgtgcattccagaggttcgctgtgaagaccaacagaactcttgagagcctatcgtctaaagctaaggaagtgagggaggagctatcggagcaactgaaggaagctcgtggtcaggacgatcacttcaggcggtgaagctggttcgcacattggttcaccaagatgatgctgaccgtgcaatcttttgctgtagttttcctagtacctgtctgggtcctatttattgatgtcattccattgatggagccgttctctggtatcctattttggatgtcactcaattgaaggaacctttgtatagtatcttcagtttctacgcacctgagtatcagacgcagagcagttgatgttcatgtcccttctctcttgtgctgtgaaatggaacacaaaccactggcaaccagcattagtgtactgttaataagatatattggtgttgattatcttactttgtatgtggatttgttccggctggtcttggatcaacatggtcctatatgatatttatcctgtataaaaatgttacgattatgttggaatgttaccattttcagagcgtttgtgtagaaatgattctgtctgaactgc

SEQ ID NO: 40 - DNA, 1152 bp, Setaria italica
gagagagagcagcgggcggagcaggcgcgcaccgaaaaaaaagccataaaaagagagctcgaagcgggatcgagcggaggaagagatcctctgctactcacttgccgagccagctcaccctccaagctcgcacgagctcccagatcccaatttgtccccagcgcgcgcgcgggccgggggaggaggaggaggagagctcagatggcgatgtccgcggggccgctgctggccgccctactactgccggcgctcctgctctccgccgcctccgccgccgacagcacgaacaaccctgccgatcagctcgtgtcattggtcaacagcaaccgtactgccagcaaggcctcctctctttctgataatcaaggtctgggatgcattgctctgcaatacatcaaagcatatcaaggccaatgcagcgatgtgcgtgacaagaagcctccggagtccagtttcgccgagaaattcgccccggactgtggtgtccaagtggcaacgctctctaagatcaccgggaggctcgtggcttgccagtccaagtacccctctccacctgaggccttggacatcctggtcaacgacgccaaggaccttcaggtgctgcacagcaagaaccacacggagatcggggtggccgtgagcggcaccgacggcggtgggccgtacttctggtgcgtcctgttcagtggcgggaagcccgccaccagcttcaaggtggacggcgaagtgcccaagaccgccatgcacccgggatgcttcagtggcaacaacgacgactgcgcgggtccgagtccgacgaatggcgccgttccgaccatcgctggtgcgtcgaggctggtggcagcccttctttttgttatggcttgtgccttggctttgtgagcttgggtagggatgctgtttcccaccattcttttgctttgtgaggaaaggagcaggacaccctcctgttgcagtgttgcgccattcttttgcttgtttgagcagagcaggtgaactatgtaaggatctatatcattgttcagcatttgagactgtcggttacctgttcagaatgttcatcaaagtagttttgtgcacaatcttcagatgtttgctgggactgtaagaaacttttgataaaatgtgtcggatggcatcaacggcatccgc

SEQ ID NO: 41 - DNA, 1565 bp, Setaria italica
gttttcctctcctgctctccctccgcctcgttctaccccctttgcccgccacgccgcaatctcctccgcctcaccgccggccgcctcaccggctggcgacacgcccttccgtccgccaagtcttcgctctcgctcgtccaacggcgcggccctcctctcccccgccctctgctgctgctcagcttgcgtgcgtggagctgagatccatccgggctcggatcgattcctcctccggctgggcctgcctctcgagacttagagtatttcgcaaggatgtcctggtgcacgattgagtctgaccctggtgttttcaccgagttgatccagcaaatgcaagtgaaaggtgtgcaggtggaagagctttactctcttgatgtggactctcttagtgaactgcggccaatatatgggctaatttttctcttcaagtggatacctggggaaaaggatgaacgacctgttgtcagagatcctaatccaaaccttttctttgctcaccaagtgatcaataatgcatgtgctactcaagctattctctcagttctcatgaaccgcccagaaattgacataggtccagagttatctcaattgaaggaattcacaggagcttttacacctgatctgaagggcttagccatcggcaacagcgaatccattcggacagctcataacagttttgcaaggccagagccattcatttctgatgagcagagagccgcgactaaggatgatgatgtgtaccatttcataagctatttaccttttgaaggtgtgctctatgagctggatgggctgaaggaagggcctgtaaaccttgggcagtgcggtggtcttgatgacctcgattggctacagatggtgcagccagtcattcaagaaagaatcgagcgttattcacagagtgagattaggttcaatcttatggccatcataaagaataggaaggaggtgtacagtgccgagctggaggatctggagaagagaagggagcaaattttacaggagatgaacaagacttccgccacagaatctttgaacaactcgctcacagaggtgatatcagcaattgaaactgtcagcgagaagatcatcatggaagaagagaagttcaagaagtggaagacggagaacatccggaggaagcacaactacatccctttcctgttcaacttgttgaagatgcttgcagagaagcagcagctgaaacctctggtggagaaggccaagcagcaaaagtcgtcgagcccaagcacaagatgatggtgacatgccgtttgatgtatcaagtgcctagggttaattgcatcttgctctctgtgtgggcattatcttatatcagatgcattgcctagttggcagcttagagaaatcattactaaggttatagaccattttgctcgctgtggtgtgttatcaactgcgccagttttggtgagcacgcacgaattggttgtttattttgtcaggttattaattgttcttctggattatgaaatgtgttgaaggctgtggatcgttttggatattccttttgagatggccacttgctaatctttatcagatat

SEQ ID NO: 42 - DNA, 1926 bp, Setaria italica
ctaaacacgaagaagcgccgctctcccccagcttcccccaaaccccaaccatgtctgccgccgccgaacccgccgccgaccaaaaccctaagcctaaggacgccaagccccacgagcccactgccgaagccggagccgagttcgcggaggaagagtacgaagaggatggagaggagtacgaggaggaggaggaggaggagctggacgggcccgcggccgcggcggcggagcgggagcgggtgcagtccgtgttccggaggctgtcgtccgaccccgtgggcatccgcgtccacgacgtgatcatcaagggcaacaccaagacgcgggatgagctcatcgaggcggaggtcgccgacctgctccgcgccgcccccaccgtgcaggacctgctccgggccgccagcgtcgccaccggccggctgcacaggctcgacgtcttcgacgccgtcaagatcacgctcgacgcggggccacccgagctgcccggcaccaccaacgttgtcgtcgaggtcgtcgaggccgccaaccccctcaccggtaccgccggcgtatactcgaagcccgaggcaagatcttggtcgttggaagggtcacttaagttgaagaatccgttcggctatggtgacatctgggatgcatcaggttcctatggttgggaccaaacaacagaggttggagttggaatctacctaccaaggtttaaatcaataccaacaccgttgatggcccgggcatctttgtcatcacaagattggctgaagttttcatcatacaaggagcgtctacttggcctttcatttggcttgatttcaacaatgaaccatgacttgtcttacaaccttacgtggcgtaccttaactgatccgtcacgtgcctcatctaaggctataaggaggcagttagggcataaccttctttctgcattgaagtacacatacaagatcgatgagagggattcacttctcaggccaacaaaaggatatgcatttcagtcaacttctcaagttggtggtctatgggataacaagggcttgagattttttcggcaggagtttgatgttcgtggcgctgtgcctttgggattttataatgctgctctaaatgttggcgtcggagcgggtgtcattttaccacttggaagggggttcatgaattcgtcttcacctgtgcctgataggtttttccttggaggtcattcttctccagtttgcagcttgagcgggctgtcatccctgctgggttttaaaacaagaggagttggcccaacagaagcacggaggcttgtacccaatgaatcagacagtggctctgctccggctccaggaagggattacttgggaggtgatctggctgtgtctgcctttgctgacctttcttttgatctgccactgaagttattcagagatgctggaatccacggtcatgcatttctggctgctgggaaccttacgaaattgtcggagggcgagtacaagaatttctcagtatctgattttaagcgcacattcaggagctctgctggtgctggcattattttgcctactaaacttttccgggtggaggtgaattattgttacattctgaagcaagctgagcatgacagtggaaagaccggaatccagttcagcttctcctcacccatgtagaaacctgccatgaaatgttttgcagctgaagtagcttttcttccctcacccctgtagacttgcgttctccattgttcttttcttactgaagcaattgcaaaacgatcgtagtcgcatatcattgggttttcttttgacgctcgttcttgggcgtgaggagcatgaacctagacttgctccttctttttggtgtcttgagttactcccctcttctgacacgaaggatttgtccttcacaactcaaatactgcaatggtggatagaataaattttgggccaa

SEQ ID NO: 43 - DNA, 1633 bp, Setaria italica
cacaagctcccaagaacccgcgacgcgcccggggccgcgccgcactgccgtgaccaccggcaccaaaaggagcatggcggcgccgtcgtcctccctcgcctcctcctcccacctctcccggcgcggcacggccacggccggcgccgcggccgtcgtcccgtcgtctcctctgcagccgcagccgcagctcctacggcacgcgtgctccgcccgccgcacgcagcgcgtccggtgcagctgggctggtggcagggcggcgtccaggcggcgcacgctaggtgtttgcttcgtggtctcacctagccagccagcaggtcttgctgcgatcgacgtgccggcggcgagcattcctaacacgacgaccatccccgagcgtatttcggtgtcctcgcttttggaggtcgtctcagacgatttgctcaagctcaataacaatctcaaatcgcttgttggtgcagagaatccagttttggtttctgcggctgaacaaatctttggtgccggtgggaagagattaagaccggcgttagtttttctggtgtctagagctactgctgaattagctggtttgtcggagctaactacagaacatcaacgcttggcagagattatagagatgattcacactgctagtttaatacatgatgatgtcatagatgacagtgggatgcgaagagggaaggaaactattcatcagctatatggtacacgggtggctgtacttgctggcgattttatgtttgcgcaatcttcttggtttcttgcaaacctagaaaacattgaagttataaagctgatcagtcaggtaatcaaggactttgcgagtggtgagataaaacaagcctccactctgtttgactgtgacatcacccttgacgattaccttctcaagagctactacaaaactgcatctctgatcgcagcaagcacaaggtcagccgccatattcagtggcgtcagcactgcaatttgtgaacaaatgtatgaatatggcaggaatcttgggctctccttccaggtagttgatgacatcctggacttcacccagtccgctgagcaacttggcaaaccagcaggaagtgacttggcaaagggaaatctgacggctccggtcatcttcgctttgcaagatgaaccagagctgagggagatcatcgattccgagttcagtgagacggattcgttagctgctgcgatagaccttgttcatagaagtggtggaataaggagggcacatgagcttgcgagagagaagggtgacttggctatccaaaatctgcagtgccttccgagaagcgacttccgaagtacccttgagaagatggtgaaatataatcttgaaaggattgagtaaatggatttactttaatgctccatcagatacagatctcctttgcatgggtttgaagtagctcctatataaacccatcttttcaacccatttttggtggatatgattttgaaggaagtttggaggaaatgcgctgtatgtacttttttctgaggaacccttgtgaagaaggccattactactgttgattctgtgaggtgatttatacaggatcctctgaaaagcaaggacttcaccacataccccgacccccaacaccttgtgcctacattttatctgaat

SEQ ID NO: 44 - DNA, 1264 bp, Setaria italica
aaaattcgctccaccggcggctcctcgtggtccggtcgcagactgcagctgagtgctgaccccgcgcggcaccgggcgtccacgccatggtgatccctgccgccttctcctcctccctcgtagtccggtcggccgtcggcgtgttgctggcggccgccatcgcagcgcgcgcggtccgccggcgctccctggacgcctcgggcgggatcgccggcttcgtcgtcatggcggtccacatcgcctgcggctacaggtacggcgcggtgctgctggccttcttcttatcctcgtccaagctcaccaagatcggggaggaccgcaagcgccgtgtcgaggaggagtttaaggagggcggtcaacgcaactggatccaagtactagcaaatagcacaattgccactatactagttgtgatatttgaaataataactggagggcaagatcagtgcttggactcaaatggctcaaagattataactggtattatgggtggtattattggccactactgttgctgcaatggagatacttggtcgtctgaaattggtgtgcttagtaatgaacaaccacggcttattacaactctgaagcatgtcaggaagggtacaaatggtggagtgaccttacaaggacttcttgctgctaccggaggaggcctgctcattggtctcacattcattattgttggactgttgacagctgaatgttcttttgatgtggccctccagcagctcctagtactacccatctctgctgcggctggtttgcttggaagtctaattgattcattgctgggagctacacttcagttcagtggatactgcagtgttcggaagaaggtcgtcagcaaaagtggtcctactgttacaaagatttctgggatgactgtccttgacaatgatgctattaatgcagtatctatcctactaacaactatacttacagcttttgtgtgcatttacatcttttaaaaatgatttgtgaagtttcttcacttgtttctgatcttcgttctcatttacaaacacaaagggtctcagaataatagtgacatgagtatacctagccacatagggctgcttgatggcaaaatctgttcgccttgatgacttggagcaaaacttggtttgaatgctagtatgagttgaaaggtgttggttatgtaagcatacatgtctgtataatcatgaaactagacatagataatcttgaacagagcaatgtattgcaccctttccttgcatgacactggaacaatttgcaa

SEQ ID NO: 45 - DNA, 1235 bp, Setaria italica
agcagccagcagtacaccactagcgcagcagcggttggccaccacccgacccgacgccggaggaggaggcggcggcgcggcgatggcggggaagcgcaacggctacgacgacgacaacgtcaaccccttcgcgggaggaagtgttccaccagccaccaattctcggctctcacctctatcgcatgaaccggctgatttctacaatgtagacattcctcttgattcaacaaaggatctgaagaaaaaggagaaagagctccaggctatggaggctgagctaaacaaaagagaaagggaattgaaaaggaaggaagaggcagcatcccgagctggcattgtgatagaagagaagaattggcctccccttttccctctcatccaccataacatttccaatgagatacctatccatttacaaaggacgcagtaccttgcattttcgtcatttttgggattgataggatgcctcttttttaatgtcatagcaactacaacagcatggattaaaggggaaggtgttatcatctggttgcttgccattatctacttcatatctggtgcacctggggcttatgtgttatggtatcgccctctttataatgcaatgagaactgagagtgctttgaagtttgggtggttttttctgttttacatgattcatatcatcttctgtgtgtgggcagctgtggctcctccgtttcctttcaaaggaaaatccttggctggaattttgccagcaattgatgtcataagcaagagtgctattgttgggatattttactttgttggatttggcttgttctgccttgaatcacttctgagcatcgctgtcattcagcaagtatacatgtacttccgtggaagtggaaaagccgcagagatgaaacgtgaggcggcacgtggtgctctaagttctgctttctgatgaacatacggctctgattacagccagttgatggatagaaggaaaccagatgtgtcatttgaggcatgggatcttgtacatcgcggcagtacgcgtatttcgatcttggaaagcgtacagctgatccgctttttgtccttctgtagactgtaagatacgaacattcctcgtattaatgcgtcagggtgtcgttggtttccatttcttgccacggtttagatgtggttgataggcataacggtggattgttggtggaatagtaggatatgatgtatttgtatacgcttgatgtgagtgaaatcgcttggtt

SEQ ID NO: 46 - DNA, 876 bp, Setaria italica
ccggccaccgccggagcctgagaaggaagaggagatctcgttggagccgaggcggaggcggaggaggagaagatggtgagctcttcgtcgccggtggtcaacgtgtacccgctcgccaactacacgttcggtaccaaggagcccaagatggagaaggacacctccgtcgccgaccgcctcgcccgcatgaaggtcaactacatgaaagaaggaatgcgcacaagtgtcgaagcaatcctattggttcaagagcacaaccacccccacatactgctcctgcaaattggaaatacattttgcaaactccctggtggacggttgaagcctggagaaaatgaaattgagggtctgaaaagaaagctgtgcagcaaacttgcagtgaactcgccctcctttccacctaactggcaggttggagagtgtgttgctgtgtggtggaggccaaactttgagactgtgatgtatccttactgccctccacatatcaccaagcccaaggagtgcaagaagcttttcattgttcacctttctgaaagagagtatttcgctgttccgaggaatttgaagctgcttgctgttccactctttgaactctatgacaatgttcagcgatacgggcctgtcatctccaccatcccacagcagctttctaggttccagttcaacatggttagctcttagggcaacaagacaggaagattagtgtggttgaggctgctcttttttcagacttatgttgagatggatcttgacgtgctgagccagctgatcgccgtatgatgactgattttatttcgccatgctggatttttttatctagactacaacaatctagacatgcatttctgactgtattttgttggtctattctgttat

SEQ ID NO: 47 - DNA, 1071 bp, Setaria italica
ccgcaactcttggttgccacgaccagatccattccggacgccctcctcctccgttccgatcctccctcctcctcctctcttccttccatctcccccgccgtccgcccatcgccggaggcgtcctccgccgattcctgcgtggtggagtgctttcgattcgaaccatctctggggctgctcccacccctcagctgaacgtgaacagggcaggggccaggggaataggggatgctcccagcttaatcaagggtacccctgaatcgaatggggtctcttctcactaggaccggcgtcctgccatggctccagagcaagattgttgatcccgtgctgcaggtcatcagaaggggagcggaacccaagcaactggccttctctgctgcccttggagtcaccattggaatctttccaatatgtgggaccactgttattcttggtggcgttgctgtagcaatgttgggaagccgttgcaatgctgttactcttatggttctaaatttggccgccactcctattgagctaagtttgatcatccctttcctgcgtttgggagaagcagtcacgggcagcgggcacttccccttgacggccgacgcattgaagaacgtcctcaccggccatgcctcaaaggatgtgctgctgagcatagtccatgcgatgctaggttggctgattgccgcgccatttgtactgggcgtgttgtacaccgtctcggtcccgtgtttcaagatcctggcggataggtttggcggcatcccttcgagccccaggacgccgatcaaggcggtgtagctagtgtggcatgcccagtgctcctgaagctgtgtgtacaaccaattctttgctatgccagcgggttgagatgggttacggcgtcatgttgctcggccatccatcccagaaactggcgaataattagaccttgagctatcacatgttatatccccactgtaattctgtatgctggcttcacgatcatgtagtgagatatgtattcctgaattcgcgaagtctggataaataaagtttggaagcactagggccatggagccgtgacgtactgcagccgtg

SEQ ID NO: 48 - DNA, 2637 bp, Setaria italica
cagcactcgccctcgagctccgaaaaggaggaaaaaagaattctccatttccccactcgctcgctctctccccgctcgctccgtcagtgagtgtgtgtgcgggggcagctagccgctagggtttccgcgaccgcgaccgcgagcccctcctcgccggcgatccggggcgcgatcccgcgcgggcgaaccgggtcccccggggggtggagcggagatgaagtcgtcgctgcggaagctgcggggcttcgctctgcagcggcacgagcagcgggtggaccgcgaccgcggccggggccactccaccgccgccgccgccaccgcggcggacgagctcctcgtggctgcccaggatatggcagatatgaggagctgttatgataacttactttctgttgccgcagcaattgcaaatagtgcatatgagttctctgaagcacttcaagaaatgggaacttgtttgcttaaaagggttacgccaaacaaggatggaataaatgataaggttttgctgttgctcgggaaatcacaatttgaacttcggaaacttgtagatagttatcgtgtgcatgttcttaataccatcaccactccatcacagtcccttcttaatgagcttcaaactgtggaggaaatgaagcgccagtgcgatgaaaagagagaattgtacgaattcatgctaaatgcgcagaaagaaaagggaagatctaagagtgctaaaggtgatacaggagcatcagagcaattgagacaagctcaggaagattaccaagaggaagcaactctttttctattccggttaaagtcattgaagcaaggacagttccgaagtcttttcacacaagctgctcggcatcatgctgcacagctaaatttgttcagaaaggggctcaagtcccttgaggctgtagagccacacgttaggcttgcggctgagcagcaacacattgatcatcagttcagtgcacttgaggaggaggattactttgttgaggatgaaaatgatgatgattacaatgacagccatgatggagagctgtcttttgattatggagaaaataaagaagctgaggaatctggtaatgctaccaggagtcatacagaggacttttttaatagaagcaaagaagagtattcttctgtaccacgtgaaagacagagaattgtcagtcagtcagcacctctttttcctgagaaaaagcttgagacagaagagaaaataaaagatttgcggcgttctgcaacaagaaagttaaatacttacgttttgcctactccaaatgatgttcgagctacttctcagatagtttcaggaaatcctactttgggacctctcgacagcagaggtcccctcccatctccgccccacacatctgcagatatgggagatttgagagacaataaactacctagtcctacaagattatctaatgcacagtctgtgctgaaagagagcaacaccaatactgcagaaacaaggaaaacactcccagtgggtgatatagccttaccaggctattatgacctgaaggcttctgataataaaaaggtgaagagagggtcattttctggcccaatagcttccagaccacggtccacagagaacattgatgttctttctgcagcgcccaggcacagctctgcgcatcagccaattcatattagagtatccccaggcaactcaccaccacctatttcctcaccaaaaataaaggagcttcatgagcttcctcgaccgcctgttaatacatcaaaaaatacagcatttcccagtttggttgcccactctgccccgttggtaccaaattctgcctcattggtacccaaagtccaagaccattttagggcaagacaaacaccaccaagtacagcatcacctttaccaacgccaccaacaccacctgggcctatagcccgcagtttttccataccttctaggaggacatcaggtatttcagatggtaaagagacagatgaacgtcaggataagggagctgccagaatgagcctttcttctcttccttcagcgcaaacattcttggaagatcgtgagccgttgtcagcagctgctgaatcagttagcaaaacatagggtatttggtgctgaggtggattattacattatcaaatctcgctgacgctgagccctcttcgtggaagaatgttgtacatactagcatgtgaactcagccagaatcgcaaagtagtcggtatttcgtgtgccctttggttaagatgtagtctgtgcaaataacgggtttgcggaaataaaatccccatttttctcaccgattgattgattgacgcgagatttgttgttgcccccctcattatttgctttgaagcaagttctgggcgcaccagttttctgcaagcttatgtaattatcacctggttccctcagcttatgtagttatcatcagtttcacccctgatcaaaattcaaacaatctctgtgtaagggtagggaaatcctagttcccacactgtaggagttgtctggaaaaaagaaaaaaaacagagagaagggctttgttgttgatgcattggcccaaaattgaaggcttgagtttggctccacattgggcttctccacagctcttaatatcttgaccaccagcaagttttgtcaggttctct

SEQ ID NO: 49 - DNA, 1270 bp, Setaria italica
ccccacccccctcctggctggacctggactcctcccacctcccgccgccaaccgccgccctccccaccggaatgccgggctgactgacggctgacgacaccccgacacgatttccggaggaggcgccgccgccgctgctctgggtggtgggtggatcctgcgaggcggagcgcggagccatggcgagcgacgtgcccatgagccccgagctcgagcaggtggacggcgagatccgggacatcttccgcgacctccaaaaggggttccagaagatggacaagatcaaggactccaacaggcagtccaagcagctggaggatctcaccggcaagatgagggagtgcaagcgattgatcaaagaatttgatcgcattctcaaagatgaggagaaaaagaacactcctgatgtcaacaaacagctaaatgataagaagcagttcatgatcaaagagttgaattcctatgtcaccttgaggaaaacgtaccaaagtagccttggtaataagaggatcgaattattcgacactggtaacgatcaagtggctgaggacacaccagttcaaatggcatcagaaatgtcaaatcaagaactcattagcgctggaaggaaacaaatggatcaaactgaccaagctattgagcgttcaaaaatggttgtagcacaaactgttgaagttggagctcagactgctgcaactctgacacagcaaacagaacaaatgaagagaattggcaatgagcttgactctgttcatttctccctgaagaaggctagtcaaatggtgaaagagattggtcgccaggttgcaactgacaaatgcattatggcgttcctgtttctgattgtatgcggtgttattgcaataattgttgtcaagattgtcaacccgcacaacaagagcctcagggacatcccgggcctggcgcctcctgctatgaacaggaagctgctctccatcgaccctttcggaggactctgagcattgcgaatggctcttgtgagccacataacacgatgtcacgattctttcctcgcttgtatattgtctcgttgtcggtgtttgcatcgatccattctttccccattggtgagtagtagctttgtgttcctagcggcagtcgtgttgtgtgtattactcgtgatcaccccccggctttctggttgtctgtgcatacgcggtagtgatgtgagattgtgaattttctgatttttcatgtttcttttggcttgtgagcttgtttgaaggtcaagtttgctactcgtctgctc

SEQ ID NO: 50 - DNA, 2722 bp, Setaria italica
ccttccagaaccaagctagggtttcgcctccccccgccctcccgcctcctcctcccggccacctgcgcgacccgcagcgtcgctctcgccgccgccgccgccgccgccgccatggggacggagcggaagcggaaggtgagcctcttcgacgttgtcgacgagacctccgtctccgccaagctcggccgcgccgccaccaacggcgccgccgccgccgcggcgggcggggccaaccccaccgtcaaccggtggaacgggcggccatactcggggcggtacttcgagatcctcgagaagcgccgcacgctccccgtttggcagcagaaggacgagttcctccgcgccctccgcgacaaccagaccctcatcctcgtcggcgaaacgggaagtgggaagaccactcagatcccccaattcgtacttgaggctgaaggcctgggtaaccgttccatggttgcctgcactcagccgcggagggttgcagcaatgtcagtctccaggcgtgtggccgaggagatggatgttactattggggaggaagtaggttacagcatccggtttgaggattgcagcagccacaaaactgttctcaaatatttgacagatggtatgcttctgagagaagcaatggcagacccacttttagagaggtacaaggtgattgttcttgatgaagctcatgagagaacattggcaacagatgttctgtttgggcttctgaaggaggttctaaaaaatagaccggacttgaagcttgttgttatgagtgctacccttgaagcagagaaatttcagggttacttcagtggtgcaccattgatgaaggtaccagggaggcttcacccggttgaaatcttctatactcaagaaccagaaagggactacctagaggctgctatcaggacagttgtgcaaatacacacgtgtgaacctgctggtgatatccttgtattccttaccggagaagaggagattgaggatgcctgtcgtaaaattaacaaggaaattaataacatgggagatcaggttgggccagttaaagttgttcctttgtattctacgctgcctccagccatgcagcaaaagatttttgaacctgctcctgccccattaaaggaaggaggacctcctggaaggaaaatcgttgtgtccacaaacattgctgagacatccttaactatagacggtatagtttatgtgatagacccagggttttccaaacagaaagtttacaacccaaggattagggtggaatccctcctggtgtcaccaatttccaaggcaagtgctcatcagagagctggtcgtgctggaagaacgcagcctgggaagtgcttcaggctatacacagagaagagttttaatgaggatttgcaaccacagacttacccagaaattcttaggtcgaacctggcaaatacagttcttaccttgaagaaactaggaattgatgatttagtacattttgactttatggatcctccagcaccggaaactcttatgagggccttagaagttttgaactacttgggggcactcgatgatgaaggtaacctaacacagttaggtgagatgatgagcgaatttcccctggatccacaaatgtcaaagatgcttgtcatcagtccaaagtataactgttcaaatgagatcctatcagtttctgccatgctatcagtacccaattgcttcctccggcctagggaggctcaaaaggctgctgatgaggcgaaggctcgatttggccatattgatggggaccatctgacgcttctgaacgtataccatgcatacaagcaaaacaatgaagatccccagtggtgttacgagaactttatcaattccagagcacttaaatctgcagacaatgtcagacaacagcttgttcgcatcatgactagattcaatctcaagatgtgcagcacagacttcaatagtcgtgagtactatgtcaatatcaggaaagcaatgctttcaggatatttcatgcaggtcgctcacctggagcggactggacattacttgactgtaaaagataatcaggttgtccatcttcatccctcaaactgtatggaccataagccagaatgggtcatctacaatgaatacgtcctgaccaccaggaatttcatccgcacagtcactgatatccgtggggaatggttgattgatatcgctccacactattatgatctgagcaatttcccatcatgcgaggcgaagcgtgttctcgagaggctgtataacaagcgggagagggaaagggccacgaacagaggctgaagttgatgcttcttttttgacgggtgctcgaagctgccaatgaagggcctgagccttctacggttctacccaagtgaagacttggtcgtccccctgatacacgttgccgtctgggcaccccaccataggcagcagctggataacattcagcacatttcatcagcatggtgattattttataaacataaatcaaatgttgctgatgcaactgtgtaacggtgtcaagattatatatttgcttttcttccttttactagaatggtagtgcagatatttgggtatcagtctccatattagtatggacaagacaattttcttatttgtgccattttgcaccggtttcaatgaaaacgtgctgatatatgtgcgtagtttgctaatagatattattatgcatctttagatataaactatatcaaatatcaaagtgcatagcaaa

SEQ ID NO: 51 - DNA, 584 bp, Setaria italica
ctcccaaataaaccctaaaccctgcgggccgcggctacagcaaaagccaccgcaagcagaagcccgcatcaacttgctccccaagaagaagcgagcggaagagctcctcgcggcgatggcgaagcgtctgatcccctcgctgaaccgggtgctggtggagaagctgctgcagcccaagaagagcgccggcggcatcctcctcccggagaccaccaagcagctgaatgctgctaaagtcatagctgttggtcctggtgatcgtgatagggatggcaagctgatccctgtatccctgaatgaaggtgacactgttctacttcctgagtatggtggaacagaagtgaagctcgctgagaaggagtaccttcttttcagagagcacgacatactgggaaagcttttggagtaacttcgggctgcaatgatcccaaggctgcagttgtttgcaagtagagatgcaggagtgtagcaagagacttctctcttttttgtgtgaatgggaaaaacaaaacccaaccatgagaattcgatgacattgcctcatcctgaaatatcttttgaaatgatataatggctcatttgac

SEQ ID NO: 52 - DNA, 1879 bp, Setaria italica
aacgctcgagccaatcgcagcatcgcacgccaccctctccatcctcctcctcctccacctccagtgctgttcacaggtcgtagatctcgggctcactgtgcaagtccccattgattgatttcgagctattagactgcgcgagtaatccacagattgaccgctcgatcgattgagagagtgaagagattggttggtagttggtacttgcctactaggtgggggagagcgagggaaagcagggagattgatgcgtgcatggcgatgcgggcgcgggtgatggggctgggcggcggccggcgggagctgctggtctccgccgccttcacggcgctcctcgtcgcctccatcctcctcctcccgtcgctcctcctcacgggcgctggcgcgggccccaagagctggcctttcctctcatcgctggccgcctccgacggcgccgccggcgaggcgccgcggtacccggtctcgttcgcgtacctcatctcggcgtcctcgggggacgccggccgcgcggcgcggctgctggcggcgctgtaccacccggccaacagctacctgctgcacctggaccgggaggcccccgcggaggagcaccgccggctggcggagctcgtgtccgggcggggcgtgtacgcgaccgcgggcaacgtgtggatcgtcggcaggcccaatctcgtcacctaccggggccccaccatgctcaccaccacgctgcacgccgtcgcgctgctgctccgcctccgccgccgctgggactggttcgtcaacctcagcgcatccgactacccgctcgtcacccaggacgacatgatggaggcgttcgccgggctgccaagggacctcaacttcatccagcacaccagccacctcggctggaagataaagaagcgggcgcggccggtgatcctggacacggcgctgtacgaggacgggcgggcggagctcctccggccggagaacatttccaccaacctccggagattccccacggccttcaagctctacacagggtcggcgtggacgatgctgtcgcggccgttcgcggagtacgtgaccatgggttgggacaacctcccccggaccctcctcctctaccacgccaacatcatctcctcgccggagttctacttccagacggtggcctgcaactcgcggcggttccgcaacgcgaccgtgaaccacgacctgcacttcatccggtgggacaacccgccgaagcagcacccgctttacctcactgccagggactaccgccggatgctactcagcggcgtccccttcgcgcgcaagttcagggaaggcgacccggtgctggaccggatcgaccgggacatcctccggcggcgggaccccggccagttcgcctacggcgggtggtgctccgaggggggcgcggcgctctgcggcaacccgcaggagcctggcagggagggcgctgtcaaggccggcgccgggtcccggcggctcaaggcgctgctccgcaaggcgctgtctccaaagaatttcaggaagcagcagtgtagatgagatcactacacaattctatttttgcggtctctaattctgatcaaacatgtcatgtatagcaaaaggaacgacatgaattcgaggaggcaattttggttcagaagagagaagactcctgaaactctgaagtagagagagatagtgcagcctttacagaatgctagtttcaggaatgctaccagttatgggctgattattagcaatgaaaaggtcattagtttgacagagctaacattcagcttgtgtacttcactctcgtatcagcaaacaaactttacaactctgtgtacagggtagaactgcctgatgaagtacttggtgcccgtctctctgcacaaacatgcaatgtttc

SEQ ID NO: 53 - DNA, 3562 bp, Gossypium raimondii
gtatccgactaacagattgatatacgggcttcattattagtatttattttatataaattttcttttcttaatctacaatatgaaatgaaggtatcattacgctagcaaattcagtgtaaaatgatcataaatattgtatatactgtaaaagaaaaatgaaactcaaaatctgtaaaagaagcgatcttagcttctcttgagacaatcataggtttcttttggcagaaagcagaaagactgaaacccttaccgaacatttttatcgttttttttttcttttcctcaatatcctatctgattttctgtctctggtaatagcaagaagacaatagcaaccaaccatggctgctggcaacaagttcgctagatttttgcataaacacaccagcaaaatcactgttattttagtctacgctgtgcttgaatggatcctcatcttcctccttttactcaactctttcttcacttacttgattactaagtttgccaattattttggccttaaaccaccttgtccctggtgttctagagttgaccatgtcctggagcccgacaacagcaactcctcaaactcttacagggatcttgtctgtgacaaacatggttccgagatttccaaattgagttactgttcaagtcatgggaaactagcggaaacacatctgatgtgtgaggaatgcttggcttctaggccaacgcctagtgacggtaaatccattggaatgacaaggaggattgctttcatttcatgggtgagtggtgatcccaagcttgacaatggtgaaaaggttgtcccttgttcttgctgcaatggcaccaaacttcatcctccatatttcctattcaagcctagttggggtgctttggattgtgcagaaaaaggaagtttgataatacaagcaatcgaagatgatgatgataacgatggcagtgaaagcgatcagtgcaaagatggtgaggatatgattgagattaaactcaacaaccaagatgacgacgatgatgatgacgaccaaaacgatcaaagggctaaaactgagcatcaggtgctttttgaaaaagatgtacatgaagatgacagatcagacgccatcaatattgcagagaagcatttcagtagtgccacaagtggaatcgttgaaccttgttttgctggagattatatgctagacttcattaatctgcatcatcagaaatgtgtttcagatcgcttatttcctgttgaattaattgatttatcaacatctgcaagccatttctcagaaaagcaagataatggaagtgaaactagtgattcttctaatgaagagacaccattacatgctattgatgagattgcagagactattaccagtcccagggaggctgaaaacctggagctagatcatcaactagacaagaatgatcttaatttaatggctgagagaccaatttccgagaccacattgttaagcactcaagactctgatctgcctcaaattcaagtgtcagattcttcattgcaatgcttacgagaagatggcttttcaacgtttaaggatcaagctaaaggtgttgatgctcctgaatcaagcaagactcaaattcttggttttacactaggtacacatgaagagaagagcacaatggatgagaacggagaaaggataaacgcttctttatcggttcatacggattgtaacaacaacgaagcagaggaggaaaagttccctgacactccaacttcatcacacgaaggtatgcattacttgcataataaactgctattcttcgggaaaagacaatcgggtattgaggagtctttagatgggagtgtagtaactgagatggaaagtggtgatccggttcgaaccattgaaaggctgaaaacttccttaaaagctgaaagaaaggcattgagtgctttatatgcagagcttgaagaagagaggagtgcctctgcaattgctgcaaatcagacaatggccatgataacacggcttcaagaggagaaggcggcaatgcaaatggaagctttgcagtaccagaggatgatggaagaacagtctgaatatgaccaagaggcccttcaactactaaatgagcttatgatcaaacgagagaaggagaaggaagaactcgagaaagaattggaagtataccgaaagaaggttctctattatgaggccaaagaaaagacgaggataatgaggataagcaaagatggaagcttgggaagtgggaaatcttcggctgcttgtagctatgcggaggatagcgacgagctatccatagacctgaatcgtgaagccaaggatgaagatagcagcttctctggcaaccaagaaagcagcagtgatgcagttggtaacttggaagaaatggcactggattgtgtaaaccatgtaagtgcccttgatgaatcgttgacagaattcgaggaagagaggctgtccatcctggatcagcttaaggcattggaagataagttactaactatgggggatgatcaattcatggaggacttgaaatcaattcagaattcctttgatggtcttgatgagaagaatgacctgcgcagcaaagaaggtaatgaattttcaaaagaaacaagttgtggcaaaacaatggcttccatggcaaagagtctccttcctttcctggatgcagctgataacgggactgaagaaggaactatgtatggaaaacaaggagaatctgattctgaaccggtagtaatgcagacatatcctggtccagaactggagttggaccccaagaaacttgcaattgaagaggaggtggatcatgtttatgagaggctacaagcacttgaagaagacaaggaatttctcaagaactgcatgagttccataaagaaaggagacaaagggatggatctcctccaagaaatcctgcaacatctccgagatctgagagccgtcgaactccgaacaaggaccttgtgtggtgatgtgcaagggtgatcttaggcttgccatgcataaaaggaatcacctggacctagtaatttcatatatattcaagtgtctatagggaatatctccagattgatggggagattccttatcttccttccttttgggcttacaagaatgatgcaagttcccaaaataggaaggatctcctctttatctgccttatttacaaccaaaaaagaaagagtggaaaatgaaggaaaacataccatttacctgggttgttcatgtagggtaagtacctagtaacatgtttttcttatttgtttagatttcatttactcttttctccataaggtttggaggaagatttgacaggtgagggaagaaggctttatcgtttactctcttactgtttccatcagggaatgttataaaatttcatgaatttttttttcttttttggaactcaaacatatgtgttgactttctatagctttgtatgaaattaatgttgttctttcttctctgggttctctcccttagttaaactgtcatgtgtatggcttctcatttagaacaggaggtattgcatattcaaattacttgtgaatctgatagaagataatttcttggttcttggt

SEQ ID NO: 54 - DNA, 1053 bp, Zea mays
gttccgtagcatatgcatatcctaaccacgattcgggggcaagcgaacggacacgatggtggccttgaccgcggggatttccgtagccaccggcgtcgtgttcagccccgccggccgccggcgaggccgcggacacgccgcctttcgctgctcgtcgtcctctgccggagagaggcaggctctcttcagccgcatcgcccccgtctacgatcatctgaacgacgtgctcagcctgggacagcaccggacgtggaagcgcatatgcgtctcttggtcgagagcgaagatgggggatcgagttcttgatctctgctgcgggagcggggatttggcgttcctgctgtctcagaaggtcggcttagatggagaggtgatggctgtcgatttttcaagtcagcaactacagactgctgctgggcgtcaggagcaacggtggaagctgtgttacaagaacatcaaatggatcgagggtgatgcacttgatttaccattcacagactgctacttcgatgctgtaacagttggctacggattgcgcaatgtggttgataaaccgaaagcgatgcaagaaatatatagggtcctgaaaccaggatcaagagcctctattcttgattttaacaagagctcgtcacttttcacagcatcattacagagttgggcgatagacaatgttgtggttcctttagctagtggctatggactaactgaagaatacaagtacttgaaaagctccatatcacagtatctaacaggagaagagttggagaaactggccaaagaagctgggttctgtgcagcgaagcactacgagcttggtggagggcttatggggaatctagtagcgactagatgagtagaatgtagaacggaaaatcgagttgcatggttcctctgcatcattttagctgattgtacgctcttcttctatgtattggcctcagatgaggtcaatgacaagtgttgattccagaggggcctggacgtcttgattatcactgtcttctgtttgaacctgcgcttctgtagagcatcgacgttgtgattacgatc

SEQ ID NO: 55 - DNA, 1151 bp, Zea mays
cagtgcgcggcccccacacccacacgaccgttgggcgcgccggtccggcccacctttaaaagcccccgcaccagtccaccaccgtgcgcgcacatccattcagacatccacccaccagagccggtcgatccgttcgaaacgctccgggaaagattccacgacttgggacttctcacattcccacaccgcactgtgccactgccgccggcccgccgcactagccgttgcttctcccttcccgttcccaaggagttgtcctcgccggcggatccggggcgccgctgcaagaggaggaaggaggaggagaggataccagaatggcgtcgcgctcggcgtccaaggatatcatcacgctgcgaggctctgccgccatcgtcagcgagttcttcgggtacgcggcgaatagcatcctctacaaccgcgctgtgtacccggaggagagcttcagcaaggtgaagaagtacgggcttaccatgctgctcacgcaggacgagggcgtgaagaacttcatcgccagcctcacctcccagctctcagaatggctggaggccgggaagctgcagcgtatcgtgctggtcataatgagcaaagccaccagcgaggtgctcgagcgctggaacttcaacatcgtcaccgacgccgaggtcgtcgagaagggggccatcaaggagaagagcgacaaggagatcatgagggagatccaggccatcatgcgccagatcgcgtcttgcatcacctacctcccctgcctcgacgagccatgcgtgttcgacgtgctggcctacacggacacggacgtcgacgctccgggcacctgggtcgagagtgacgccaagctcatcgacaacccgcagatggttaagctgcactccttcgacaccaagattcataaggtggacacgctggtgtcgtacaagaaggacgagtgggacgaggaggagtagagtttgcaccaaaagttaccctgctgctgctagagcttggcgtgaaggctgtgtgaatcgttcattcacgtctatcgtgtactgcactaatagtatactgctactttggggggaagaaaagtgtgagacgctcctaccatttagaatttcgagattgaaatgccggttttaatataacatgagtcagcgcctttaagatctggctgc

SEQ ID NO: 56 - DNA, 1544 bp, Zea mays
ctctccttccactgagtcacgccgcttccagaaacaagggagggaaccggagacccgggagccgagcagagtcgcaccaaatgctctgatccccgttcgtgggctttcctccccgtcgatccctcctccatggcgcgcgtcctcccgctcgagactgccgagatggccagaggcgaagaggcagtggtagacatgccaaggtcatcagccggggcgtcatgcacagcagttgaccattctgagcagagcagaaaggatgatgaatatgagaggctggttacaagagctcaacatgcaacatctgatgttggcacgacaattttatctgagcaaccaaagtcaagatctttcatttggtggatgaaagttctgcttggctgcttccttcttatattagtgggctatgtcttcgtgaaatggggggtcccctttgtctttgagaaggttctcttgccaatcatgcaatgggaagccagtgcttttgggcgtccagtattagctattgttctcgttgcatctttggctctctttccagttattctagttccttctggaccttctatgtggttagcaggaatgatctttggatatggttggggtttcttgattataatggccgggagtactattggcatggtggttccatattggattggttcattgttccgtgaacgtctgcatgtatggctgacaaagtggcctcagcagatagcactaataaaactcgcgggtgaaggaaattggttccagcagtttcgggttgtcgcgcttttcagaatctcaccattcccatatacaatttttaattatgccgtgactgtgacagaaattaagttcaacccttatctatgtggttctgttgctggaatggtacctgaggccttcatttatatctacagtgggcgtttaatacgtacattggctgacatgaagtacggcaactataaaatgacaccagtggaaatagcatacaacgccatttccttcgtcatcgctatcgccctcacggtcgccttcacggtgtacgcgaagagagctctgggtgacataaaaagtccggacgatggcatcggtaaagacgaagaagatcacggcccaaatggctcaggggtgcgtatgaatcgtcgtcaggagcgtgccgacgcacgttacatagaactagatgatatgtgatggtgtgttggcccggatcttgcttggaaggaggcaccagtaggtcattaggtgcacggctacggtaggtagctagctatagtttacaagaggaggctaaaataatccacacccagctgacgtggtttgcgtgattcgtttcgtgtgctttgcctactgcactgccatactgtctgaatctgaaggtgcagggctactcactactgagttactgaccgagcgatgctgctctcaacgatgtttctgtgaccatcagcgtatcaatcagtccttgatctgaagcctacactggagcttcatgttgaagcatacattggacttgagtagtacatttgtatataacgtaactgctaatagagttagcatatgat

SEQ ID NO: 57 - DNA, 897 bp, Zea mays
gaaactttggcgcccttcaaatcccatggccgcactcggttcttctgtcacatccagaggcttggcactccatacctccgtgtgtgtggtttttcttcatcgtcgccacgggaatccagtgatcccggccgcaccgtctcgtccccagcgaagtcttgcgagtgggttaacaacgagttcttcaggcatgaacaatgccttccctattatcaaaggaactacacgaattcctgcggttggtcctggccctgcaaatccggcaggaggaaacctgccaatacccagcagcatgcctccgtgggccaagtgggtggccggggccgtcatacttgcgatacctatctacaggaggttcagaactttagaagacaagatagagaagacggcagaggtggccatcgaggtggtcgacacggtggcggaggctgcggagaaggtcgccggcgaggtcgccggcgcgttccccggcaacgacggtctcagggaagcggcctcgaagattaagacggtcgcggatgagatcgaggaagacgccgagaaagccgaggccctaatcgagaaggttgacgagatcaagaaagaggttgattcaattgtggatcctataatcgacaaggttgtcaaggacaaagaaatatagagacaggtggtgaactgaagatgtaaacatttgttgggctggtctggttaggaatggatccggatatttattcagatgttaaattactttcgattgcaaacaaatatgatatataatttgttatgtaaatttatattggtgattttagtattaagcttatcaagattcataaaatttaaatatcaaatatgttatatatcattttaaatatttgatttaaaattcggatgcggatattattcggattcgaatgttgt

SEQ ID NO: 58 - DNA, 2750 bp, Zea mays
ggcgccataaaccctcggcctcgacctcatccagtacccgcacctccgctcaaaaccccagctctcctgccccggctggtctcagccacaagtaggcggccggcaagccaagaccaaggagcccgcgagcgcgagggctcgccgacgcggatggcgctactcctccggccgattcctccccctccccgcctccgcgcgctcctcggccgcctcctctccactggcgccagtctatttccctcccgcatgctccccgcgccccgctccaccgccgccgtccctcggctcctgtttgggcccagtgctgtggccgcggcagccacgcggcgcaatggggtccgggtgcgtgcgttcatggcgtcaacgacggcgtctgaggcgatgcacgagaagcaggtgtccgcggagtacactgctgccaatgtccaggtcctagaagcattagatggagttcgcacaaggcctggtatgtacattgggagcacaggaccacgcggcttgcatcatctggtttatgaaatcttggataatgctgtggatgaagctcaagcgggccatgcttcgaagattgatgtagttcttcatgatgacaattctgtcagtgtaacagacaacggccgtgggattcctactgatatgcacccccagacgaagaaatcttgtgtggagactgtcttaacattaatgcacgctggtggcaaatttggaggttcaaaaagtggttacagtgtctctggagggcttcatggtgttggcttatcagttgttaatgctttatcagagacacttgaagttactgtttggcgtgatgggaaggaacacagacaaagctattcgcgggggaaaccaaccactaggctaactagtagcacactgactggtgaaacaagctctcgtcaagggacgcgcatcagattttggcctgataaagatatatttaccaccacgatcgattttgacttcaatacaatctccagtcgcatacgggagcttgcctttctaaatcctgagctaacaataatcttgacaaaggaagaagggcacacagttcaacgcaacgaatattgttatgctggtggccttgttgaatatgttaaatggttgaatactgacaagaaacccctgcatgacccgattgcgttcagaaaggagttggatggtataacagtggatgtctcccttcaatggtcctctgattcctactctgatacagtgctaggatacgcaaacagtatccgcactattgatggtggtactcatattgatggtctaaaggcttcattgacgagaaccattaataaccttgcaaagaagtcgaagactattaaggataaggatattaccttgagtggggagcatgtaagagaaggaatgacatgcatcatttcagtgaaggtccctagtccagagtttgagggtcaaacaaagacaaggttgggaaatccagaagtacggagaatagttgagcagtctgttcaagaaaacttaacagagtacttagagcttcatccagatgttctggattcaatcctatcaaagtcccttaatgctctcaaggctgcgttggcagccaagcgtgctagggaactagtcaggacaaagagtgtgttgaaatcttcatcactccctgggaaacttgctgattgtgcatcagctaatcctgaagaatctgaaatctttattgtcgaaggtgattctgcgggcggtagtgcaaagcaaggacgggatagaagattccaggctattttgcctctaagaggtaaaattctcaacattgaaagaagggatgaagcagccatgtacaaaaatgaagagatccaaaaccttattcttgcacttggattaggagtgaagggtgaggattttaagaaggaggctctccggtatcataagatagttatacttactgacgctgatgttgatggagcacatatccggactctcctccttactttcttcttcagatatcaaagagcattatttgatgaaggttgcatctacgttggtgtacctcctctttacaaggttgagcgtggaaaactagcacattactgctatgatgatgccgacctcaaagagatagttaacaccttccctgcaaatgcatcatatcatatccagaggtttaaaggtttgggtgagatgatgcctgcacaattatgggaaacaacgatggatcctgagaggcggctgttgaagcagcttagggttgaagatgctgccgaggccaatgttgtgttctcgtcacttatgggcacccgggttgaatataggaaggaactgatccagaaagctgctagcatgatcaacatagatcaacttgacatttgaaggcattaagtaaggctgtcctttctgtgtatgatatagaaggtccgccacctgctgcttttcttgccactccaacaggattctagcgttgcagacttgatgataccttggcaacatctttttggtgctagagtagcagaaaacgtagggtacaaacattggatccaggatgagagctgggtttcctaacgaaaactctgattcatttgtggcggtgctataaccatttcagcttgacagttcagagctcacgggtgtagttccctgctgacatcgttcctccgatacggtgtaatatgcttttatatctatcgcctaatatttgcttcatgattccgtgtctcctttcttaatctggcagttaagtatctgtatgagctatggattcgtctgatgtttaaattggacggtttgaaccc

SEQ ID NO: 59 - DNA, 2475 bp, Zea mays
atcgaccaaaaaaaaagtccatgaccgcgtttttctcttctgcctttcctgccgccggccgggtctactcgtcccatcttgtagctgcagcggcaccccctcaaaatcgtccaaccaatcccaccagctgctcatctcgaatccagcccgaaacctcgcgccacgcgtgccgtgggcccagttcgtgcgcgttcagctgctgccccgcgcccagggatcgggaaggcaagctctttggtggttcctaagggcgaatctcgtggcgattcgctcagatttggatttagggtttaggaggcggtgctggtgatcggtttgtgccgccgggagagatgtcggcggctgtggcgtgcgcggagagggcgactaacgacatgctgatcggcccggattgggcggtcaacatcgagctctgcgacatcatcaacatggatcccggacaagcaaaggatacactcaaactcctaaagaaacgtcttgcaagcaagaatacgaaagtgcaaattctaacactttatgtgctagagactctaagcaaaaattgtggggatattgttcatcaacagattgttgagcgcgacatattgagtgaaatggttaagatagtaaagaaaaagccagacttgagcgtccgagagaagatattgagtttgattgacacatggcaagtggcttttggaggtccatctggaaaatatcgacagtatcatgcggcttaccaagaactcagggctgctggtgttgattttccgcctcgcgaggaaaattcagtcccgttgtttacaccacctcaaactcaaccattaagacatccacatctatatacacctccaggtcaaagctatgaagatgctgctatacaagcttctcttcagtctgcccctcctgcatctgccctcagtctgagtgagattcaaagcgctcgagggattgtggatgtgttagatgaaatgttaaatgctctggaccaccggcatcctgagggtgtaagggaggaggtcattgttgaccttgttggccagtgccgatcctatcaatctcgtgtcatggatcttgttaacagtactggcgacgagagccttttatttcaggctctaggactaaatgatgagttacagcgtgttgttcagcgtcatgatgacatagcaaaggggatccctcctggtactggagcacctttacctgcttctggaaatgtcaaccaagggactgccccacctaggcccactgcggtttcattttctccacttctaaatgtacatgaggacgatgaaccagaagacgagttctctgtgctttcccgcaggtctgcgagggatggtgcagtagcacagaacaatgtgccctctgctccaagaaatgagaggtcatacccaagcccacttcttcctccaccaccagcatctaagaggcctgtttataccgaggcaagcagtgttgactatcttagtggtgactcctacaagtcagagaaggtttcagatgatttcatcaacccaactgctccagctaacatatccacatcatcccattcaaaggcagaagcacatccacctccgagttatggtggcaggccagacagagtatctgacgacttcataaacccaactgcacctagcttctcggcgccttctcgtcctacaaatgaggagccagcccgcccatccgtgaagcggcaagagagcctacctgacgacgacttcataaacccaactgctcttcctggtttctcgtcgtcttcagctactaaggagtctggcgaggaccttccaaaggctccatgggaagcacaagctgccgcgggttccctaccgccgcctccggcgaggtacggccagagacagcagtacttcgagcagaacgtgtattctggcgggagcaacgaaggcggctacaatggactgacgacacagaccgaaggtctctcgctgaacccgcggagcagcgagaacgagaggagcgcggcacggccggcagcgtcccgccctgccaaacctgaggactcgctcttcaaggacctggtcgacttcgcaaagaccaagccttcgtccccgtcgaaaccggccaacagccgcaggacccgctagaacgactcgtgcgatgcatggatggacattgggtcgttcggatattcatttcacaggttagcggcttttagatggtaccatgaaataaggccgtctggagactggttttcattgcatatttgcattgcatgggaaattgttttggttgcgtttagagtggcagatgtcagaaacgttgcttgctcataatcctgggtgtgtgatgtctagttagctgctcctaaatttctgtgtcgttggcttccgattctcattttctttttctttcacttagctgtgtatatatatgttacccgattcgacagcaaatattcatagttgagtttgtgacttgaggaatgaggtgttcctattttcggtattggataaattaggtgcctatttttca

SEQ ID NO: 60 - DNA, 1266 bp, Zea mays
gtcaaagcagagtctgcccctccccgcgccgttctttttggttccccactccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctggcctccttcagctcgccgtcggtcatattcgagcagatctccgtcatcttcgcgctgcccaagctattcattgcctcattcactctcgtgctgcctttcttccccacgggctcattcgagcgcgttgaggaggagggcgatgtcgccaccgcgttcaccctcgcgcgcattctctcgatgatccccaagtcgcgcggcgggcctaccagcgtcgtcatctacgacatccacgcgctccaggagaggttctacttcggggacgacgtcctgccatgcttcgagacagggatcccgctcctgctgcagcgcctccgccagctcccggacgcagaaaatatcaccattgcctttccagatgacggtgcgtggaagcggttccacaagctgttacagcactttccaatgatagtctgtaacaaggttcgggaaggtgacaagagaatagttcgtataaaggaaggactacctgaaggccgtcatgttgttattgttgatgatttagtgcaatctgggggaactcttagagaatgccagaaagttctagctttgcatggcgctgcaaaagtcagtgcttatgtgactcatgctgtgtttcctaagcagtcatatgaacgtttcatggcgtctagttctgctgggccaggtgacagatttgcttacttctggatcacggactcatgcccacacacagtaaaagctattgggcaaagacctccatttgaggttctgagcctcgctggctcaattgcagatgctcttcagatatgagcgtacactggtagatgggcatgggcttggattgttgatgcccaccagattgaaacttgtactatgaggtggaatgctcccgcttttcctaaatgtaagagttggtttccagttcctggaaaagcaaataatgtgtagtaagttaagtacctgaaggttccataaacagccctgtggtttgtaataaaatcaggcattggatactca

SEQ ID NO: 61 - DNA, 706 bp, Zea mays
gacgacgactttctagtctctctcctcccgcctccgagtccgacccgtccgagaaaacaaaacaaaccaaaagaagaaaagaaaggcgacgacgagggagggaaggctcgccgcgagatctgggggagctcccattcccaggatgcacgacttctgcttcaccatcccctacgggttcgccgtgctggccggcggcgtgctgggctacctccgccgcggcagcaccgcctccctggcggggggcgccggcgccggcgcgctcctcctcctcgcgggcttcgtcagcctcaaggccttccagaagcgccgcaactcctacgtcgccctcgcgctcgagacgctttgtgcattagccttaacttccgttatggggcaaagattcctcgagacttcgaagattatgccagctggtgccgttgctggtctcagtgccgtgatgtccgcattttatctgttcaaaattgcaacgggcggcaaccacatcccaccaccaaagaaagagtaaaccaggctttaacttgtaaattatgtttgattgatgtcgaagaagactacgagcgattgtgttgtctagttgcatggtaacttcagggactaacatcttcttccccatttgtaattcggttagaatgtaccatggtttgtgaacaatgtaaaagaaataaagatgtgattcacggaaatgaatatgatgtttactgaggca

SEQ ID NO: 62 - DNA, 2511 bp, Zea mays
agcacgttaacggcggcggcggtgagaaaaggcgggggagggggactggaggtgaaaggcggctgctttcgctgtctccccaccacccgcgcacagtggcggcgctgacggtggcaggaaaggaaagtggcgatcacaccaaactcacatacagatggagatggcagagaccttgcatgtattgcccgatgatggcaatggaagtgctgcagttcagactgagccttattgccatgaagacgccattgaggacatggaatctttcttggatgaagtaaacgacagggttcatgtttcaggaattgtgactggtgctatcatcaaggggatcctaagtgatgtgcggcaagaagctgctagccaaattgctctcaaggatgcagagatatcatcactgaaccagaagctgcagcagccagtaaatggcagcttgagtttatctgagggacgggataaaagacatgatgagttttatagtctccgccagcagcttgactccatttccaagtcactgttgaattctgaatgggggctatcgggatcacagcataactttgaagattcagaaaatgccagcaagcagcaggacaaagaaaattcctctagaaatggtgtagcaaagaccattcatcctggagactctaaagaagaagtttttggtgatccgaaactcttggatcacatggataaggttgctttgatagcccatttcaataaatcaatgaatgagatgaaaaggcagcatgattcagttctgtaccagaggacggaagagatattcaaactgaagcgtgaaatcctgaagaaggatggatcaaacccttttcatttacgaaataacaaagaacttgagcaaacaaggaagaaaattgaggaagtcatctcaaagttggatgtgctcctcctggagaataaaagagcctctgtccgtatcaagtcaaatgcaattcctggtcaacaagataagaacaatgtattaggttctgaaatcgagcaactagaaagcggtgcaagtaataatgaagactaccattgctctattccaactcactcatcacattttgcatccagagaggcagatcatgaactgaatattgtaaggcctcaatttgacgttgaagatgccagaattgcagccacctttagagaagaaatagaaaggattatcataaaagagttcattagtgaaataaacatagaattgcatggttatgagattgagggtggtatgaagcaggaagtttgctcaataattcacaatgaggctattgctagagcaatgtcaaacattgattctttgttgttgaagtacgaggagaaaaagggtcatgctgaagaggaatctctacataagcaaaagattgaaaaactgaaactaattgtggattccttcactgaagtattgagtgaaaaggagaaatttgtatcacagattggattggaagcgatgcagactcgcgtggagtcaatgtgttgtgaacttgatttgttaagggacaaagtggcaaagcaagattcctacctatctgaaaagaacagggaatttgatgccattatgtgcaggttggagcaagctcagcagcatgttcaacacaatgatgttaccttggttgagctgaatgatagacttagaaccatttcaaactctctaaaagacctagagaaacagaatcaagctctacattatgccatggaagaaaaagagaagatgctaacatctgctgtttccaaagacaatgatatgagagaattcatggaaaatcttgttaaatctatcaaagattttgaaattgtcatgatgaatcagcaggctgttgttgcaaataaagtcgatcatcatgaatcaaggttctgtttattaaaagaacaatgtaaacaccttgcaaaagaaggcaatcttttaagaaagaaggccttacgatacaaagagatatctgagacaagagactctaatcttcagaaagctgaacttgaggtggatttgcttggtgatgaggttgaggccttaacggatcttcttgcaaaaatctatactgcacttgatcactattctccagtactgcaacactacaccggcgttatggagaccttgagcatgattaagaagcacattagcatggcgaagtaaaatgcttctggtcggcttgacactgtagaattgtaggtttgacagcaggcttccagtggtttgacataagtttgtagaattgtagatggcagcaagcttttgtttccgactcaaggactaggtgattacccccttttgcaggcagagtagtggtcttggtagcttttgagcactctgtaaatgacccaacccaaccgtagctattagttcttgtgcttggcttttgatgctatggcctatgggctttgccacctgctatgctgggttgcaaaggtgaactcttgtaacattggtagccgagaggatgttagagaagctgagttttcatgtggatctttattttttcctggcacaatggtagataaatctacactatagcctgg

SEQ ID NO: 63 - DNA, 1068 bp, Zea mays
gagaacggagaagagaacaagagatagtacttgacactcctgtcctgctcctcccactcccacgctcccaaccgagctcgagcgcacgcacacgcgcacaagcaggagctcctgtcccgctagatcccaaacagtctcctgcccgcgcgcgtttggggtggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctggcaaggcatcttctgtttcggacaaccaaggtttgggatgcatcgctctgcagtacatcaaagcatacgaaggccattgtgaccaggtggacgacaagaagccgatggagtcaagcttcaccgacacgttcgccccgacctgtggcgtccaggccacaaccctctccaagatcaccggaaggctggtggcttgccagtcccagtacttggctccagctgaggcctttggcgtcttgttggtgaacgacgcgaagggcctccagatactgcgcagcaagaaccacacggaggtcggggcggctgtgagcggcaccgatggcggtggaccgtacttctggtgcgtcctgttcagtgacggcaagccgactaccagcttcaaggtggatggcgaagtgccgaaggcagccatccacccgggatgcttcagtggcaacaatgacgactgctcgggccccacaaatggcgccgttttgaccagtgctggtgcgctgaggctggtgacggccattctttttgctgtagctgctttgtgagcgtgtaagtaggtgtaatgttttctgccattattttgctttgtcaccatctcctgtctgtctgcagtggcacgctatatattctttgagcatatgaactatgtatgcaaggatttgtaggtcgttgttcagcattttgagactatctgttacctgttcggaatgttcatcatagtagttttgtgcgctcttttcggaagtatttgagcaaattaaag

SEQ ID NO: 64 - DNA, 2229 bp, Zea mays
aaacaaaggaaaagggcttagcctcacgagacaaaagacgcccgccccggccggcgaccagtacctcgccattgctagtgctagccgccgtcgctggtgtcccctcctcccacttgcgccgcctgtccccgcgccctcgaaaccttttctcccaaaacagatttcgtcccggcgctctcctgcaaagggcggctagctgtcgccggtggatacgtttcaccttgcttgggttctgcttcttcctgcttttccaagagagggccagcagcagacgaagcgagcaaagcgcgcaggaaccgctcggtctggtgattttaaggggcgaggtcgtgttcttgggaggcggagagacacgagctctctcttcctgtcctctttcccgcggcttctctcttgtcttgctccaagagggcaaaactcgtcggggtagggaaatggcggaggtgaagccggaggagataagccatccgcccatggagcagctccaggggttcgagtactgcatcgactccaaccctccctggggcgaggcgatcatactgggcttccagcactacatactggcgctgggcacggcggtgatgatcccgacagtgttggttcccatgatgggcggcgacgatggggacagggtcagggtggtgcagacgctgctgttcgtgacggggataaacacgctgctgcagtccctcttcgggacccggctgccgacggtcatcggcggctcctacgcgttcgtcatcccgataatggccatcatccaggacccgtcgctttctgggatacccgacggtcatgagaggttcctcgagaccatgaaggccatacagggggcactgatagtgtcctccagcattcagatcattctgggctacagccagctgtggggtattttctccagattcttcagcccagtggggatgactccagtggttgcgctgctcggatttggcctcttcgaaagaggtttccctgtggttgggagatgcgttgagattggcctgccaatgctgatcctctttgtcgtgctgtctcagtatctgaagaacatacagataaaagaaatccccatactggaaaggttctcccttttcatctgtgtcgcgttggtatgggcgtacgctcagatcctcacttcaggtggagcctataagaacagcgccgaggtcacccagaacaactgccgcaccgacagagccaatctcatctcttctgccccatggattaagatcccctacccactgcaatggggtgcgccgaccttcaacgccggccagtcatttgggattgtgtctgctgttttggtctcgctggtagagtccacagcctcctacaaagccgctgctcgtcttgcgagtgcgactccacctccggctcacatcctcagcagaggcattgggtggcagggaatcggcatcctccttgacgggctctttggaacggggactggctccactgtctcagtggagaacgtcgggttgcttgggtcgacaaggatcgggagccgacgggtcatacagatctcagctggcttcatgatctttttctccatgctggggaaatttggagccttgttcgcttccatcccgttcaccatctttgcggccgtgtactgcgtcctgttcgggctagttgctgcggtggggctgtccttcctacagttcactaacatgaactccatgcgcaacctctttatcgtcggcgtctccatcttccttggcctgtccgtcccggaatactttttccgctacaccatggctgctcatcgtggtcctgcgcacacgaaagctggatggttcaacgactacatcaacaccatcttctcgtcgccgccgaccgtggggctgatggtggccgtgttcctggacaacacgctggaggtgaagcaagccggcatggaccgggggatgccgtggtggcagcggttccggacgttcaagggcgacagcaggaacgaggagttctaccgcctgccattcaacctcaaccgcttcttccctccggcctaaaagtcaagtcactcagactcagattgctgagcagaggcatagtgtagcttatttattgttccattcgttcatctctacttgttcgtgttgtagattattttggggaggttcagtaagtatacttactgcccaatccactaaatgtggtcgcctaccgttttttatatatttttttacatgctccgtccaaaataagtacacttttcaatttggggagtcg

SEQ ID NO: 65 - DNA, 2070 bp, Zea mays
ccctcactcctaagcgccgtcgcgatctgctgcggtggccgctgccgtcgccgtccatccccaccgcctcgaccacgccaccgacgccgcctctcgctccccctcgccgcgccgcccgaacgccacgatgcgtcacctcctcctctcccgcttcctccgccgcggtggcggcagcggcatccccaacggccactaccaccacctccccctcctccgcgccctctcctcctccccctccccggtctcctcggacgcagagctccgcaagtacgcgggctacgcgctgcttcttctcggctgcggcgccgcgacctactactccttcccgttccccgccgacgcgctgcacaagaaggccgtgccattccggtacgcgccgctgccggaggacctccacgccgtctccaactggagcggcacgcacgaggtccacgcccgcgtcctgctccagccggactcgctcccggccctcgagggcgcgctcgccgccgcgcacaaggagcgccgcaagctcaggcccctcggctccggcctgtcccccaatgggatcgcgctctcccgcgctgggatggtcaacctcgcgctcatggacaaggtgctcgacgtcgacgccaagaagaagaccgtcacggtgcaggctgggatacgtgtcgcggagctcgtcgacgcgcttcgggaacatggcctcacgctgcagaactttgcgtccattcgggagcagcaggtcggagggttcactcaggttggtgcccatggcactggtgcaacattacctcctgttgatgagcaagtcattagcatgaaactggttacccctgccaaagggacaatagagctgtcgagggagaaggatcctgagttgttttatcttgctcgctgtggacttggtggcctaggtgttgttgcagaagttacccttcagtgcgtagaaagacaccagcttgtggaacacacatttgtttccaatgcagatgaagtcaagaaaaaccacaagaagtggctatccgaaaacaaacatattaagtacttgtggattccatatactgacacggttgttgttgtccaatgcaatcctccctcaaagtggataaccccaaagttggcatcaaaatatggaaaagatgaagctttacagcatgttcgggacctttatcgcgagtcactgaaaaaatatagaactgaaacagaaagtaaagacccagaaatagatacactttcatttactgagctgagggacaagctgcttgcccttgatcctctggataaagatcatgtggtgaaaatcaataaagcggaagctgagtattggaagaagtcagaagggtatcgcatgggctggagtgatgaaatactgggcttcgattgtggtgggcagcagtgggtttctgaaaactgcttccccactggaaccctagcaaagccaagtatgaaggatcttgattatatagataagctgctgcagttgattgaaaaggaggagatacccgcacctggacctatcgagcagcgttggactgcccgcagcaagagcccgatgagcccggcatcaagctctgaagaagatgatgtattttcatgggttggtattataatgtatctgccaacatctgatgctcgccaaaggaaggaaatcacagaggagttcttcagttacaggagcctggcgcgaagtctctgggatgattattccgcctatgaacactgggccaagatcgaggttccaaaagacaaggacgaacttgccgaactccaggcccggctgaggaagcgttttcctgtcgatgcatataacaaggcacgtatggagctggaccccaacaaggtgctctcaaacgccaagttggagaagatgttcccagtgttggagcctcctcaccagacaaagtaatacgtgttgaagagcgcagagcaagggcacgtacgtagaacttggttgcaggaggcttaacccatacacatttgtagcactgttagttcctgtcatgattctgggaccctaccctggctgtcaaatgtgatggcgattaagattggtcactgaaataaagttttttttgaagttcgaaatgg

SEQ ID NO: 66 - DNA, 1547 bp, Zea mays
cagtctggatggttcgcggacctccactccacgacccgaacgttcgggagaaggcaaattccagacaccacacaggacacagcgcattcggctaatttcctcgtctctccccaatccgaccacccccatccattcaccaacccgaaatagaaggccgtccccagccaccagcctccggagttcctccggcgatccccgtccccttgtgtgcgcgctccaggagggccttctgcctccagcttgcagagcccacctaattgctgcgagatggatagagggcagaacgggagggatgacgtcttcggacgcagggatccattttctgggtttggcttcggcccccacaggagcttgttttctggtctccttggggggagggatccatttgacgatccgttctttacccatccgttcgggggtcggatgatgggtgaccatgacatgtttgtacctagtccttttgggccgatgggagggccttttggggacatgaggaacggtgggtttatcgagcaagctcctcctaggggtaacagaagaaggcctgtgatcacagaggtcgaggaggatggtggagagaacgcagagcatggtaaccagcagcctaaccaagatccttatgttcaggagccagacgatgggattgatgagacagaaggtggccaagtcgagctgcacagggatctcagtagggctaatagtggagggcagccgcaggctcgtactttcacatatcagagctcttccgtgacgtttggtggtattaatggagcttactacaccacttcaaagtctcggcggactggtagtgacgggatcactgtggaagaaagcaaggaagctgatacaacaactaaagaggctactcatagaatctcccgtggaatccatgacaagggacattccctgacaaggaaactgaattcggatgggaaggttgacaccacacagacactgcacaacctgaatgaagatgaactagctggatttgagcaatcatggaaggggaatgctggacattacttgcctgactggaaccacaatgctggtgcacctaatagcgataattctggtgaccgtagctccaatggacgtgaccggcgatcggcctcaggctgggcgcttcctgggaccgagcaaggccgtgatccgaggcgcaacgggaagccaaaatcacgggtcatccctatctcctgaagagcatggacggagtagatatatagagtagataaataaacagctggtttgtactactatgcaaggtttaggttcaagatcgtttcaaggaaacgacctgaggtccaggtaaccggagtccgcccagcacctcgcgtgctattgtctgattctgtagctgtacagtgctctgctaccttattatccgtgatgtgaaacaatttgtgtcgtccagtcttgctgtaaaatcatcatcgcgtatattgtaaacctgagtctgtatgtctgagttggctttgctgtgttgttgctagttgtttgggtcgctgaaggatgtgaagcgatctgcttctgtgtttgcgtaaaaaaaa

SEQ ID NO: 67 - DNA, 781 bp, Zea mays
tcgacctgagcagtgccaatctcgccgcgggcttccactgctttgccctatgcactatacgccgccccccggactggaaaattgcttccccgcggacctccactccaacggtgcccgtatctcctttgtcctggctggatccgtataatctcctttgtcctccccctcccctcgttcccgtctccctcgcggtcctctcaaccgtacgccgccgccttgctcgcaccgtcgacagtgcctcagtccagatcgaccctccctctacccagatcgggttccagttggcctaccgcccccgccgccctactacaggtgccgaggccttcaccggcgaagagcgcccgccagacaaatggaactgggtgataaggcggtcggttttctgctgactctgacaagcttaaccttatttacatactacacattctgggtcatcattttgccatttgtcgacagcgaccactttgtgcacaagtacttcctgcctcaagagtatgcgattttgataccggtactggccggcgtggttctcctttcgttcttgagcgtgtttgtgggccttgtgatgctcaaatcgaagaagaagaagacggcttaatcgggtttgccatgtacactgctgtgtcattcacttagtgtgatgaaatgcatgagttcgcagtatctaattgctagaagctcggttctgtaatcagttccgtcatactttaaaggtctttactttgtcatctggatgtgtgttttttttattctggtggtcaattaaaagcagtgttcatca

SEQ ID NO: 68 - DNA, 1466 bp, Zea mays
cgcgcgaccgcgaagtttagtcatcgtctccagctgctgtcttgctcttccccgccagcaccagcacgcagcacgcagcaccagccaccacaccacccgtcacgtcactactgctccttcctttgtcctctcctgcctcacgtctcacgccagcagaagcgccaaacaccagcagcggacgaccacgccaactctaggtctacgaggaaggggggggggagggaggagcagcgcagcggcagccgatggtgtcgacgagctcgacgccgcaccctctggatccgtccgtcccggccgtcgtggggggcggcaaggaggaggaggaggaggcggtggagtcttgtgccgccgccgccgccacgcccttgccgccggttgggatcgacgacgaggaggagggcccccggagagtgcgcaagccctacaccatcaccaagtcgcgcgagagctggaccgaccccgagcacgacaagttcctcgaggcactgcagctctttgaccgtgactggaaaaagattgaagcatatgttggctccaagacagtaatacagattaggagtcacgcacagaagtactttttgaaggttcaaaagaatggaacaggtgagcatttgcccccacctaggccaaagcgaaaggctgcccatccatatccacacaagtcctcaaaaaaggcccttcaagttgtcttaccacaacaagtttcgcacataatggagcaaggctgtggtacacctatggatgtagctactgttgctacagactctagtgtaaataatgcttttcctgttcaacatttcagtccgaggcatacacaagccatgccagactttgctcgtgtatacaacttcctgggaagcatatttgatccagagacaaatgggcatttgcagaagttgaaggaaatggatcccattgatgctgaaacggtactgttgctgatgaaaaatctgtcaatcaacctaactagtccaaactttgaggagcataggaggttgctctcttcggatgcctcaagcatggatcaaaagtcgggctcttcccgggttcatctcccgttcatgataacgagcaagtgagagaagcagctggctggcctgaaggcaagaaggtcgtttggagtcgtcacactcaggagcaaggcgatgcgtatgtacatatatcttaataagcagctttaggatagcttggtttgctcgaccgacatgttgcaagtttatgcgcctttttctttattctctgcccctccagttttgcccattgtagtatggaacttataacatgcgtgttttatgccgcatcttacaaaatatttttgtcccatcacaaggatgaacgggtgggggcatgtgtgtgttttttttgccgtgtgtgtatgtatacagcatgcggctgtatgtgtagatcaggctatatatataacagactgtgtgctgttctattattgccctcgtttcaaatactta

SEQ ID NO: 69 - DNA, 697 bp, Zea mays
ctgtctccacgagattgttgaattcctctctgccctagcaccagccatggcgaagccgcagcttcttctctgtttcctactcgccgcctccgcgccgctaatcgtcgccacggccaagaaatccggggacgtgtcggagctccagatcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattgggcactggacaagtgatcaaaggatgggatcagggtctcctgggaatgtgcgttggtgaaaagcggaagttgaagatcccatcaaagcttggctatgggcctcaaggctcgccacctactattcctggtggagcaaccctcatatttgacacggagcttgtcgctgtcaatggagaaccaaccaaccaatctgacgagctttagattcatcaaacaaatgaatccattcacctttttactcggaactcagcagatgtaatactttccaagaaatgagccttcattccctgccactttcatagtttctttcgctgttccacactgacatctatgatttttggagcaaactctgatctgttttgactagtttacacgtttgtgtgtggaatctgaagagctgttctgaaa

SEQ ID NO: 70 - DNA, 2165 bp, Zea mays
gcggccgggcgagcgagctgccacgtcagcgcgacggtgatcttcccccggtaacgccgcctcctcgcccaacccggcctagggcggacgattaaaattaacctaacaccgggttaaagcctccgcgctccgccccccggaatcggaccaaagccgggcatacgcccccaagtccaaaagccctctccgccccgctctcccactcgtaggtgttctccccgtctccgcccgcactcgctcgtccgcgcgcaggaaggttgacctgtcgagggccggcgaacccggtaagtaagagtgaaaatggatggaagtagtaaagggagtgggcattctgaagcattaaggaactacaacctgggaagaactttaggtatcggtacatttggaaaagtgaagattgcagagcataagcttactggacatagggttgctataaagatcatcaactgccgccaaatgagaaatatggaaatggaagagaaagcaaagagagaattcaagatattgaagttgttcattcacccccatatcattcggctttatgaggtcatatacacacctacagatatatatgttgtgatggaatattgtaagtatggcgagttatttgattacattgttgagaaaggcagattacaggaagatgaagctcgtcgaatcttccagcagatcatatctggcgtcgaatactgccatagaaacatggttgtccaccgtgacctaaagccggaaaacttgttacttgattcaaagtataatgtaaaacttgcggattttggtctgagcaatgtcatgcatgatggccattttctgaagactagctgtgggagtccgaactatgctgctccagaggtaatatctggtaaactatatgctggacctgaggtcgatgtatggagttgtggggtgattctttatgctcttctttgtggaactcttccatttgatgatgagaatattcccaatctgttcaaaaaaattaagggaggtatctacacacttccaagtcatttgtctgctttggccagggatttgatcccacgaatgcttgttgttgagcctatgaagagaatcacaattagggaaattcgggagcatcaatggttccagattcgccttccacgttacttggcagtgcctccaccagatacgacacaacaagccaaaatgattgatgaagatacacttcgagatgttgttaatatgggatttaacaagaaccatgtgtgtgaatcactgtgcagcagacttcaaaatgaggcaactgttgcatattatttactattggacaatcggtttagagcaactagtggctatcttggggcagattatcaagaatcaatggacaggaatttaaatcagctggcgtcatctgaatcatctagttctggtacgaggaattatgttccaggaagcagtgatcctcatagcagtggtttgcggccatattatcctgttgaaagaaaatgggcgcttggacttcagtctcgggcccaccctcgtgaaataatggttgaggtcttaaaagcacttcaagaattaaacgtcagatggaagaagaatgggcactacaacgtgaaatgcagatggtgcccagggtttcctgaagttaatgacacgttagatgccagcaacagctttcttggtgactctaccatcatggataatgatgatgctaatgggaggctacctactgtgatcaagtttgaattccagctttacaagacgaaggacgacaagtacctcctagatatgcagagagttactggacctcagctgctcttccttgacttctgtgcggccttccttaccaagcttagggttctatagtggtctaccatgtgcaaattttcactgtggtgatgaataaccgaaagcatgtaaataggaaccttgttctcgtattttggacaacgaacatgtttgagtgactggtcttgtgttgagcgcctaaaggtcatgtatacttaggttagtactatttccgttcttaaatatttgtcgcctgctagtgatagttcatttttgaactaaaacgttacgaataaaaaaagagtatattactgtctgcatggacatggctgtttcagtaggccgtggcaccgcagatggcgatgctcactgcaacctattatgaaaaaaaatgcaagattcaacttttgttc

SEQ ID NO: 71 - DNA, 800 bp, Zea mays
atagacaattttttccaaaaaaaagaaaagaggaaaaaaatgttatcttctacctccttagctgctcttctccatggccgcccccattatcctttccctgcgtcgaaggcgcatcttttcctagctctccccaacaaccctacccgtttcctggcctccgcctccgtccgggtcgcctatcctccccggtggcctctccgcgccgccgacggggagcgggacaaccgcgtgcaggagctgagggtgcccgattcttggctgacgcctgcaggagcaacgcaggaatctgaatggctgagggagacactgcgcaagtggctcgacgacgagtactgcccggagccggccaacgtggacatcagcagcaccgccgcgcggtcgtatcgcgaatccctgatagcgcggcagtctgacctgggagagatcttgctgaggatggtgggcgacctggacaagctgtcgtacagggagagcttccacggccccttctcggccgccaacgctgcagtccgtttgatcgctcagaggatggaggagtcactgcctgatgaatgacggtggtgcgcgacctggagtttctatatggcacgacttttgatgaagtcgtaggctatatgtacttttgacgatgaacaattcgatcaccattcctcaccgaggctgtcgctgacagaaaatggtgagaataggctcgagacttcatttttctgctgaaattcgccaacgtactattctgtttatgagcatgtctttgagacgagcggtgaaatgccaacgaggtgggtcgacttaagggagtg

SEQ ID NO: 72 - DNA, 4115 bp, Zea mays
gaaagggcgaaaaccccaacgcctccaaaagtttcccgcccgagcccctcgaaccctagtaccatcaccgactggcgacgcctcgccggcggccggcgagatgcacatcaaggaggtaactctcgaggggttcaagtcgtacgcgggacggactgtggtgccggggttcgacccgctgttcaacgccatcaccgggctcaacggttccggcaagtccaacatcctcgactccatctgcttcgtgctcggcatcacagatctccgtcaggtacgcgctgcctcgctccaggagctcgtctacaagcaaggccaggccggggtcaccaaggctaccgtgtccatcgtcttcgacaattccgaccgctcccgctccccgctcggctacgaggactccccggagatcactgtcacgcgccagattgttgttggtggaaggaacaaataccttatcaatggccatcttgcacaaccttcccgggtgcagacccttttccactcagtgcagcttaatgtaaacaatcctcattttctaattatgcaagggcgcataacaaaagtgctgaacatgaagcctccagaaattttgtcaatgttagaagaggcagcaggtacaagaatgtacgaaatgaagaaagaatctgctcttaagacacttgaaaagaagcagaataaagttgatgagattaataaactccttgatgttgaaatcctccctgcactagagaaacttagaaaagagcggtgtcaatacatgaaatgggccaatggcaatgctgaactggataggctcaaaagattttgtattgcctatgactttgttcaggctgagagagtgcgagatggcgcactgaatgatgtcaaacaaattaaaacaaagattgttgagctggatgaaactacagaaaacataaaagcagctatacaagaaatggacaataacatttctaccttggctgctgaaaaagaagctaaagtaggtggtgaaatgaaggttctgtcagacaaagtggataaactatcacatgtacttatcaaggaaacttctgtgatgaataatcaagaggaaaccctgaagtctgaggaaaagggtgctgagaagattctcacaaacattgaggacataaaaaggtctatactcgagagagatgctgctgtaaaaaatgtagagaatgaggcttctgacatgaaaagaagagcagaggatctcacaaaggagttggacgagaaggagaaagaataccagggtgtgctagcaggaaaaagcagtgcaaatgagaagaaatgccttgaagatcaactgagagatgcaaaagctgcagttggagatgcagaatctggactaaagcagctagctacaaaaataaagcattctgaaaaggagttgaaggagaagaaaactctattagtatccaagcgtgatgaggctattgctgctgagaatgagctgaaaacaaggacaaaagacttagaaggtatcaaggcatccatgggatctattaattatgacgagggtcagatggaagctttgcaaaaggaccgttctgcagagttagaaattattcaaaaattaaaggatcgtgttcgtaacctttctggtgagcttgctaatgttcacttcagttatcgagaccctgaaagaaattttgacagatcaaaagtcaaaggggttgttgcacgtcttattaggattaaggacagctcaacagcaacagcactggaggttgctgcaggtgggaggttattcaatgtggttgttgacactgaagaaactggaaagcaacttttaaaaaatggggatctacgaagtagagtaaccatcatacctttgaacaaaatccaaacttacatgatacctgacagagttcagcagacagctcgtagactggttggtcctgacaatgtaacattagctctagaattggttggatatggtgaggaagtaaagaatgccgtggcttttgtctttggctcaacatttgtgtgtcgtaatatggatgcggcaaaagaggttgcgtttaataggcaaattagcagtactagtgtgactcttgagggtgacacttatcagccaagtggtcttttgactggaggtagtaaagggggtagagggaacttgctaaggaaactcgacgaactagctaaagctgaggctgatctatctgatcatgagaaaaagctctttgtcattgaacagcagattggagcccttttaccattgcagaaaaggcacactgagttgaaatctcagtttgaactgaagtcatatgatctctcgctgtttcagaacagagttgagcaaaatgaacatcacaagttaggtgagctcgtaaagaaaattgaacaagagcttcaagaatctaaacaagagttgacagaaaagcaagtgcagcatgaaaaatgtgtgtccacagtttctgagttagagaaaactatcaaaacttatggcacggaacgagagggcaaactcaaagcgctggaaaaaagaatcaaatcaattaaatcagagatgcagtcgatgtcgaagcaactaaaggcttatgaaagtgacagggagaggctgatcatggagaaagatgcggttgttggtgagcttgctacactggaagagcagctaacgacttcaaaagctcagattacttctctgtctgaaaccttggaaaaacagaaggacaaggttacatccataaagcaagattatgatcaagctgaaagtgagctcaacgttgggcgttctaaactgaaggaatgtgactcacagataaaccgtatggccaaggaacagcagaaacttcaacagaagttaagtgattcaaatgttgagaggaagaaaatggaaaatgaggttaagaggatggagatagagcagaaggattgctcttcaatagttgataagctagtcgagaaatataattggattgcaactgagaaacaattgtttgggaaaagtggtacagattatgattttgaatcttgtgaaccacataaagcccgagaggaacttgaaaatcttcaagctcaacaatccagtcttgagaagagggtcaataagaaagtaatggcaatgtttgagaaggcggaggatgagtacaatgatttgatgtcaaagaaaaacatcatcgagaatgacaaggcaaaaatcaagaaagtgatagaggagttggatgagaagaagaaggaaacattgaaggtcacttggctcaaagtaaacaaggatttcgggtctatattcagtactcttttacctggtacaatggcaaaacttgatcctccagaaggtggtacttttttggatggtcttgaagttcgtgtggcatttgggacagtttggaagcagtctctgtctgaacttagtggaggacaacgatcccttcttgctcttagtcttatcctggctctgcttctttttaaacctgcaccactttacatattggacgaggttgatgctgctcttgatctgagccacactcaaaacattggtagaatgatcaaggctcattttccgcactctcagttcatagttgtctctttaaaagagggtatgttcaacaacgccaatgtgatatttcgaacaaaatttgttgatggtgtgtccaccgtgacacgaacagtgccttcgaaacagagatgaccagtttacacatcatgcatcttctgaaccaaaactaggcatataattccaaatctgtcattttaaggagctgctataatcaaacattttcgctgtttattcagccatgaaaattattccatgaaagctgaaccccacaattacttgacgctgatgcctcaagcccctcgcttgtcaggcaatgacatcaaaataggtgctgtaactgtaatctcatggcgtgacgttcatgatgacctcgactggcttctacattatgcgctttcttctgacctgatgtgtaattagcggttgaactattttgtgttgaaggtcgaccgtgtagcatgtatgtaacagccatttataaccaaggtcatgtataattctgacttgcaaatttaccctatgttgatttaccttttattacttagaacaaaaatctcatcatagttttagaaagtcaatgctctaaacacttcataatattattgactatcgtgtgcat

SEQ ID NO: 73 - DNA, 984 bp, Zea mays
gaccccgcgaccccgacgcctgcgttgccctacccctacctgacctccactgctccacacctccacctgcctgcgacaaaagcaaaacctagccgccgcggcgccgcccgccgacctgccgtgccgactgctgagtgccgaccgacgtgcgcccgctgtccgctcgacgttgttggcctccctcgacgccgctggcaggtggccgctcgacggagtcgacgcctcacagcctccctcgacgcgacgccgctggccactcgacggagtcggcgcctcacagtcacagtgagatgtcagaatacaagaacgtcgttggggggaggctaaagctgaagggtaaggcactggacgtgaaggaaggtggagtcaagaagaaaaagaagaagcatcaactcgaagagtcgtctcagattgagcacgatgagctccacaaagggggagactctggcttaccaactgatcacaacaatgagcttattgaagctggcaaggtgggagatgaagaagggaatccacatcccgactatgaccatctgacaccggcggagcgacgctatatagaacagaagcggaagatcgacatgcaaaagctggccaaagttgccaacaagtcacacagggaccgcatccaggacttcaaccagtatttggcgaacctcagcgagcactatgacatccctaaagttggccctggctaacatacatagccaaactgttgtgtaggcacaaacaattgtatgctaggtgggcttcaaggacattaaaaataaataaataaatgtatgtttggtctatccagctttttgttagtatgttatgtatgattttatatttgttgtataatgacatggtcgattcatgccgtcaactgtcgcggtatatatatgtggattgatttgaattgattttatatttgttagcatgttatctattttccacttttcttttaaaaaacataatttattactcttatgtggattgatt

SEQ ID NO: 74 - DNA, 918 bp, Zea mays
agaaccacattccataaacccaaaatagcaatcagctcatctgtcagcgccacaggtgaccggaaaaccacggccggcgttcctgcttctctacccggtccgaattgctgaccggatcaacccgagaccttgcaggattatcgatctgattgcggcatgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggaccatttctttagcaatgtttgtgagctcgatttagtgtttaattttcacaaggtttacctgatactagatgaatttattcttgctggggagctgcaagaaacaagcaaaaaggcaataattgagcgaatgggtgaactggagaagctggaatgacgaagaccaggaagatgctgccgcgtgtgttgtattccaatttgtattattcgtttcaggtgttttacatttgctctcctggttcgttccggctgacagcgtgatgcccatgctgtcactcgaaagaatggtagtagtagctagcatgagtacattataaacgtaccttcgaaaacataataatttcccagcaattatttcgttcccctctgcagtgaaaatgaaaaagacaaaacagcgcgttattcgtgcgactatgtttgcagtgccgaccagctgcagctgcagtgggcctatcaattatagggctggcaaggaattttctcaatcata

SEQ ID NO: 75 - DNA, 1597 bp, Zea mays
acctctctcccagtcaccgccaccacagccgccagcagtccatcaccggttccgttcgaatgggccgcaagggacgcaaggctagggtttcgcgcgacgccgacgtcgacggcagcgaggatgagatggccgccgctcctgccgccgctgcgggcaggagcctctacgagatcttgggagttgagaagactgcttcacaacaagaaataaagaaggcatatcacaaattggctctgcgcctccatccagataagaatcctggggatgaggaagccaaagagaagtttcagcagctgcagaaggttatatccattcttggagatgcagagaaaagagctttatatgatgagactggcattactgatgatgatgcactggtgggagaagctgcaaatgatcttcaggagtacttcagaacaatgtacaagaaggtcactgaggctgacattgaagaatttgaagctaaatacagagggtcagattctgagaaaacggacttgaaggaactctacacaaaatataagggcaacatgaacaggcttttctgcacaatgatttgctcagaaccaaagcttgattcccaccgcttcaaggatataatcgatggggcgattgctgaaggtgagctgaagtcaactaaggcgtatgagaaatggtctaaaaagatttcggagatggagccaccaacaaatccattagagaggagagcgaagagtaggaagaaaagtgaggagaacgatctgatcctggccatctcacagcgcagggctgagcggaaaaaccagttcaactccatcctctcgaacatcatgtccaagtgtgattccaaggcaagcagttctgagcccacagaagaggagtttgagctggcgcgacagaggctggagagcaaaatggccaagaggcgcaaatgatgcctgctgccagccttctttccctatgcgtctatgccgaacatcgtcttaagctttgggtgtgatctgattttaccagcacgcaagtgatggttgtgagagctagcttgagcgtgtcaggatctgtatcatatctcgtgtcctctgggacagtaggtcgtgtggttatcgccttgccgagagggaagctttctctgaacttcaataccatggatacgtgggtaatggctatgcagttgtagtttagtgtgtgtgtggttatatatataatgtaatcgtgccagcagctatccgattatgttctttgaagaaagctgtagtgccctccaggcctcgaggatgcaagtgttgaagggcggacaacaggcgggctgtggcttataatccagtcctcacgaggtgtaattgccattaatgtcgaggtttacaacagcatcaagtcctgcaagtaccgatgcaaataccatcaccatgtttatcatttacaagtgtaagagctttccatttgaataacgctctagagtcagagactcgccgctgttggctttttgactagagcaaaaacggtgctcaaggcaatggccatcgttgctgctgaaatcgcagaaagtgaagctggcatatgattagagatgtcaatgggaaattttccaccctttatagtatcctatcatgtttgatct

SEQ ID NO: 76 - DNA, 1758 bp, Zea mays
ggcgaaggaaggtgaagcagcgtctcccctcccggtcgccagtcgcgtcgaccccgagtcccgaccggtgcgcgcgcaggcgcacagccaggacacgaccgagcacggagcaacgtcgccctcccccagtagcgcagcccggccacgccctcatcgcccatcctgccgggccgcgtcgccgactcgccgccaattaccattcgcctctgcagacccgacacggcgcgcggctcctcgccgatttgttcccggcggctcatcagaaaggctgtctccttggggggatcgattactcgcgtggctcgcagttcgcacgatactcgggggttctgacttggttctaaacagcatctgcatcttctcgaccccccaggctttggatctggccttcgtctcagttcagcgagccgcgaagaacagccttgatttggtgccccaagtgatgtagtgtgagaggctaacttcttgagagcgcgatgagcagccagggattcggtgcggggagccccaagtccttccgctaccccagaggcggcgacttcgatctcgagtccgggtccccacgcaagggccgcaagcccaagaaccctcacctcgagacctcgatcgtcatgaggatccgctacttctacgaggcgcaccccgtggccgtcgccctcatcctcctctccttcgggctcagcgtgctcatcctcctctccgtgtacgagacccggttcaggacgatgaggagcgtcagtgcgtggtccagtgacggtggggattatccattgccaatgctccggaaccttgtcatggtggctgggcattcgatctatacgagctcaagatgcggggagaccgagagtgagaattcctggttcttggagccgtaccagaagcacgctggacaggcggccaccttcctggctcacatcaaggagggggtggggatcgcggcgagggatgagggggcactcctgttgttcagcggcggggagacgaggagagatgctggcccgaggagtgaggcacagagctactgggctattgccgagtcgaaaggatggttcggaaatgatgagggtgtaagaagccgagcactcaccgaggagcatgcacgagatagttttgaaaacctcctatttagtgtgtgccgtttcagagagctaactggaagatacccacagaacataactgttgttagctacgatttcaaggaggaacgttttgcacaactgcacagaaccgcactcggattcccggaaggaaggttcttcttctcaggtacaccagctacgccttctgcaagggaggctgctctgaaaggcgaagcagctgtccgagctcagttccttgaagacccgtatggatgtctaggatctcttcatgtaaagaggctgaagcgggacccgttccaccgaaccattccataccctgccggttgcccagagctgaagggtctgttctcctattgtggcccggtgccttactctgggcacctcccttggactgagtagtagtgtaatgtacatcagccttggatggagctccccactgccacttcacgatgtccagcagccttgcactgaccttgttctgaattgagggagagtatatgttacactatcaacatatggatttttaacctttttgtttcttctcgatgacttggctactgtctttactcacaattcaaacttgtgattttatttttacacgtactccgccttattctgtggtgcaatgcaaacagtgaagaacttcccctttgcagcc

SEQ ID NO: 77 - DNA, 670 bp, Zea mays
ccaggcaagcgatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgttttttttccttcctctttctacttgattttcatttaacgaattggtatcgctgatgcaccagtttaatttggtgccctgttatttgttctttccctcgagtgagggatcgacacctgtaccattgcttgccatttgtctggaccagttcaacaattcgatttaaccatcacgtatatgtgtgctttggataaacattattacattaccctcatggtgaggggattgccggtttgttatgcctt

SEQ ID NO: 78 - DNA, 1407 bp, Zea mays
cgctcgctagtcacctaccgcaccgccaccgccaccgccgccgccgccgcgcccctctcgcacgcgcagcacaggacgcgcgcgatcccctcgcgtccggatcgccatggcctccacggcgttcgccgccgccaagtacttccccgcgcacctcgactcctccccgcgcatcgcgccccgccgcgccgcgcccaccgcgagcctctccttctccccgctctccgccagcccgtcgtccctgctccgcctccggtccccctgcccgtccggcccggggggcaggctgcctccgccgccgccgccgccgccgcgatcgtacggcggcggcggcggatctggtggcgacgccgcgaactccggcggcggccgccgcggcgggggcatcctcgggctcttcctcgccgggtgggccgcccgcgtcgccgcggacccgcagttccctttcaaggtgctcatggaggagctcgtcggcgtcaccgcatgcgtgctgggcgacatggcctcccgccccaacttcggcctcaacgagctggacttcgtcttctccaccctcgtcgtcggctccatcctcaacttcgtcctcatgtacctcctcgcccccaccgccgccgcgtcgtccgccgcctccgcgctccccagccacatgttcgagcccggcgccttctcgctcggctcccgcgtcgccacgctcgtgtccaagggcgccaccttcgcggtggtcggcttcgcagccgggctcgcgggaaccgcgctctccaacggccttatggcgatgcggaagcgcatggacccggcgttcgagacgcccaacaagccgccgcccacgctgctcaacgcggccacctgggcgctccacatggccggcagcagcaacctgcggtaccagacgctgaatggggtcgagtacatgctcggcaaggtcgcaccggcgccggtgttcaaggcgtccgtcgttgttctccgctgcttgaacaacgtgcttggtggggtgtccttcgtgctgcttgctaggttgactggggcgcaaaaatcagataagccggcgacggtcgcggaagagaaggataggttgatagctgtgggcaatgctgcagcagatgccatcggtgaggcgagagatggagaggagggtaagtaagtggtagaggagaggaacagtaagatgatggtgcatcgtcccacgctcttttgcaagaaacctgtagagttggttggaatggaataaggagtgaggctcaacttcttttcttaaagtcggtttgtggtttgtcgctgttgatgattacttcctccgtttcgttttagttgtcgctggatagtataaaattaaactattcagcgataactagaaagaaacaaagaaacggagggagtatatgcttagaatgaagtttttctctcatcctt

SEQ ID NO: 79 - DNA, 2589 bp, Zea mays
ctgatgtggcctgtggcaatgcaggtgtccgtactctgcgcttaaatcctttccgggtggagttcttgcctttctcgccgcttccgactctgccatgccaccatagatccagctagggcgttcaatcctgtgcgagagtacgcgaaatcgccgccggattgatattgaccaggggtttctccgcccaactgaggtttcgctgccatttgcagggaccgtgctccagttcggcctttcgggggaaaaggaatcgtatctgctgaatccccgggctccggggatggatcttgacatggacggctacgtagacccctacgaggaggccgcggccgagggcgactccgacgaccctgacgaggacgactcggatgcggagagcgactacgaggagaagtcgttcggcctcctcaagtccggcaagcaccgggtgcgcaacccggacggcaccttccgctgccccttctgcctcggcaagaagaagcagggttacaagatcaaggacctcctccagcatgccgacggcatcggcgtctccagcaagcaccgacgtcacggccgcgaacgcgcgaaccaccgcgcctttgcacgctttgtccgcaccgatccgtcctttgcggaagacctcgtcggtataactggcattcaaggtgccattacaactacccctgctaatgagaactacagcgccaatggcaacgggaaggccaaggctaatgtagatactgctggttccagttctgtggcggcaaaagtgggtccgccacaggaggttgagaggtttgcttggccgtgggcttgtgttcttgcagctggggcaggctttaatgctgaggactttgttggtagagtagcattgttcagttcggttgaggttgtgcctttgtttgtcgatgagatggaagtcacagaaaccttcgcaattgtgaggtttaccaatgattggagtggattcaatgatgcacttacgatagagaactatttcagcgtcaataagcttggtaagaaggaatttcagatgagagatagtggtcttggttccgtggagggagatggcgaaggcgatgtcaaggtttatgggtgggttgcccgagctgaggactacgatgcaacgactgtggtaggaagattcttgagaaagcacactgtcctgcaaacaatagacgaggtttccaagactgaattagagaaatcaggggagatggtggcgatactggcatcccagatcgaggaaaagaaccgatacttgcaggatttggagacaaagaagaatgcgacagaactctccatctcaaggcttgaggaggacaacaggaaacttcatgaggcatacaatgaagaaatgcgcaatcttcatcgcagggctcgtgaaaatgcgctacggattttccaagagaatgaaaacttgaggattgacttagaaaataagaggagagaactgaacttacgagctaaggagcttgaaaaaatgtcagctgagaatgctaacgacaggaagacactcgatgatcagaagcagaagacaaagtatgataatagtgaacttgagctagctagcatagagcaacagagggctgatgcagatgttctgaagctattggctgaccaagagagggaaaaggaagatgtacttgctagaatgcttcagctggaaaaagagctgcatgagaagcaacagcttgagctcgaagtagaacggttgaatggtacactccaagtgatgaaacatctagagggagacgatgacgggggagatatccatgaaaagatggagaagctgagtgaaagatttgagcgggaaaagaagcgcctggaggatttgagtggtgatctggtgacaaaagagcgtgaaagtaatgatgagctacaacaagcccgaaaagaattgataaagggtttggaggaagagctaaatggacggacagctgttgggatcaaaagaatgggggaactcgatgaaaagcctttcctaaatgcatgtaagagaaaatatgggaacaatgaataccaggtcaaagcagcagagctggtcacaaattggcaggaggaactaaagaatccatcctggtatccttttaagatgattcatgttgacggagaggacaaggaaattctggttgacgatgatacgaaactgaagtttctgtggattgagtttggcgatgacgtgtgtaatgcggtgaagacggcattgatggagataaacgagtataacccaagtgggaggtatgttgtgcccgagctgtggaacttcaggaaaggcaggaaggcgacgatgaaggaggtgctcaagtacctgttcagtcagatggacacgacgaccaagcgcaggaggggctgagtaggtgcccttggccatgccgtgaagcccagtcgtgtgctgctcgatcccgtagtggcagtctgtcttgtactgtgtagtgacatctgacgtaataatgttcaggcttgggtatggtttgagctaacgagccatatagtgtgcttggctaggctcgtttacgagctctttagctcgcgagtcaggtgagaacagaaaaaacaatatgtatataataattaatttctagttaattttaaactaatttaaca

SEQ ID NO: 80 - DNA, 2462 bp, Zea mays
atacttgcccctcctcgacggttcgccaaaaggttcgagacgcgcaccgccagccgatacgaatccgacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggcgtacgcgtcgctctggcgctacgcggaggcgctagatgacgccaagcggaccgtggcgctgaagccggactgggccaagggctactcccgcctcggcgccgcgcaccttggcctcggtgacgcgcccaaggccgtcgaggcctacgagaaagggcttgcgctcgagccgtccaatgaggcgctcaaatccggcctcgcacaggcgcgccagtccgcatcggcgccgagacgtccggtgggctccggggctgacgccgttggcaagatgttccagggccctgagctatggagcaaggtcgcggccgatcccaccacgcgtggctacctcgaccagccggacttcgtgcagatgctgcgggaggtgcagcgaaaccccggcagactgaacagctacctttctgaccaacgaatggttcaggtgctcaccctcatgctgaacatcaagttccagaaccagagcagtggggcgcctgacccggcagcagcacaatcgaacccgccgccaccaaagcagcagccagaggcgaaggcaagagaaccagagccggacccggagcccgagcctatggaggtgacagaggaggataaggagcagaaggagaggaaagcgtcggcgcagaaggagaaggaagcaggcaacgccgcttacaaaaggaaggattttgataccgcgatccagcactacacagaagccatggagctcgatgacgaggatatctcctacatcaccaatcgtgctgctgtttaccttgagatgggaaagtatgatgaatgcattaaggactgtgataaggctgtcgagagaggaagggaactgcatgctgatttcaagatgatctcaagggcacttaccagaaaaggaactgctcttgccaaacttgctaaatcatcgcaagactatgatgctgccattgagattttccagaaggcgttaactgagcaccggaacccagatacactgaaaaaactaaatgatgcagaacgagcaaagaaggagctggagcaacaagagtactatgacccaagaattgctgacgaggagcgagaaaaaggtaatgagttctttaagcagcagaaatatccagaagcagtgaaacattacaccgaagctctcaggagaaaccccaaggaccccagggtatacagcaatagggctgcctgttacaccaagctaggggcccttcctgaaggtctgaaagatgctgagaagtgcattgagctagatcccacattctccaagggatacacaaggaaaggtgctatccagtttttcatgaaagaatatgacaaagcgctggaaacttatcaagctggcctaaagcatgacccgaaaaaccaggagttacttgatggtgtaaggaggtgtgttgaacagatcaacaaggcgagcagaggcgaactcagtgaggaggaactgaaagagagacagaacaaagccatgcaagaccctgagatccagaacatcctgactgatccgatcatgcagcaggttttgacggatctgcaggagaaccctcgggctgcgcaggcgcacctcaagaaccccggagtgatgcagaagatccagaagctcgtcagcgcagggatagttcagatgaagtagacggtggctggaatgtccgggttcagatctgggacctgtgctggaaatgctgtgaacttgatcattgtttcgcattttggaaactgaacccttttgtgcgaccatagtttggtcatggctgttaatgatccatatatgggttttcccatccgatatgttccaattcgtgcctttccccctggaatgcccgtgaaaaaggaagaatattcatcaaccttgcactcgagcagtttgtagagtcgtttaatgcgatggtatggtaccgtactaccgtggtaacatccagttgaacagcggcagaggtagtatttgcccccctcgtttgccaccggatagttactaggataatgattggtaccatccggataggcatcagggaacatatgaggtacactatgcaatcaagacgtgaaagtttttttttttaatattagtacataggaaaggtgagagtgagaggctgttttgaaacataatattatagatgaggtgatgtaaacataatagatggaaccatacatacatattagtagtgcaactatataaccaagacacaagtatataaatgagagtgaaatggttgtttaaaatat

SEQ ID NO: 81 - DNA, 1320 bp, Zea mays
taaatttgttcttttctttggcgtggaaacctcgaccgatctgtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggcccgcctcaagaccttcgcccacggcacgcagaccctcactaaacttcgctttacaaggaatgattttactgaggatgataaagcggcgttcaaaaaagtgcttcaggaagatggcttttatacaattaggctgccatctaatgtgttggacactacaaagaaacatcatgttgtttcttcaatcagagctagatgcattccacgtgacagtttggatgaacacattgttatccacatggatggtgtaaatatcttggcagtcaattatggctctgttgatgggtgccaataccctaggcctatgaaattgccatcaaaatggacattcagctcttacactatcctaaagactgctgaacaggcaccaagaaccccatcgtttgcagatcagttaatagaagctgacaatggtcttggcgaagtaatgaaaccacctgagaaatctttctgggctaaatattggatgtacatcattccgcttggtcttattgtcatgaatgctgttacggcagctgccaacataccagaggaagctgcagggcagggccaacctggagcacaacgggcacctgctgctgttgctgggaggaggagatgatggctgccttccataccgtagttaactatcttcacattgttttctgttttttttggggtattgtatcaatcttaccttgactgcatcatctatggcactgcatgatgatgccatcttttgcttgtgttgaaacacgtagcctatccaagacaatgtggttcctatacatctgtagccaattttggccactagcatgccattggacactgaaactttgcttgaagcctgtgcacacatcatttgcagtgaccacttcatacttgatgcagcaaaaacacctattaatttcagctgttgaattttctgctaataattcatgctttc

SEQ ID NO: 82 - DNA, 1289 bp, Zea mays
aaacctcattccaagctctcttcattggttcatagctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgagccaggcggccagcaagtacatgcagaggatctaccctctaggcatgcagaggagcagctccagcctcacattgtcgtcgctctcgctgtcgcagaactccaacgactcctccatcagcagctccaactccagctgggagcccaaggtgccgctgctctacggcggcaccttcagcccatggggcgacgtcatggtgtctcgggagatgaggcgggaggacgatgacaaggtcagtgaccatgacgtcgaaggaggcgaggaggacttggactgcagtgagccggggagcctgcgtaggtgcagctggatcaccaagaacagtgacgaggcgtacgtccagttccacgacgagtgctggggcgtccctgtgtacagcgacaaccggctgttcgagcttctgtcgctgtcagggatgctgatcgaccacaactggacggagatactgaagcggcgggacatgtacagggaggcgttcgccgacttcgaccccagcgcggtggcgcggatggaggaggaggacgtggcggagatcagcggcgacagggagctgaggatcgccgagtgcagggtccggtgcatcgtggagaacgccaggtgcatccagagggtggccagggagttcggctccttcagcggctacatgtggggccacgtgaaccaccggccggtggtgggcaagtaccgccaccacaagtacatcccgttccggacgcccaagtcggaggcggtgagcaaggacctcgtccgccggggcttccgcctcgtcggccccgtcatcgtctactctttcatgcaggccgccggcatggccatcgaccacctcgtcgactgcttccgcttccacgactgcgtccgcctcgccgagcgctcctggggcatcaccaacgtcgccgcgtaggcgtagccagccggcccctcaatatctgtgcatgcatgcctctccaagtttttcacaccttcttcttggtgttgttattgtttttttgtttggagatcggaattgtgtgtgaaattacgtagagtatgtactctactaagttatgatgtaatacttctattaactctttgccaatgaaaagtagtactgaacta

SEQ ID NO: 83 - DNA, 2249 bp, Zea mays
ggctagctgtcaggacggctcagctccagctttgcggccctccagctctccccagttcaagttcaatattggcgagcatgcgagtttgccctcttccgtcgtcgtcatcatcatcgtcctcgcgatcccggcgtccctgtttcggcctacgcctcccgtagacaacagttgcgccctgctctccggcaagctatggccaagctgagctgcttccccgctctgctccccggcaagaggaagaagaagacacgcaagatcaccgatgctatcaaggccagcggcaacgagtgccccaaggtgaagccggtcgaagtcgaactcatcgacccgacgcttggtgcaggcgtcgtccaggacgtcgtccccgccgagctctcggtccccgtggaggaccgcaacaataaggaagcggctgatcaactggtgttggtgaaggagagcgatctgtcagatttcgacttcagcttccacgcggccatgaagcccgtccggtccgacagtgacgtggcactggacacctcggccgacgctgcggtggcggacacatcgccgaagctgaagcggtcttgctccaacatcgagactaagcgaccaggctcgcgttccgcgcccgagatgccggcccggtcgcgctcctacggcgatctgggcaacctggtcgccggcctcgccctggacgcgacggcgaccccgcacggcgcgccggaggccagtccggcgtccgtgaagacgtcgcgcactgccgaccgcgtgatgctgaagaagcggtcgtccagccaggtgctgccctcgcgcagccggaagctctggtggcggctcttcctctggagccaccgcaacctgcacatgccgcggtcggcgcgcacggcccaccgatcgttctcgcctggccgccacgacgggtacacctcggacacgttcgaggagggcccggccgccgaccgcaagaacaagacggtcatggtcgacgagtcgccgccagcagcgtctgtgcccaaccagtgggtcgccttctgcgccgagagctccatccacgaccgcgtcagcgcgtgggtcagcagcatcgaaagcgagcctccgttcgatatcgccgaggaggatgacgacaactacgacggagaggacgatgaggagaatggcgagtgtgcggcgtcgcagccgcgccatctcgagctcggggagccatcgtccgggaagggcggaaacagcaaatccaagcgctgcgcaacgacggccgacgaggtcgtccaggccaacaccgtggtgcagtccctgaacgccttctcgtcggtggcgcacatctcagggatgggcctcaaggtggtgccgatgatcgcgcccttctcaaccctccgggccgtcaacctctccagcaacctcatcgttcatatctcccctggatcgctgcccaagggcctccactctcttgatctgtccaggaacaagattgccagcgtcgagggcctccgggagctcacaaagctacgcgtgctcaacctcagctacaacaggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgtaggcaacccggtgcaggccaacatcggcgacgacgccctgcgccgggcggtcacgggcctcctcccgagccttgcctacctcaacaagcagcccgtgaagccgcagcgcatcgcgcgggaggtggccacggacagcatcgcgcgcgccgcgctcagcggctcggacagccggagcatccggaagaggacgtcgcggcggctcacgcagagcccccgctcgtcgtcgttgaccagggcccgtggcggcggcggcggcggttcacccacaccaagaaacacctctcgtcgtcgttgaccagaagaaccaactgcgtgattcgcgttgctctttggagacgggagacggtggcgtgactgcgtgcaggcagactcagacgacaccatgattcggcacggcgccagcatgatatgagacaaaccaagtatataaagcaagtatgatgtgagagaattgcgatgcaacacataatgtacatacttgttagggagatattgcttagattaatactacgaccgatgcatctttgtacctga

SEQ ID NO: 84 - DNA, 642 bp, Zea mays
agatctcttgggtcatcctctacgcgagcgggccgcttctcccatccagccgcgcacggcgtcgccggaaccggagaagggagggaggaagggagcgcgagatggacaaggccaataagctcagcgccggagcgggggagaaggcgaccaagagcaggagccacgggtccacggcgctgttcgtcgcggtggactacgcgttcctgctcgccttcgccggcttcctcgcctacctcgtcgggtcgcggatcctcccctccgccgccggctccgcctagaccggcccgcgttcgtggatctctcttctttcttccacgttttttttggagccgatggctgcgggagcaccgggatcttgccgggtggttctcgtctcggaatcgatctcgatctgatgccgctcccgcgatgtaatctggcgacaatttgacgagaagagaactagcggtgtgtttcttggcaactcgcctggtaatgtgacgcatctttccttattctgttgctactagtactatccctgctcgtgtcgtgtgtgctgagagtctgagattgcttgggactttgaatgcggcgtttatgccgcgatctgtgatgtctgcttgctactgacgccaacttaaagtaaacccatcagcttgcttc

SEQ ID NO: 85 - DNA, 691 bp, Zea mays
ggggaaggggtttaggaacaacccatctccattcaccaacggcgcctccaactccgagcgccgcctctgcctcgaaaactcttactcgcggagctgcagccaggggggcgaccggtgtgtgaaccgctgccgctatggctgctgcttccgttccgccaacatcttcatccggcggctgggacttcacctgtaaccttgaagtcgattatgggtctgaagaaaatgcatccatagtctacagaacgttagcagttgacaaggagttgcagcctgacaaggtgaagagggagatgactctatcaggcagcaagctggccgtccacttcgcagccgtggaggcccgcttcctgcgagcatcgttcagctcatttgtggatcttatgggactcgtgacgaagctcgtcgaagaatatggtgtggccaatgcagggcattcttgaatcttgatgaacaatctcatacacggcattgcggagttgattttagttcgcctgtgagcaatttggagttttggacagtctttaccagtggaactgctcttgatctgtgtcaagctagtgtagtatttgcccttgattggtcaaatcctattcggaacggttaattcttttcggcaatgccgttgtgaaatgtatagatgatgaataggtaaaaattatctatatatcctcagttaggctttctccacgag

SEQ ID NO: 86 - DNA, 1675 bp, Zea mays
gaaaactagcccagcccatgtatatccaccggcactcggcacgaagtccatagccagcgaaactcccgaaaccgtaccaaccagacaattcaccatggcggcgccggcgcaggcgcaggcgcaggtcctgcctctcctccggtggagccggagcgcctccttcctctgcgcctcgtcgcgccgcctcttctccgccctccaacgcccctctgccgctgctcgctgcgaggccggctccaaggccatgctcaaggggatggactactcggaactcgagaattgggtgcaggcgcaggggtttcggccaggccaggccatgatgctgtggaaatgcctgtacgggaacaacgtttgggctcattgctacgacgagttggctggtttaaataaggatttcaggaagatgataaccgagcatgctgatctcaaggcattaactatgaaggacatccatattgcatcagatggaacccgtaagatattgttctctcttgaagatggttcagtgattgaaacagttatcattccttgcgctaggggcaggacaactatctgtgtttcaagccaagttggttgtgccatgaactgccagttttgtttcactggaaggatgggtttgagaaaacatctctcgacagctgaaattgtcgagcaggctgtgtttgctcgtaggttattctcagatgaattgggatcaattaacaatgttgtatttatgggcatgggtgaaccatttcacaatattgacaatgtaataaaagcctcagcaataatggttgatgagcaaggtcttcattttagccctcgcaaggttactgtctccacaagtggtcttgtccctcagttaaaacgcttcctccaggaatccaattgctccctggctgtcagtcttaatgcgacaacagatgaggttaggaactggataatgcccataaacagaaagtacaatcttaacttgcttcttggcactttaagggaggaacttaacctcagacaaaaacaaatagtgctatttgaatatgtcatgctttctggagtgaacgacagtatggatgatgccaagaggcttatagagctagtccaagggatcccatgcaagataaacctcatctctttcaatccccacggcggttcccaattcaagcccacaccagacgataagataattgagttccgcaacgttttaattcaaggtggcctcactgtttttgttcggctcagcagaggggatgatcagatggctgcctgcgggcagctaggagagcctggaggctatcagctacctctgctccgtgtgcccgagaaatttcaggtcgccttgtgatgctaaacagtgcatacagtaaaaatggtcctgagcagcttgacgaacacacggagtaattggcttggaacgacgattcgatcgtgcaaatcttgcaagttctaccgccttcggaagcttgtgtggacttctgcaataacgtgcaaatctgaacctgggtacttgtgcgacaacacatttagacatggtgttgcttctgctagtacgtggtgtacccaaaccaaattcgataagattattattattataaattggtattttctggcaaatcgttgctgtataagacattaacagtgtaacatgctttcacttggtacttcgaaaaatatggaatgaacttatacggtaatc

SEQ ID NO: 87 - DNA, 2353 bp, Zea mays
tgcagcactagcactggtaccagcaaccttcacgagctgcgtggtgaggttgaccaggactccttccggatcctgaaataaggccaccgctcgtttcctctccacctccctcctccttcactccctccccttgcgtttagcctcccgctgttgtggagccgcgggccattcccaaccatcgttgcggtggtggccggtattggccgagacccatgggcatccaggtcgcggcggtcgtgatcccgccgccctgctcttctccttcctcctcctcctcctctccggcgtcgccttcgtcctcggccattgccacgtcgccgcagcatgccgttcttggcgccaggctggcgaggagccagtcgtcgctggcttgctggaacgccgccggtctcggccggcggcgcggcggggagcacacgatcaggcgcgctctcagcgcgagcatcgacagcgtcgggagcgacggcggggacgacgaggagttctcgaggaggatccaggagctcgcggtgggtcagcacccgggcgccggcggctgcgggtggccggcgagcgtggagcggagcgcgagcagcgtcgggctgccgctgtccctgcggatgctcaaacggaggaagcagcagcagctggagcaggggcggtgggacgagcggctggtcgacagcgccggcgagtccgcgcgcgccgcggtggggcgcgccttctcctcgatggtgctcatcatccgggagctccagagcttcacgctgcagatgcgggagacgctcttgtacgaggacctgcagggcgtcctggcgcgcgtccacgccgagatgcacgcctccttcgtctggctcttccagcacatcttctccggcaccccggcccttatggtctccctcatgctgctcctcgccaacttcaccgtctactccatgggcgacagcgtcgcggccgctgccagcctcctcccaccgcacgcagccgtggcggctgtggagatggtggacacccagcaaccggagcaatcccattcccagcagcagcggttcgacacccccgcgctcaagacgttctccactggccgcacggcctcggtgggcggaaacggcggcgggggcggcaaggtgcggccggttgccggcgccacgggcgacggccagtcggacgagtcgtcgtcgtaccgacaaagcggagctgtgctgccgcaggacgtgtcgcaggcgacgcccctgggcgcgggcgcgggcgcggggtcggaggcgtccgtgtccgactcaatggccgtggaggaggcacagcagactgtacaggacgagctggtcatctggaaacggatatccgacgaagccatcaggatgcaggcgagcgtgcgtgcagaggagctgatggacccggaaatcctggagcagctcgtcgcgcccgtggaggcaccgaagccagacgtggcctatccgtcggaggagcacgtggccacggcgcagagatacgagcaggccgtgtccgaggagcccaacagctcgctgctcctggcgaactttgcgcagttcctgtaccaggtgcagggcgacctcgacagggcggagcacttcttcaggagggcggtgcgcgcggagccggcggacgcggaggcgctggggcggtacgcggcgttcctgtggcaggcgcgcaacgacctcgcggccgcggaggagacgtaccaggaggccatcgccgccgaccccggcaacgcgcaccacgcggcagcctacgcgcacttcctgtggaacacgggcggtgaggacacatgctacccgctcgactgatgcatgcgacgccgctaccgtccagcacagttcatcggtgcctcccatagaaaaaactgaaacaaaaaagaaagagaaaagaacactccgccgctccactgcctcggcaagtccacgctctttctcacggcatgtgcttgagcggccacccggggcagcagtactagactacaagtgaagctgaagcttatacacttcgcgttacaggaaccgttggttcgctttagtgtctagtctaggcatgttctttctcttccctgtggttgctcgttctgggcaatggccgacggaaatccgcggctcgctgctgcttcccgatccggaaacccggcgactgcgagttgagagcccggccgggaacggcggcaacgctcggttgtcggtgggcccgtctgtccacttggcgtcgcatggatgttttctactggcacttttgcacggtatgccgctttgttcagtggagcagaaaagtatatatatatatacttatatactagcagcaaattgcttcttgtaaatgtgcagatcaataaactctataagaagccctccatttttttttcactcaa

SEQ ID NO: 88 - DNA, 754 bp, Zea mays
gaggaatatacccattgtttcgtccgtttcctttgcccgaacgtgcgctgtctctcgatcctgcatctctgcacctgctcgcctccccagggaggcagggacaatcgacttcgccgggcgccggctagccccaccggcgacgacaggcacagtggaccacggaggagaaagtactctgctttgaatgggaagtgccatgaacaaagacaaagttcatgacaaggagactcacggaacaagtagtgatataactgagaaaacacctgtggaaacggtgaagggtcccaatctgcttgagcgagcaaaggaagagatcgaggcccttgccggagctgttcatactaagatggagcaccattccagtccccacgcgaagaaggatgaatcacataaggaaggcaaggaggggagcctgcacaaaataaaagcccacacggatgaaactcacggaacaagtgctgacataaatgagaacacaccagttgacaaagtcaaaggtccgaatgtgtttgagcgtgccaaggaagagattgaagctattgtggaagctatccatccgaagaatggatctgacagtaagtgaagactgaaacccctggggctgttttgccttaactggctgcaaaagccttaacgtgaggccatgtgctaccagatagataaatgctgtcaaagacgttcacccaatagtctttttatacgcgctctggagctgtaaaagctaagagcggacttgtttttatgctacactgtt

SEQ ID NO: 89 - DNA, 1069 bp, Zea mays
ggcagacgccacagcgctagcggcatagccggcgacagaaacaaccgatgccactcctcgccgtctgtccccgccgcgttccgccgctttcgctcgcgcgccgccaccgccgcagcttgtatcgggcccggtccctcgcgctcaaatgcgaggtctcctctcctccgctacttctgacccggaggatgtccgccgctggctcgctgcttgtcgctgtcgtccccgtccccgcgccgtcgccgcaactccccgtcgcctccgcgtcggagttggagacggagacggcggaaggagagagcggagcttctgaggggttagcattggagcgttacaccgaccaggagcagggcttcaccctcctcaagccggcctcctggcccaaggtggagaaggcgggcgcgacggcgctgtttcagcaggagggaaaagggagcaacaatattggggttgtcgtcaaccctgtccggctcaattcgctggcggagttcgggacgccgcagttcgttgcggacagacttctgcaagcagagaagaaaaaggaaagtaccaagtctgccgaggtgatttcagtgggagagaggtcaggtcatggtggcttgacagtgtatgagatcgagtacatgctggacagcacaaggggagggatgaagcggatcttctcgtgtgcgtttgtcgcttcaaggaagctctatctgctcaacatagcatattcagacacccaggagaagcccttggacagggagacaagaaccgttctggaaaaagttctccattcttttgattctgtataggtgatatttttttatagccgaggtatggcaccttttcttattttcggaatttctttcacttgaaaatacagtcgcaagtaattgtttgtttgtaaaatgagtgctgaccaaaatagctgcagtgtccatgtgtccaatactgttgcacttgcacctttatcagtgatttcaggttataagtaatttcagttcagataatgagcttcatcttctacagattggtagtatttgtgtcaccaggcagtaaaatgttgtgacctttgattcctagcctggca

SEQ ID NO: 90 - DNA, 2900 bp, Zea mays
ctgctgtatgttcagtgcctgcctggtttctggtttctccccttccctcctcgacctctcttccagcttccaacgcagctcatcaccagacaccactacttccccagttcccctcaccgtccctgcgctccatcgtctttggtgtccatagctttaaatacgaccacgaagccggtgcggcgactcggcgatctctccatcactgctgcggtgctgcctagctaccttctcggcctcgggtgggggcggcattgtcggtccagactccagagcgcgctgcttccggagctggccgcttgcgctgagccctctgccggaggcaatgaggagcggccgtgcctgctccgctctcgcgtcgctcctgctgctgtggctgggcgtcgccgccgcgcagaaggcctcgtcctggaagacattgagcggcaaggctccagcaatcgtagccaagggtggattctccgggttattccctgattcaagcgaatacgcttatcaatttgcgctgctcgctagctcgccggatacgatactgtactgcgatgtgcggctgaccaaggatgagattggcatttgcctgccggacatcaagatggataactgcacgaacattccagatttctatgcgcagggtcagaagagctacctcgtcaatggcgtgcctacttcgggatggttctcggtggactacaatggcactgagcttgaacaagtgactctcaagcaatcaatcaattctcggacacccagatttgattcaagtttctttccactacttgctgttgaagatgtgcagtccaaattcaaaccttctggaatttggctcaatgttcagcatgacagtttctacagccagttcaatctaagcatgaggaattatatcatttctgtatctaagcgtgttgttgtcaattatatctcatcgcctgaagtgagcttcctcaccagcctacttggaagaattagcaacaaaacgaagcttgtgttccgctttcttgacgagagcagtctcgagccatctacgaaccagacatatggttccatgttgaaaaatcttacatttgtcagtacatttgcatctggtatacttgtcccaaagggctatatttggcctcattcaccagacaattatctgcaacaatacacttcagttgtcgatgatgctcataaagcggggttggaaatttatgctgctgattttgcgaatgattttgtggtcagttacaaccacagctacgatcccttggcagaatatctctcgttcattgataatgatgtcttctcagttgatggtgtattgactgatttccctatcacagcatcagaggcaattgggtgttttaccaatttaaacaaaagcaacactgatcatggaaagcctttaattatttcccacaatggtgctagtggggattaccctgggtgcactgatctagcttatcagaaagcagttgatgatggcgcagatgtcattgattgccccgttcaagtgaccaaagacggaataccaatatgcatgagttccattgacctgatgaacgatactactgttgcaagatcacaatttatctctcagactgccacgataaaggatattcagattgcacaaggggtttttacttttaatctcacctgggatgacattgtaaacaacctgcagcccaaaatatccaccccatggtactccttcagattggaccgaaatccgagatataggaatgcaggaaagttcatgaggctatcagactttctggacttcacaaaagacaaagatttgtatggaatcatgatcagtgtagagcatgctgcgttcatggcaggggaacttgggttcgacatggtggataaagttatcaaagcccttgacgacgctggttaccatgaccaaactgcccagaaagttatggtccagtcaaccgacagttcggttctggagaagttcaaggagcaaacgaagtacgaccttgtgtacatggtcaacaaaaaggtcggggacgctgcgtcgtcctcgcttgtggacattaaaaggttcgctagcgccgtgtccgttgataccggctccgtcttccctgagacccactacttcacagtgtacgaaaccaaccttgtccagacactgcagacggctggcctctcggtctacgtctacactcttatgaacgagtttctgtctcagccatacgacttcttctcggatgctacagcgcagatcaatgcctatgttaagggtgctctggtggatgggctaatcacagatttccctgctacggctcgaaggtacaaggtgaacagctgcatgaacatggggaacagcacaccgaatttcatggcccctgctcgtccgggtgatctcatgcaaagcatcagcaagagcgcgcagccaccagctttggctcccgttccacccttgactggttccgacgtggcggagccgcctttacctcctgcgagatcgaacagcagcacagctccgacgcaatcactcgcgagcaggacgcgtgcttgcgctgctcacatcccagccctggcctcactggcaatgctttgcgcctggctttccctggtatgagcttgcagtgcaggccgccctagctccgtcgctcgactgctcgagctggaccgccgatccactcatcggatgttcttctccacccatagcagtagctcatttgttcagtgaatttgcatctacgggcttgtgcggaatgcgtacgacacttctgtgtgagctatcactattcactactgacgtttcagtacatatatgttggattggatgggtaatatattgcctacttctcaaggctattgattatgtattcacaaagaaaaggctatgatcaaggtgtaagcgactcatattgcattgttctatgcaagatgagcctatggccgtgactttc

SEQ ID NO: 91 - DNA, 2490 bp, Zea mays
ctcgacaaagcccacgccgcgccctcgccctcgccctcgcccccctgcctagggctccgcgccgccccgaggagaggagaacgcgcgcgcgcgcgcgcgccattgcggatccaaacgctccgccgcctcaactccctcgtcaattcacctccgccgccgccgccgcgccgcttcgaacacgatggatctactgagacaccccttcaagggagttgtcactgatatcaaaggaagggccacttggtacaagcatgattgggttgcaggactccactctggctttaggatattggcacctaccatgtatatcttctttgcctctgctctccctgtcattgccttcggagcacaactgagcacggcaacaaatggaatactctcaacagttgaaacactggcatcgactgcgatatgtggcatcatacattcaattcttggagggcagcctttgttgattgttggagttgccgaaccaactattatcatgtacacttatctctacaattttgccaagaatcatcaagctctgggtgagcagctatatttggcgtggacaggatgggtctgcatctggactgccatcatgttgtttcttttggcaacgttcaatgcttccaacgttattagcagatttacaaggattgcaggagaactttttggcatgttaatcactgttctcttcttgcaagaagctatcaaggggatgataagtgaatttagtgtgcccgaagacgctgacagcagttcaccaatataccaattccagtggctctatgtcaatggcctactcggtgtcatattttcaattggcttgctgtacactgcattgaggaccaggcgagcaaggtcatggctctatggcacagggtggtttagaagcttcatagctgattacggcgtcccacttatggtgattgtgtggacaggattgtcgtatttacatccaggcaaggtgccttcaggagtccccaggaggctttcttctccacttccctgggagtcaagttcactgggacactggaccacagcaagggatttgttttctgtccctccagcatatatatttggagccattctgcctgcttttatggttgcaggactttacttctttgatcacagcgtagcttcacagttggcacagcaaaaagagtataatttgaagaagccttctgcctaccactatgacattttggtccttggattcgtggtcctgctctgcggtttgcttggtatccctccatctaatggagtgcttcctcagtctcccatgcacacaaaaagtcttgctgtccttaagaggcagttgctaagcaaaaagatggttgatactgccaaggagagcataggaggaagtgctaccagtttggaaatatatggcaagatggaagaagttttcatcaaaatggatagcgaacagaatactgattctgttgacagggagttgaagaacttcaaggatgctgttctgcaagaaggcgacgaagaagggagattggctagagaatttgaccctcgcaaacatatagaagcccacttgcctgtccgagtgaacgaacagagactgagcaatctgctgcagtccatactggttggtgggtgtgttggagctatgccagtcatcaggatgatacccacatcggtcctctggggttactttgcctacatggccatcgacagtctaccagggaatcagttctgggagaggatacagcttctgttcattacagaaagccgacgctacaaggttcttgaaggtccccatgcatcgtttgtggagtcagtggttcccaaaacagtaaccatcttcacgatcttccagttggtttacctcctaatatgcttcggcataacgtggataccgatagccgggatcctgttcccagtgcctttcttcctcatgatcgtcatcaggcagtatctcctcccaaaattttttgatcccgtcgtcttgagggagctcgatgcagctgagtacgaagaacttgacggggtcccccttgaacacaaactggaagatgaagcatctgaagtaggaagttgtcctagccgtcctgatgcggagatattggatgaactcacgaccaaccgcggagagctgaagcacagaagttctagcctgcgtgaagaaagaccaattcaagtgacagtgagcacgcatatggttgcttcaagtgcggttcagccaagcctgtgaagacggcgaagtgttctttttatccgtagaattatgatcctcaagctgcactccgttgatgtgaatactgttgctatgtaatgtactgctactactagtgttgtacttgggtttttgacccaaacgcgtctgttggtaaggggtgatttgtaagaacagggacttacgtaaactacgtaggatcgattggtaagaagagagggagagaggagatgcaatacaagtcttcttggatatgaaagggggaatgccgaaggggcatggagtagaataatatcatatattgtcattagttc

SEQ ID NO: 92 - DNA, 1149 bp, Zea mays
actgccgcacgaatcgagccgccgaaaaggcgcaggcgaagccagcggggagagaaaacgggcgggatccccaccgcctcgcgcgcagcggcggcggcggcggcaatggaggtcacctcctccccctcgccttccgcgccgccgccggcctcctcgaagccggcgctccagctcaaccccgcggccgtcctcctccgccgcctgccgaccccgaccccaacagcggcgacgcccgtcaccgcgacggcgccccccgcgcggcccgccaccgcgtccaacccgctcgcggccttgctcgtccccttctggcgcgggctgcggcgagcgccgaaacagccggtccaccccgcctccgccgccgcggcgcggagggcggcggagcagcaggaggcggaggccgaggcggaggcgcggcagctggtggggtgcgcggtgccgctgttccggccgtacgtggcacagctgccgtggcacggcggcgcgcgggcgtggctgtcgaagctgttcccgcgctacggccactactgcgggcccaactggtccagcggcaaggaggccggctccgtgctctgggaccgccgccccgtcgaccacctcgacttctgctgctactgccacgacatggcctacgacacccacgaccaggcccagctcctccgcgccgacctcgccttcctccgctgcctcgagggcagtcggcacacgcccgcgcgcgacggcatcgccgccgcagccatctaccgcgccatgtgcatcttcggactgaagacgatcctgatcccgtaccggacgaacctcgtgcggctgcagacggggcccaactacgcggatttcttcgccgatttcgtgaagagggtcgcgtcgtcgtcgggcaggccgaccggcggcgagaagcagaggctgtgaacgaatttgctcgcctcgtcctacatgtaaaggtggtagatcgagccgaattggttggggccttggggggatgagatcgtagtgattgtctatataggtagcttgagtttttttttaatccagatatggccagggaaattgagtcttcctgtgtgtgtgtgtctaattgggtaattgtagcaactgattcgaaatttaaactttggggtttctactgtgaatatagcaaatgtctaattgggt

SEQ ID NO: 93 - DNA, 1764 bp, Zea mays
attgatccaccgacatctgggcccggagcttctcgggcccccgtggcagccgttcgatcaagcacagagctggtgcttactagtatcgccactagagacgcctccacccgctcccactcgtcttctccctccctagtcgctccccaaatcggatctccaggccggcagaagttgagcggactgactggtcactgtagttcgatcgaatccgagtagggctgatacagttcgattcggcgggaggcatggcgtccgaaaagcacttcaagtacgtcatcctcggcggcggcgtcgcggcggggtacgcggcgcgggagttcgccaagcagggagttaagcctggggagcttgcaatcatctccaaggaggctgtggctccttacgagcgtcctgccctaagcaaaggttacctctttcctacgaatgctgcaagactcccaggattttatgtatgtgtgggaagtggtggagagaagctattgcctgagtggtactcagagaaaggcattgagctgatccttagtacagaaattgtcaaagctgatctttccaccaagactctgactagtgcagctggagcaaactttacatatgagatcttgctcattgctactggctcctcggtcataaagctcaccgattttggcacacaaggagctgattctaacaacattctatatctaagggaaattgatgatgctgacaagctggttgcagctatccaggcaaagaagggtggcaaggcagtggttgttggaggaggttatatcggcctcgaactgagtgcagccctgaagatcaatgactttgatgtcactatggtgtttcctgaaccttggtgcatgcctcgcctcttcactgccgatattgctgctttctatgaggcttactatactaacaaaggtgtaaagatcttgaagggcacgctagctgttggttttgatgctgatgccaatggtgatgtcactgcagttaagctaaaggatggcacagtacttgaagccgatattgttgttgtcggtgttggaggcagaccattgactactctcttcaagggtcaagttgctgaggagaagggtggaatcaagactgacgcttcctttgaaacaagcgttcctggagtatatgccattggtgatgtggctaccttccctttgaagatgtacaatgagttgaggagagtggaacatgttgaccattctagaaagtctgcagagcaggctgtaaaggcgatcaagggcaaagagtccggtgaaccagttccggagtatgactacctgccatacttctactcccgatcattcgacctggcgtggcaattctacggcgacaacgtgggcgaaaccatcctgtttggcgacagtgaccccacctccagcaagcccaagttcggctcgtactggatcaaggacggcaaggtcttgggcgccttcctggagggcgggtcaccggacgagaacaaggccattgccaaggtggcgaaaacccagccgccggtcgctaacctcgaggagctcaagaaggatggcctccagttcgccagcaagatctgagacgctcccgttccatgtaaaattccgtgtcatcgtgaaggttcttctggagctctggtcatgattgagaaatgttctgctacagatgttatactacatacgtgactacactacatgatatattcggttttctgattgtgatatctgtacgtggctacactcacatgtgagatttgaataagtcctgcagcctcagggctcagctagcaca

SEQ ID NO: 94 - DNA, 1594 bp, Populus trichocarpa
tgcaaaacaaaaaaaacaaaataccaagaatcctccctcttcttttagcttgtttgttttgtgtgtgtatgaacgcacgcccacacagaggcacgcgcgcatagtcttataggttgctgagagaattaattaagctgttagctagctagttgtgtgatgacaatggaggaagctattgtggtgaacaaaggagatgatctgattgatttgccaccaggttttcggttccaccctacagatgaagagataataactcattatcttacagagaaggtgatgaatagtagcttctgtgcaagtgctattggtgaagttgatctcaataaggttgagccatgggatttgccaaagaaagcaaagatgggagagaaggaatggtatttcttttgccaaagagacaggaaatatccaactggtatgagaaccaatcgtgctacagaatcagggtactggaaggctactgggaaagacaaggaaatttacaagggaaaacatagccttgttgggatgaagaagactcttgttttctacaaagggagagctcccaaaggagagaaatccaattgggttatgcatgaatacagacttgaaggcaaattctcatactatagcctccccaaggttgcaagggacgaatgggttgtttgcaggattttccacaagagtacaggcatcaagaaaacctcaattcatgacctcctaagggtgaactctttcggagatgatttcttggattactcctccctgccacctttcatggatccccttaattacaatagcaggccaagcaccagcagcttcagtggtggcgataacaatgagttcaaggaaatggcaacaagatcatcagatggaaattatttctccaatacaagcatgctcaacaacaatcaaaactttgctcaacctccaaataccaactaccaagcaccaaactccagttttcaccctcaaattccagcctcaaatcctctttacacctttcaaaccagtcccaatatgcctggctacttgcaccaaggaaagagttcttctaattcattccaaaactttcaaaactctatcttcagtgacaatgaacatacccttctaagatcattagctagaaacagttatagagaagcatctggattggagaaacagtgcaaggttgagcgcttctcatctaatcaatctatggtcagcctttcacaggacactggacttagcacagacgtgaacaccacagctgagatatcatctgtggtttcaaagcaagaaatagggagccatgataaggtttttgaagatcttgagggtccatcagctggccccattgcagatttggattgcttgtgggattattgaagaccatagagaatatgtgtatatctacgcgtggtttaatttcttctttaaattcttaggatatatgaatgtaacgaaaaaaaaagaagaaagagagaaaaatttctgaggacatgtgatttgaaacagtcatttctccattagctagctaggtaatttgattagagtttggaaagttctttgtattgatcatataaatactttgtatagatttttattagttcatggtgttccttttccgatttct

SEQ ID NO: 95 - DNA, 1867 bp, Populus trichocarpa
gcgtctatttaattaatgcacattaaattaggcgtctactcatcttgcatgtgccaaaaacttgaataacatattagtactaggtctatactttgaatatcatttccaaggtctaagactgaccaacttggaagtgagaaaaccactagctggatatggccattcaagcaactttcatagcagatccagttctcatttcaagcccatcaagaatctccatcagaggttgggagcaatgtattgggtcttttgtgttgaaaacgaggcctaggcatccgaggctttcaaatggaggcagagtcagagcaagagcttctctgaatgctgatttgaaagcggttggcattcctcatcagtggtacaatgttgttgcagatctttcagtgaaacctcctcccccactgcatcctaaaacatttgaaccagtcaaacctgaagatttatctcctctatttcctgatgagttgattaggcaggaggcaagcactgacaagttcatagatatcccggaagaagttcttgatatttacagtctctggcgcccaactccattgatcagagcaaagaggttggaaaagcttctcgatacacctgccagaatttactacaagtatgaaggtggcagtccagccggatcccataaacccaacactgcagtcccacaagttttttacaatgcgcagcaaggcatcaagaatgttgtgacagaaactggtgctggccaatggggatgttcattggcctttgcgtgcagcttatttggtcttgactgtgaggtgtggcaggttcgcgcttcttatgatcagaaaccatatcgtagattaatgatggagacctggggtgcaaaggtacacccatctccatcaagcattaccgagactggtaggagaattctccagatggatccgtcaagtccaggaagtttaggaatagctatatcagaagctgtagaggttgcagctaaaaatgctgacaccaagtactgcttggggagtgtgctgaatcatgttttgttgcatcagacagtcataggtgaggagtgcataaaacaaatggaggctattggtgaaacccctgatgtgataataggatgtactggtggagggtccaattttgcaggactcagtttcccattcatccgagagaagctcaatgggaaaatcaaccctgtcataaaagctgttgaacctgcagcatgtccttcactgacaaaaggtgtatacgcatatgattatggagatacagcaggaatgactccattaatgaagatgcacactctaggacatgacttcattcctgaccctattcatgctggtggattgcgttaccatggcatggctccattaatttctcatgtgtatgaactgggtttcatggaagcaatggcaatccctcagattgagtgctttcgaggtgccatacaatttgctcggtcggaaggactgataccagcaccggagccaactcatgcaatcgctgctaccataagggaagcactgcattgtaaagagactggagaagcaaaggttattctcatggcaatgtgtggacatggccattttgacctgaaatcttatgagaagtatttgcaaggaaagatggttgacttgtcattcgatgaggagaaaataagagcatcattggacaaagttcctcaggtgacaagaaattgagccggtacaggtggtgctatgtaggatgaacattttagattaaaaggagaaaatctttcttgttaggtgaacaagagattttttgctattagatgctttttattgaaatttagttgttgcaattaggctttcaataaaatacgagacttagacaacagcatttgccttggtctgaatcagtggttctgtcttct

SEQ ID NO: 96 - DNA, 1857 bp, Populus trichocarpa
gcattacaatagccaggtagattaatcaaatcccaaacatggcttcctcttccttagctttcccttcccttcaaacccaattccagtcactaaaaaagccgtctagtcccaagccctccactcgtcgcttctctgtccgtccgatcagagcatcaatatcagaaaaaccatcagttccaggtccacccgctactgtttcaccatctgaaccaaccaaactccccatccgcaaaatccctggtgatcatgggctccctcttattggtccctttaaagatcgcatggattatttctataaccaaggcagagacgagtatttcaaatccaaaattcaaaaataccaatcaacggtgtttagagctaacatgccgcccggtccttttattgctccaaatccgcacgtcgtggttttacttgacggaaaaagctttccggttctatttgacgtgacaaaagttgaaaagaaagatctttttacaggtactttcatgccttcaacagaactcactggtggctaccgagttctgtcctatcttgacccgtccgaaccaaaacacgccaaactgaaacaactcatgttctatctcctcaagtcacgccgtgatcacgtaatccctgaattcaatgccagttacacagaactctttatgagtcttgaaaaaaacttggctctcggagggaaagctagtttcggtgaagctaatgatcaagcagcttttaatttcttggctaggtcttggtttggtactgatccggcagagaccacacttggccttgacggacccggtctagtttcaaaatgggtgctctttaaccttggtccagtgctcaaactcggtcttccaaaatatcttgaagatcttaccgtccattcattccgtctaccaccatcactaattaaaaaaagctaccagcgtctttacgatttcttctacgcttcgtcaggcttcctgctcgacgaagcagaaaatttaggaatttcacgtgaggaggcatgtcataatcttcttttcaccacatgctttaattcattcggtgggatgaggattttatttccaaacatgatgaaatggctaggccgtgccgggaccaaactccacgctcgattagccgaagagatcagatcagtggtcagatccaacgatggaagtattacaatgcggggcatggaagagatgccattgatgaaatcagtagtctatgaagcactccgaattgaaccaccagtctcgctacagttcggtagagcaaagcgtgatctgataattgaaagccacgacgctgcttttgaagtcaaagaaggggagatgttattcgggttccaaccattcgctaccaaagacccgaaaatatttacccaagccgaggagtttgtcgctgacaggtttattggggagggagagaagatgttggagcacgtgctgtggtctaacgggccagagacagagaagccgacgttgggaaataaacagtgtgcagggaaagattttgtggtactcgtgtctaggctgtttgtggtggagttgttcttaaggtacgattcattcgagatagaggttggaacgtcgcccttgggagcagctgtgacggttacttcattgaaaagggcaagtttttagataattggagatttttgtgtcttgtgagggtagttttgggagacgagttctcatagtgtatgatagtttttgggggggtaaagttaccctatgctttccgagacatcaatctcgtgatgtcgaggtccttttcttagctaatttaattgggaaaaagtgatataacagtgtaccatatggtgagcaataataatgaaatgaagcagcatcttattgttggagaaaaatatcttcaagt

SEQ ID NO: 97 - DNA, 1571 bp, Oryza sativa
gcccgcccgctccattttttcgctcctctccaccgcgggccgcgtctcggaataaaacctcctactactaaccccaccattccttctcccctctcctctcctgcttctctcgcccgcgccgccgctcccgcggggcgaaccgggggaaaggcggccgtctcgcgtcggcgagatttctgttttacaaggttggtggtgaagattttgctatccacttagccgaccagagtgaatttggaagttgcaatgggtgaaaacgctcaaggtagtggtcgccgcccctttggagatttaacaaatgtccttggcaagcgcccagccccatcgaatttggagaaaagtgcaggtggaatcaagattgtccgggttgaaaaggctgttgagccaagaaaagagtttgatgaaactgcaaaagcaagtggtggagcgacacgaaacacattgcccctttttgatagtattgccaaagagaatttaatgaggccctcaatttttcgggaaactaagatgcagcacatggctgctgaggcagctgtgttgctatccaaggaatccgatgacatgaggagttgtgccatgtcattaggctcatctggcttgcatgataaggagcaggagtcttcgctggaatcagaaggtggctgtgaagaagatgatgatgatgacatggatagtgaatacttggcatataccagagatagtactaaaacggcaactaatgatggtgaatgtcttactcaagaggagatggctggatcatcagggaatcagaagccactatcttcactggacttcacaacaggttgtgatgacatgccatgttccgatgtccatcaccattcactgggaaatagtgaactggaaaatgacgataccactaagtcgtgtgcttgttctttctgtcttaaggctgcattcatgtggaccgatctccattatcaggacacaaggggacggcttgctgcattgaagaagagcataaagttcgctagattgctgggcaagagaagccaaggagatgaatattctgttaatgcaggcagatacaacttgaaacgggctgcagagatggagtttgagctatatcaacagcaaagatcactcttccttcatacagaaaatgtccttatccgtgagagcgcacagcttcattcatctcttgtgaagttaaaggaattcagagagaactgcaagacagatctcgagacggctagcagttcgttgttgggaaaatgaatctttcatggttgtgctgttaaactgcttttgcctgggattcttcagatcagctgggccagtttgagtcaagttgtgcattgagattggttgattgctaggaagattagtggttattgccagtcaggaagtttggttatagtgatggtactacctatatgcagtgttcagcatctttgtttgtaaaaatcgtgtgggaaggtcggaactccaagttagcgacatgattctcctcagttgtaactggcagttagcttgcgccatgtggtatctgtatgttgtttcctgctcccaagcataatggtggaagaacgatgatttgacttctttttttt

SEQ ID NO: 98 - DNA, 1670 bp, Oryza sativa
aatccctccatttcccaaatcccccaaacccgattccacccaaaatcctcctctccgcctccgcctccgcgcccgccatgaactcgctccaatccttcctcgccctcaacccgcccgccgccgccgccgccctcggcggcgcgcgcctccgcccgtcgcgcgtcaccgcgtgcctcgccacgcccacgcccacgccgccgcccccgacctccgcgcccctcgcccccgccgccgcggccgcgcgccgcgagctgtccgccgcgagccgcgccgtggtggaggacgaggcgaggtacatcgtcgggacgtacaaccgctcccgcgtcgtcctcgtcgccggccgcggctgcaagctgtacgacgccgacgggcgcgagtacctcgacatggccgccggcatcgccgtcaacgcgctcggccacgccgaccccgactgggtcgccgccgtctccgcccaggccgccaccctcgtccacgccagcaacgtccagtacaccgtcccccaggtggcgctcgccaagcgcctcgtggaggcctccttcgcggaccgcgtcttcttcgccaacaccggcacggaggccaacgaggcggccatcaagttcgccaggaagttccagagggtggcgcgccccgacggcgacgcgcccaccgagttcatgtcgttcaccaactgcttccatggcaggaccatggggtcgctcgcgctcaccagcaaggtccaataccgggagccattcgcgccggtgatgcccggcgcgacgttcgccgagtacgggaacctagaggaggccaagaaggtgatacagtctggcaaaattgctgccgtgttcgtcgagcccgtgcagggcgagggtgggatccatagtgccaccaaggagttcttgcaggggctgcgggatgcctgcgatgaggctggagctctcttggtctttgatgaggtgcaatgtggtctgggacgcacaggttacctctgggcgtatgaagcctatggagtactacctgacattatgaccttggcaaagccattggccggtggtctccccattggtgtagtcttggtcaccgagaaggttgcttcagcaataaacttcggcgaccacggtaccacattcgggggaggccctcttgtttgccaagctgcattgaccacattggataagatccagaaacctggcttcctagcagaggtggccaagaaaggagagaacttcaagcagcttctcagtaccaagctgagcggaaacgcccatgtgaaagagatccgggggatcggtctcattgtcggcatcgagctcgatgtcccagcgggtcctttggttgatgcgtgcttggatcgcggtgtcatagtgctgacagctggtaaaggcaatgttgtgaggctggtgccgccactcatcatctcggaaaaggagcttgagcaggctgcagaggtgataagggactgtctacctgcacttgatgcctctacctcttaatgtaagcaacatccttagcaatggaggctagaatgatcttccccttttgggaagacccttagcaatggatgttagaatgaacctcccctttgggtggaagttcagatataatgtgtgccataggtctacttgtcgaatcttcttccaaattttggaaacaaataatgatatcaaaatgttgtagtccaattgctg

SEQ ID NO: 99 - DNA, 856 bp, Oryza sativa
tgcagtctgcacacacgcacaagaatcgagtgagccagagttgagagttcgttccatctcccttcgctcgccacgtggcagccgctagtccttatcgccgccgccgcccacctcgccatggcgccgccacccgccgccgccgccgccgtggacggagtcggggtcggggtcggggcgcacagcgtgttcgtgtacgggagcctgatgcaggacgaggtggtgcgcaccatcatcaagcgcgtcccgccctcctccccggcgctcctccccaactaccacaggttcaacatcaagggtaggatttatcctgcaatcctacctgttcaaagcaagaaagttgctggcaaggtcatcaccggtgttactgatgcagagctccagattctggatgaatttgaagatgtggagtacgtgaggacaagagttgagatatcattaactgatacttcagagacaatgcttgctgacacctatgtatgggctgatgcagaggatccaaatctttatggtgaatgggattttgaggaatggaagaggttgcacatgaaagatttccttgcgatgacccacgggttcatggatggcctcgaacagcctgaatccaagtccagggttgaaacctaccaatcattcatgcaggaaatccaacagcctgggacgacgacgacgacgacccaggttgagatttgaaggactacattgcaatattcgccaatagccgatatatatagtgaaatggcagttcgctgtattagcatgttagtatgaaataacccatctcctcgagagtgtaatctttatactttatagcatcatccattaataatacatgtaagaataaagtttctactgtgat

SEQ ID NO: 100 - DNA, 3196 bp, Oryza sativa
cgccccccctttttttagaaacaaaaaacccacaaaaagtcgcccacccaaagctcgcctcgcctagcgacgatcgcgagcactcctcctcctcctcctcctccgactccgatcaaatcacaccggagaaacctcgccgtccggccacaccggcggcgcgcgctctctcgctgtcgggggggttggcggtggcgcagccgcggggcgagaaaaatctggtctcggacgcccggctttgttgactaaaaccgggcgggcggcgggcggcggcgacgacttcgcacgcgatccgcgccttccttcctcttcttcccttgtttggtgcctcgcctcgtctctcctctatttcttttcgcttggtttagttggatttttgcgttcttggtggtggtggtggtagtggtcgtcgtcgtcggcaacgcgggagacttagcgttcttggtggtgttcgcgatctttgcggcgtccagtggcagtggattgcggtggtgggattggcgcggatcctgttttgctcgtttggttgtcgatcgccggcggtggattccggtggtggaggtgtttgggttgtgagctcgtcggcggcggcggcggcgcattgggtgttgggggccgagatgggcggcgtgtgctcggcggggatcccgggggacaggtcgccggcggagctgtcgttccgggcgatggggctcgtggtggagcaggagctcaaggcgttcccggccgtcgccggcaaggtgcaggggaagcacaagacggcaccggtggaggtggcgccggagcctgatccgccgcgccgcctctcccccgagaaggccccccggctgtccaccggcggcggcggcggcaaggctcgccggtcggtctccaaggagccgcagctggtgcgctcctcgtcggagaagctcaaggccggcaagtccaggacaagcacctccggcaaggcttcagacaaaggctcggtgtttggtagagccagcacatctgggattgggaaagcagtggaggttttggacacactgagcagcagcatgacgaatttgagccctgtaggtgggtttgtggcgggcgcgaagatgaaggggagcccacaaaagattcttgcgtttgaggttgccaacacaatagtgaagggcatgagcctgatgcagtctctgtccaaagaaagcgtcagatacttgaaggggaccgtcctccgatcggagggcgtaaagcgtttggtttctagcgatatgagtgagttgatgagaattgctgcagccgacaagaggcaagagctggcgctattttcgcgagaggtgatcagatttggcaatcgttgcaaggatactcagtggcacaacctcgatcgctatttttccaagctagaatcagaaattacgcctcaaccaaacttgaaagaaatagcagaagcagagatgcagcaattgttgacactggttcggcacacggctgatctgtaccatgagttgcatgcattagatagatttgagcaagattatcgccgtaaattggaggaagagaaaaaatcagttgcttttgaaagaggggacactgttcagattataaggcaagaattgaagagccaaaggaggcatgtgaaaagcttgaagaaaaagtccctttggaataagatgctcgaagacgtcatggataaacttgtggatattgtccactttttacatgtagagattcaagaatcttttgggacctatgatggagctttacaattgaatcaaccttcagagagccgtcagacgttaggatcagctggcctctcgctgcactatgccaatatcatttcacagattgacaacattgtttcccgaagcaccgttccaccacaaagcacaagagatgcgctctatcaaggactgcccccaactattaagtctgctcttcgaaaaaaactacataattgcccacaaccacaagaggttccgatcactgaaatcagatcttcaatggagagaaccttgcaatggattatccctattgccaacaatacagccagagctcaccatggattcggatgggtcggcgagtgggcgaacacagggaacgatgcgatgcggagggcggctgggcagccagacgtgatcaagatcgagacattctaccatgcggacaaggccaagacggaggcgtgcatcctggacctcgtcctgtggcttcaccacctcatcagctacagccgcccaagcaacggtggcaggtccaggtcgccgagcaggtcgccggtgcgctcccctcccctcacgccgccgcaccaggtgccgacgacgacgtcgtcgtcctcgccgccaccgccggcggtggcgaggccgagcggcggcaccggcggtggcctcaccagggaggaccgcgcgatgctccaggacgtgtacgcgggccgccggcgtcgcgctccctgtcacagcaggagccaggagctgtcgtcagctcgcggcggcggcggcgccggcggcgacagctcgtcggcggtggcagccgcggcgcagctgagcaagaacgacaggctgagcaagagcagcaacgatgctccggcgcggagcggcggcggcggcggcggcgggaagctcttcccgctgagcaggaggccctcctccgccgtggtgtcgcccgccgtcgacttcgacatcgacggcatcaaggcgctggcggatgcacagaagcggcagtgaccgtgacgtcacagccaccatcttcttctccgccgcaaattttgctcaaactgtccactgctcaaacgcagcgacgccggaaaaccgtgagaaaaaataagagaaaaaaaatcaagaaagaaatggagatggccagatgatgagaaaccaagatcggtgatggatgcttaattagggtgtgattgatacatgatcaattaattaattaatcgccattgtatattgtaggagaaagaaagaaagaaaaatagatggatagatagcccaagaattgcagctgtcaggtactgtactaccatgagacaatcatggatggacatgttatatagtactccagctgtgcaatgcctgaagactagtagtactactacatatatcaacagactctgcaggcacatatagatagtgaccaaaaaccctcctgcttgtgaattttcaacccttcttgtcttggaatggaatgcacagtttcatttctgtttgtctgcactgttctgtgccaggtacattca

SEQ ID NO: 101 - DNA, 1550 bp, Oryza sativa
cgtatttgtggtgcaacaaccgttcaaccaacacagctagcaacaagagtagaaacaaaaattcccctcctattttttaccaatccccagccataaaaattaaaacgagaaaaaaaagaaataatccccacaaatattaattgtataaataaaatcgaaaagaaaggaaaaataaaaaaaatatccaaaaataaaaccccctccactcccatcccgtttctccccctttccccttctcatggagtcgtgtagcttccgcaccgccgcctcgccatcgccattcccctcgcttccctcctcctcccgacaagcgccgccatgctccagcctccgattccccagaccaagaaacgggaggatggtgggggtgcggaggagggcgtccggattcgaggccttccctcccctacctggtaaggtgttcgtcgaggaggcaattggagctgaatatggggaaggttttgagacatttaggatggatggaccactcaaggtcgatgtggattatctgaacgaaaaattgcaagaatgcttccttcaaaggataagacatgctatgaagccagatgaagcatgtgggcttattttctcatgggacaacgtaattgctgatacagactcactaaagttggatgcctggagacagcttgctttggaagaagggaaggatatcccaaatgctggtcatgtccaaaagagtattcttcatggtgctgccgaccatgtgcttagaaaggttttatgttgggcaaaagatgaaagtcaaatggaaagactgaaggcacggcttatagagttatactacgaaaatctcttcaaacttgatacaccagtaaatggattgcgggaatggttggatgctgtccagacagcaggcatcccttgtgctgtcgcatcgtccctggataggagatgcatgattgaagctttggatcgaatggaactaagcaaatacttcaaggcaattgtgactgacgaggatgatatggagtcaatagcacataggttcctctcagctgctatgaagctggatcggaagccctcaaagtgtgtggtgtttgaggatgacccgagaggcgtaaccgctgctcacaactgtaccatgatggcagttgcactcattggtgctcatcctgcgtatgagctggtacaggctgatctcgccatcgcaaaatacagtgagctctcggttatcaatctcagaaggttgtttgcacataaggggttaagtttcatggacttgcagaagcagatcatcgagaggtcacctcccaagaggaagctgacagtagacaccatcttctaatgaattctttacctcccaatactgaaaaagagagaaaagaaaatagcaccatgcatcctccctactgtgctgtgtatatagcattccatgttggttagattacatagaaagctgatgttagatgatctgttgttgcatacctccattctggatgtactagatgtaaactgatgtttaaccattttaatcatgataaatactaccagtctaccaaacagaatcatgtccagggttatgaagggtg

SEQ ID NO: 102 - DNA, 2127 bp, Oryza sativa
ccttcgccagcggcttcctctcttctgcggccgcgcgcgatctccacacctcccctgcggaggcaaggaaggagaggcgcccctccacacgcggagcagaagagagccatgggcctccaggtcgcggccgtcgcgccatccccgtgcgcgcgctcctccgcctcgtcttcgccgccctcgacatcctcctcgcgtcccgccctcggcggtgcggggctcgcgagatcccgcgccccggttaattggggcgccggtgttatggcgcggcgccgcgggttgcggcagccggcgaggtgcgccctgagcgccagtttggatggcgtggggggcggggacgcggagttcttgcggcggatcgaggagctcgcggcggcggtgggtgtgcagcccacgggttgcgggtggccggcgagcgtggagcgcagcgcgagcagcgccgggatgcctctgtcgctccggatgctgaagcggaagaagcagcagcagcagctggtggcgcggcagacgcggtgggacgagcggctgctgggctccgccggcgactcggtggggcgcgccttctcgtcgatggtgctcatcgtgcgggagctgcagagcttcgcgctgcagcagatgcgggaggcaatgctgggcgacgacctgcagagcgtcctggcgcgagtccatggcgagatgcacgcctccttcgtctggctcttccagcacatcttcgccggcaccccggctctcatggtctccctcatgctcctcctcgccaacttcaccgtccactccatgggtcacagtgtcgccgccgccgcagccatccctcccgctccacctacctccgcggctgtcgcggtggtcgacacccagcacgccgacccatccctcccgcggttcgacgcggcctcggtcaagacgttctctattgggcgtgccgcctcggtcggcgggagcagcggcggtggcgggaaggttcggcccgtcgcgggcgccactggcgacgaccggtgggacgaatccctagctcggctgagcggtgtcgcgccgcagcaaccagcgccgccggcgggaacgggagctggtatggccgtggacgagcaggccatctgggaaaggatggtggcggaggcctcgaacatgcaggagaacgcgcgtgcagaggagctgagcgacccggacgtgctcggcaacctcgtcgcaccggtggaggcggagatcgagacggagggccacgctgagtacacgcggacggagcagcggtacgagctcgccgtgtccgaggagcccaataacccgctcatcctggccaacttcgcgcagttcctctacctcgtgcagaacgaccacgaccgggcggagcagtacttcgagagggcggtgcgcgcggagccggcggacgcggaggcgctgagccggtacgcgacgttcctgtggaaggcgaggaacgacctcgcggcggcggaggacacctaccaggaggccatcgcggccgaccccggcaacgcgcaccatgccgccgcctacgcgcatttcctctggaacaccggaggtgaggacacatgtttccccctcgattgacgcggccaccggcacaacaatggccactcgaaatcagacagaaaattaggaagcggaaaaaaaaaagaatctctattcaaagaagtccagttcgtgcagcatgcgcgggggcggccacgcggcgagacgcctagagcacacgacgacatgggcggcggagtggagctgacgcatgatgccttccgtttacttaggtaggttgagtagaggtgtgcgtgggcagtggagtgagttgtgagcttgtgagttgtgtgatacgggagagcgcgcggtgccgcttctcccgttccacaaatccggcgacgggagcatttcgccgggaatgaggaagaggacggatacggggatgcaagctcatttcccgacgatcttgtcggcaggggtacggtggcgtggatggatggatggtgtatagcaacttgcgtcctgtaattatgtagattgagcaaaaagaataatagtactaagtgaataaagaggtcatgttaatctcggtgtaatcctcctcggatctaatgcatttctgcttccagttggtacttccacttggcatggaaaatttgc

SEQ ID NO: 103 - DNA, 2144 bp, Oryza sativa
cctaaattgccagatctgtactccggaggcgaagggtcggagccactcgctacttgccgccgccgccgccgccgccgtcgtcgagggcgaggcagcggcgctccgcctcggctcgggcggcgcaccggcgcctctgagcggccacgccccggtctccgccatccgcccgtccgcctctccgttcgacctcgtcccgtggtccctccctacgccgccgtcgaccgccgtttctggtaatctcaggaacttgaaatggcagacgaggagcatgctccaacgtctaggaagagggttgcaggtacccaaatcaacaaggataatcctgagcctgatgatgactcaactgagcaagagatggggacatttaagagagctagtgaggaagtgatggcaacacggagaattgtaaaggttcgacgccagcagccctcatcagctccttctaatcctttctctgcaatcagatttacccccagtgataccagcgcccaagcaactatccctgtctcagagcctcaaccttctgatgtcattacagcgaatgcaaaggatagttcaagtgagaaagctgatgagggaagcaatggcagtgggaaagatgctttacctgtaactgacaagagtgcaggttctagtgaggtagctgagacagaaaaggatggatcagatctgaaaggatcagatgaaaaagccaagtccagtgactcaattgaaccaccttctcaacctgttgagaccactgacgaagcaaaagacttggggggcggatcagtggtagctggagaggccaaggaagataacagcaaggcatctgatatcgaggacaaaacagcaaaagagggagatgctgaagaagaggatggagcaaatgaggctggagctgaagacaaaattagcaagggtgatgatgagaagaaagatggagatgaatcagagacaaaggatggatcgtctgaggagcagaaggatgctgataacaaggggcagtcgtcatcaccaacaccccttttctctttcaagaacctgtcgagtggccaaaatgccttcacaggactggctggaactggattttcaggctcttcattttcatttggatcaggctctaaagaaagctcgagtgctcccctgtttgggctaaagactgatggctcatcattcccatcttttagtattggtgcttcgaataatgggagttcctcccctgcgcttgcgacttcggcagaagctcccaagaaatttgctatgccagagggcccagttgaaactggtgaagagaatgagaaggccatattcacagccgactcagcattgtatgaatacttggatgggggttggaaagaaagaggaaagggggaactaaagttgaacatcccagtatctggtggcgagaggtctcgtctcgtcatgagaaccaagggcaattacaggctagttcttaacgcaagcctttacgaggacatgtcgctgaaggacatggacaagaagggcgtgacgtttgcctgtatgaacagcatcggcgactcgcagagcgggcttgccacatttgctctgaagttcagggataccagcatcagggaggagttcaaagctgcggtggagatgcacaaggcgaaaaaggcgtccggcacactcaagacacccgagaactccccgaaggcatcagatgattgaaggttgaagcccaactctcgccacaatgcaccgagtccatgaagtggaggagctgagatacgcttcttgttcttttgggggggtttatttaagtaacataccgtaccatgtcactacgctgccttaagatgatgatgcgcttgcatacggtttcctgtcgctgtttttggaacagtgggtagagtcctgtgaaactttaaattaaaagtcctgaaatcttagtaagtggagagatgagactcctattgcctactgtgatgaccccagcggacactcactaagagtatgccgctgagtgtttgatattctatttggggatgagatctttatcaatcggtgttgtactggtgtatcatgtatccgtgatctgcagcgtcagcgtcgccttacctttaccttctactgttgctgataatcttttctttgagaaactttttgctgatgataataagagtaccttttgttggaacttc

SEQ ID NO: 104 - DNA, 1356 bp, Oryza sativa
aaacaacaccaccctgtcatagtgtctcatttaggcatatcctgataccagctggctattctctcttgcccttccacgttcaagtttcagcccaggtacggccggaagctatctaaggactgcagctatgggcaatttgttctgctgtgttcaagttgatcagtctacagtggccattagagaacagttcgggaagtttgatgctgtgcttgagccaggatgtcactgcctgccttggtttgctgggaagcgtatagctggccatctcacactcaggttgcagcaactggatgtgcgctgtgaaaccaagacaaaggacaatgtgtttgtcaatgttgtggcatcgatccagtacagagctttggctggcaaggcaaatgatgctttctacaagctgagcaacacaagatctcagatccaagcttatgtcttcgatgtgatcagggcaagtgttccgaagctgaacctggacgacgcatttgagcagaagaacgacatagcaaaggcagtggaggatgagctggagaaggctatgtctgcttacgggtttgagattgttcagacgctcatcgttgacattgagccagacgagcacgtgaagcgagcgatgaatgaaatcaatgcagctgcgaggctgagggtggctgcaaacgagaaggcagaggcagagaagatcgtgcagataaagagggcggagggagaagcggaagcaaagtacctgtcggggctgggtatcgcgaggcagcgtcaggcgatcgtggatgggttgagggacagcgtgctggggttctcagtgaacgtgccgggcaccacggccaaggacgtgatggacatggtgctcatcacccagtacttcgacaccatgaaggagatcggcgcctcctcaaaggcctcctccgtcttcatcccccatggccccggcgccgtccgcgacatcgccacgcagatccgcgacggccttcttcagggccaggctaccaccacctcccattagcatccatgtgggacaccagctgtgggattgctaagctgctgtttctcttgatttgtcctgtgtgattagatatgtcttgtaatttcttcatgctagctgtccgaccgacgtgtgtgcgcgcgcgggcaacattttcattttagttgtgaatgatatcctatcgtgtatgtatgtgtggaactatgccttgtgaaaactttgtgaaatttcagcgtcaaacatgtaaatgtgcatgtaatccggttctctgtattgtattacttgtatgatatgccgtctcgagttgtgcattttcagcttgcatgcatgagcctcgctatggtactttctacttataataaaaaaaatctcatttgatcgaa

SEQ ID NO: 105 - DNA, 1473 bp, Oryza sativa
gtggatgagaggaggcgatgagaatggccgcgccgcagcaagtgcatgtgcgtgccgccccgctcgcgcgcgcgctccgaactcgcgtcgccgccgccgccgcgtctgcgagctctcccgaacgcgcgctcctcggcctctccgaaccggatctccggcagctcgccgtcgacctcggccagcaaagttacagggggaagcagcttcacgacctcctctacaagtccagggccaagcaaatccaagaatttagccacgtaccaaaggtgttccgtgaggccttggtcggcgctggctggaaggttggccgctcgccagtgcaccatgctgtgacggcctccgatggcactaccaagatacttctcaagttggaggataacagattgatcgaaacagtagggatccctgtcgatgatgacaaaggcccgtcaagactcactgcctgcgtttcatcacaggttggctgccccttgcgttgctcattttgtgccactggcaagggagggtttgcaagaaaccttcatgcacatgagattgttgagcaggttttggccatagaggagacgttccaacacagggtgacaaatgtagtgttcatggggatgggtgagcctatgttgaacctgaaatcagttttagaggcacatcgatgcttgaacaaggaactaaaaattgggcaaaggatgataacaatctccacagtaggtgttcccagcactataaaaaagttagcatctcacaagcttcagtcaacacttgcagtcagcctgcacgccccaaatcagaaactacgggaaacaattgttccaagtgcaaagtcatatcccttggaggcactaatggatgactgcaagaattacttcctcgaaactggacgaagggtatccttcgagtacactctgctagctgggattaatgacgcaaaggagcatgctgaagaacttgcagagctactgcatacatgtggcggtggttatcatgtgaacctaattccttataatccgattcaaggttctgaatacaagaggccctacagaaaagtggttcaagcgtttgttgatgcgctagaagctcggaagataaccgtaagcgttcgacaaacccgtgggcttgatgctaatgccgcttgcggacaactaaggaatgagttccagaagaatccactgcttgaatcatcaccttcatcagagcccaacctcgtaccagcttgatgagaagactgagttcatgatggccatgcacaatgattgcagattatcagtccatcacactgaaagctgatattgtactcgtagttgttttcggcatttcctgatgtatttgaattttcaagagttgttataagtagatatatatttagtgccacatacgggtgctatagaatcattatgcacattgcttaggtatgtaatctgcctgacgttgtgaaaaatggctcttcctgaatatcaccagatgcgaaaatttccacac

SEQ ID NO: 106 - DNA, 2341 bp, Oryza sativa
agtagtactctcgtaataataacacaataggaggagcagagaggagagagccactgcaccgcgcgtccgcccgcgctccctccctctcctctcctcgcactcgccgtccctcccaatggcctccgctgccgcccacgcggccaccgccaccgccgccgccgtcctcctcgtcgtcttcctcgccccccttgccgccgcctccgactccgaccacaagtaccaatcggaggagaaggttatgctctgggtgaacaaggttggcccgtacaacaacccacaggaaacttacaactactacagccttccgttttgccatccgtccaataaccccgtgcataaatggggagggcttggggaggttctcggtggaaatgagctgattgacagccagatcgacataaagtttggaagggatgttgacaagggtaccatttgttcaattgaacttgatcctgacaaggccaaacagttatctgatgcgattgagagttcatattggtttgaattcttcattgatgatttgcctctatggggttttgttggagaggcagacagaaatagcgataacaaatatttccttttcactcacaagaacatcgtcatcagatacaatggcaatcagattattcatgttaatcttactcaagaaagtccaaagcttattgatgcgggtaaggcattggatatgacatattctgtcaagtgggaaccaaccaatgtaacatttgctcaccgctttgatgtataccttgactaccctttctttgaacaccagatccattggttctcaatcttcaattctttcatgatggttatctttctcactgggctagtgtcaatgattttgatgcgcactctaagaaatgactatgcaaagtatgcccgcgacgatgatgatcttgaaactctggaaagagatgtcagtgaagaatctggatggaagcttgtccatggggatgttttccggcctcctcgcagtttggctcttctttcagcccttgttggtgttggcacacagttgtctgctcttattctgctagtgattttgttggcaatcatcggaatgctgtatattgggcgaggagctattgtcacaacattcattgtttgttatgcccttacttcattcatctctggatatgtcagtggtgcactttattcacggcatggggggaaaaactggatcaaggcaatgattatgacagcatcactatttccgtttatgtgctttggaattggcctagtgcttaacacaatcgctatattctatcgatcattagctgccataccatttggtactatggtggttgtgttcatcctgtgggccttcatatctttccctcttgctcttttgggaactgttgttggtagaaactggagtggtgccccaaataatccatgcagagtaaagactattcctcgccctatccctgagaagaaatggtacctcacgccttctgtcattgccctcatgggaggactgcttccttttggtagcatcttcattgagatgtactttgtcttcacatcattttggaactacaaggtgtactatgtatatgggttcatgttgctagtctttttgatcctcataattgtcaccatctgtgtaacaatcgttggtacatatttcctgctgaatgcggagaactaccactggcagtggacttcattcttctctgctgcttctactgccgtctatgtttacctctactccgtatattattaccatgtgaagaccaagatgtcaggattctttcagacaagtttctacttcggctacactcttatgttctgcctaggtttaggaacactctgcggtgctgtcgggtatcttggatcgacactgtttgtgagaaggatctacaggaacataaagtgtgactaaaaattgaccccggtttagacagatggggcgaaaaactttgtatgtgtggcttgttccgtgaagtgatcagccatgttttggtggccaagaagccagggcagtttatggagtacaaacgttcttcggcgacattgctgggatgccatggtttttgttttcttgtcccttttgttctctttgatccccctctcggtgccacaattttcatgttcaactagccatatatagctgcgatcatagtttagatgttagtatataccagagttgttattcttgagcctcatatctgtgttgcttcacttaaagctgtaagatccatgacatttgttgacctttaatgatgaaaacatctccgaaagacatcattttcagattttatgcttgtgttttcctgcacgcagagctacagaaaaaagaagcttagcagatacacatctattatcattgaaaaat

SEQ ID NO: 107 - DNA, 1801 bp, Oryza sativa
gcgcggcgcgcggcggccggcggcgagctcggatccccacctccacccctcccgactcccacgccttcctcctccactgcgacctacggtgtaggcgcattccgcctacgtggcctcgcctccgcctccggttcctccgccacgacgtgtccgcgtcccgtccactcgcccgatgaggaaatttcccttctgtactgtttcgcacgactcttccgccgacgaattcccccgcttccccatttcgtctcgcggtgagtttttggtagtttagtttgatacaccacttcgtttgataccctcggcgaccgcgcggcggccagcgggcgcatccatggcggcggcgggatccataggcgtgtacagggcggtgttcgcggcgctgggcgctctcatgctgggcaccctggtgtacacctgcgtcaccgacggctcgccgtttcgcctcgagctgctcaccccgtggttggtggcaacactgattgatttttatgtcaatgtgactgcgatttcgacttgggttatctacaaggaagtaaattggattagttctttcttttgggtagttctgttgtactgttttggcagtattgctacatgtgcttatgttgttgtgaagctttttgaaataaaaacttccggaccttcacaagatccacttgatcttttattcctcaggcaaggagatctatccgaaagaaagtcctcttttgtcataattgggagaattattttcagcattttgggggcaatgatggctgcagtcgtaatttatactgtcatcactgatggactacctttcaggaaggacttgttgaccccgtggatggcggcaaccttaattgacttctatataaatgtcttcgcaatatcggtatgggttgctcacaaggagtcaaactggatatctactgccatctggatatgcttgttaatatgctttggaagcatcacgacatgtggctacattgtcatacaacttttccaagtgtcgtaccgagacccaatctatcatgtgctattgaactctcataacaagaagatttgaaaatatcattgaagagttatgttattcttggtatacaataatattacctcaataaatggtgtatcgtctagacaaatagggaattctcggtgtaattacatatcattctcagtgtaatgacataactttggcaatttctctacaaaaggaccagactatatgcagtttgcagctcctttatctgtcgtgttttttaattaaccctttatttgtatatctgatttagtcgatttgcaaaagttttcttcattgtagttgttatcaaaattgtaaggtcatgtaacacaaagggttactaaagtgaagtaaagaaaatgtgactgtcttgtttaactgggaaattatttgaattgccaaataagtttgcagtcttgctgaaatcgggctcgcaagactcttttgatttgatacatctctatcttgagtgtgtgaaggagcctcaacgcagagcagggaagacttccaagcattataccccctagctctgccaaagtatgaagaatatgtaagccatcttttgccagttcttttgcagacagaattccaatatgcagggattcagatcattctcattttgttctttctgttggagttagaaaaatctttgcttcggcatactctcaaatataatagctttgaattctggacccctggaaccaattcttggtcacactgtcaatattttaacaaggtttcgatgtgtaacacttgtaaaactcacattctgtaggaaagctttgagatgcctattgttga

SEQ ID NO: 108 - DNA, 1444 bp, Oryza sativa
gtagtacagagcagagcacagcagaggagatcgagcagagacagacagacccgcaggcggaagcggaggcagggcaggcaggcagcagcaacaatcccccacctgcgcgtgtgcgtgtctgtttcggtgcttcctcctcctcctcgccatggcgctcctcctcctccgacgcggcggcggcttcgctgcggccacggtcctcgcggtcgtcgtcgtcgcgctcgtcctctcctgcggtggtggcgcggaggcggccgtgagggacctcagggtcgggtactacgccgagacgtgccccgacgccgaggccgtcgtccgcgacaccatggcccgggcacgcgcgcacgaggcccgcagcgtcgcgtccgtcatgcgcctccagttccacgactgcttcgtcaacgggtgcgacgggtcggtgctgatggacgcaacgccgacgatggcgggggagaaggaggcgctctccaacatcaactcgctccgctccttcgacgtcgtcgacgagatcaaggaggcgctggaggagcgctgccctggcgtcgtctcctgcgccgacatcatcgtcatggccgcccgcgacgccgtcgccctgacaggtgggcccttctgggacgtgaggcttgggcgcgaggacagcctgacggcgagccaggaggactcggacaacatcatgccgagcccacgcgccaacgccaccaccctcatcaagctcttcgccggctacaacctcaccgtcaccgacctcgtcgcgctctccggctcgcactccatcggcgaggcccgctgcttctccatcgtcttccgcctctacaaccagtccggctccggcaggcccgaccccaacatggaccccgcctaccgcgcggggctcgactcgctctgcccccgcggcggcgacgagaacgtcaccggaggcatggacgccaccccgctcgtcttcgacaaccagtacttcaaggacctcgtccgcctccgcggcttcctcaactccgaccagacgctcttctccgacaacgccgggacccggctcgccgtgaggaaattcggcgaggaccagggcgccttcttcagggccttcgtcgaagggatgatcaagatgggggagctgcagaaccccaggaagggagagatacgacgcaactgccgtgtcgccaatgccccggcgccgccgcctgtggaggcggaggtggcggcgacgtccaaggcggtggtcctggtggacttctgacgaacgagctgctagtcccctgactccccagctgttggtgttcgagaggagctgctcagatatgagagtgttgtggctattcatatatgagtttttggtccgatggcaggtttgcacctacctgtaagcttgtgatttcagggttacccgcttattgccgattattgaatggtgataaataactgagaaatcgagctaatgatcattgcctga

SEQ ID NO: 109 - DNA, 3062 bp, Oryza sativa
tgagacatccaccatatcttccccgcctcggcgcgcgcgtactcctacgtctacgtgcgtgagccccccacacaccctcgctcgccgcgccgccgtctctagttttttttttctaaaaaaaaaaaagcctcggccgccgcagccgcccctgcccatcgatcgcggcttgtctcttccccttccctctgcctggcgtggagtactactgcgctactagagagtttgctggtggaggaggaggacgaggaggaggaggctgggtggtggcggccgccgcgatggacataacggaggtgacggtggtgcaccacgcggcgctggtgctgctcgcgctctgggccgccgtgtcggccgggtgggcgcacccggcgatcttcctcgccgcgctcctctatctgttcgcggtgaatgaacgatacacaatgaggctgcgaaagcgaatacaacatgaggaaaggaaatgtgcaaaccaaagaaggcttctctctgatgcagagactgtcaggtggttgaattatgctgttgagaagatctggccggtttgcatggaacgggttgcatctgagcagttccttttgcccatattcccatggttcctggaaaagttcaaaccatggacagcgaggaaagcagtgatccaagacctttacttgggcaggaacccaccaatgtttacagatattagggttgtcaggcaatcaactgatgatgaccatctggttttagagataggaatgaacttcctatctgcagatgatatgaatgcaacaatggctgtgcaacttaggaagagattaggatttggcatcacagcaaacatgcatataactgggatgcatgttgaagggaaggtcctagttggggtgcgatttctccgacagtggccatatattggtcgcgtaagagtgtgctttgttgagcctccatacttccagatgacagtcaaaccattatttggtcatgggcttgatgtaactgaacttccaggaatttctggatggcttgacaggatgttggatgtcgcctttggacagacccttgttgagcctaatatgctagttattgacttggaaaagtttgcatcggaatcaacagatagctggtttagtgttgatgagaagccacctattgcacatgccaaggtagagatcttggaaggtgctgatatgaaaccctctgatccaaatggattagctgatccatacgtgaaaggccatcttggaccctatcgtttccagacaaagatccacaagaaaacactcaatccaaaatggatggaggagttcaaaataccagtaacctcatgggcagctctcaatcttctctctcttcaagttcgagataaggatcccatctttgacgacacactcggtgactgttccataagcatcaacaaattgagaggtggacaaaggcacgacatatggattgctctgaagaatataaagacagggcggattcatatagcagtaacagtacttgaagatgaaaatgaaaaggttccaaacgatgacgatgagcagtgtggaacacccaaggggggtaaagcaagcacaccaaggtctagcttttcgtccaggaccaacaatgaaagtgaatcatcagaggagtttcgaaagatatctgctgaatatgagccagtagacattgaaggactggaaaaggttgatgtttgggtccatcggccaggcagtgatgtcgcagtcacttgggagcctcggaaaggacgtgcgaggtgtcaggattccagaatcctacgagagaatgatgtctactgtgacagccctaagtcgtgccaatcagaatctcagagaagtgactccagtactgaagaaccagccaatggcaaatcacgccatcatctccacaaggtcaaaaagggtttggggaaactagctggtgcgatgttcaagagcccaaagaaagagagtgatgatgaagcctcgccatgtgtgacgcctcacccaaatataaaaccacttggagaaaaaagggtgtcagtaagatacgtcgtcgatgaagatccttctgaaaacttgccagatgaccagcattccagtcctgagagaggcgagtcggaaagtccgaccaagaggcatttgaggaagaaggctgtgcacatggtgaaacatgcggggaacaaaacagctcataatctgaagaacatgttcagcaggaaaggcagtgacaagagcaaagaaggccaagatgaccagaaagacgatcctgatactatagtagtagaaccttcaaaagttaagaaagacaatcctgatgcaagtgaggtagacatagacccttcacaagttgagaacgacatccccgattcaacggcaattgaccctttgaaggttgattctaatgtggccaacaacattgtggttgatgcactagagtatgcatctgaatctgatgcgaaggacaaaccacagtgaaatgtgttctgctatttttggcggtcctcgtgctgttgggactgttcatgtaggcaggatactaggtagcaaaatagtctgatagcctcctgacagcaagcgaaggttgacagtatagtccgtttggttggttgagtcctccatcttacctgacgaccgatgtttttcttgtattatagatgctcaaggaacaatacctctgtacatgtcgtatgcagactgtctaagctgtttgcttcttggacatggaaagcaggtggccggttggctttggcaaggtgttggataggagagaacggacaaggagaaccaaaaaaaaaaaaaagagattgaaccaagcctattatgtgaccatgcaaaagtagggaacatgcccatccccatccatatactcctttgataatacaaaagtaggagtactagttttgtatagaataatagaattagcctacttgctttagatgtagtctttcagcgtacagtatgtcagtactacagttacatccctaaagttgcgtactttgggaacaatacatcaaaataccaaagtatgggacatccctaaagttctgtttttttttcaacattccgtgcataaaatgaaccatcaagtacatatgtttactt

SEQ ID NO: 110 - DNA, 969 bp, Oryza sativa
acagattacaggttacaggtttcacccctgagccaaacgtgagcccgctacactgacaacaacaagctcatcgccaacccgctactgaagcagcagcctaccagcaatggcgttgccgctgctcaagtcgtccccccacttctctgctcttcactccgcgaacagagcccagctccatggccgctgccgtgcaacgctcggtggattccatgacccgaggtccaactccagccgttgcaagaaatcggccgggaggggttcagtgaaggcgaacgcgtccccgttggacgtggtgacgctgatggtgacgatggtggagcacgtcgacctgcagagggactacgtcgtgcacaagtcgatctggcatctcagcgacgccgccctcaagagcgtctataccttctacgccttcttcacagtctggggcatctgcttctttgcgtccatgaaggatcctttctacgacagtgaggcgtacaggggacaagggggtgacggcaccgtgcactggtactatgaccggcaagaggacctggaggcgtctgcaagagaggagctcctgagggaggagctactcgaggagatcgagcagagggtcggagggctcagagaactcgaggaagcagccaaggaggagcagcttacaaactgatggatgaatgagagattgcgcatggatggatgactgcatgatcatggcgcgatgcggctgcattctgtaataccgtacagagcggctgtgtaatagcaagatacacagttgcctgatagcgcctgtaaatgttggcatcagactcaaaaggaaagcaaataggtgctccgtctgcatgaatgcattatattgcatttgtagtgtaggctaaaagaaggaatgtactactccatgttaatcaaagaacctgtaccgttcaccatggtggatattgcttccaaaatatataaattgtgtaaatcgactgatatagacct

SEQ ID NO: 111 - DNA, 3312 bp, Oryza sativa
gacaaattggaaggaaccgtttgcaagccacatgttctagtggctttcacagtttcactcattccaaggcaacgagctggagctctcctcctccaatgtatctatctatctctagcccaagatatatctggcttgccattctcatagcttgccagtttctgatgagccaagggagctctgtgcgtcgtcagctctcctgcccgggacagtgatgagggcaaggagccatgcttgtcaggttaggcgtcgttgttgtagcctccgtcgcagctttaactcttaagagagccaacagtggcaacagagatggccaagcaaggaaaggaaaggataaaactcgctactctgaacatggggagaaagaagaagagaaggaagaggttaaaacaatcagcggcataatcaattcagctctttcagatgatgacgacatgctctccgagatcgagagcctcctatcaggggagattgacatccccctaccaagtgacaggttcgacgtcaaagaacgctctcggtacaacagtgttaactccgagctggagaggctgcgtggacttgtgcgtgagctggaggagagggaagtgaagcttgagggagagctgctagagtactatggcctcaaggaacaggagactgatgttgtagagctacacagacagctcaagatcaagatggtggagatcgacatgctcaaaatgaccatcaactcgctgcaagaggagaggaagaagctgcaggatgacgtcgcccgtggcacaggagccaagagggagctggaggctgcgaggaacaagatcaaggagctgcagcgacagatacagatggaggcgaaccagacaaaagggcagctgttgcttctaaagaaccaggtgattgcgctgaagtccaaggaggaggaggcagccatcaaggacgcagaggtgcagaggaagctgaagaagctcaaggagctggaagtggaggtagttgagctgaggaggaagaacaaggagcttttgtatgagaaaagggatctcatcgtaaagctggatgcagcacaaggaaaaataacagagagtgatgtagtttcccatgcaagagaggagatcaacaagctgaggcatgcaaatgaagaccttaccaagcaagtagaaggcctacaaatgaacagattcagtgaagtagaagagttggtttacctgcgttgggttaatgcttgtctgagatatgagctccgcaactaccaggcaccgtctgagaaaatttctgctcgtgaccttaacaagaccctgagcccaaaatcgcgtgagagggccaaacttctaatgctggaatatgcaggatcagaacgaggacagggcgacactgaccttgaaactgcttcttctgcaccttcttcacccagaagcgaagacttcgacaacgtttcagttgacagttcttctagcagatacagcttctttggcaaaaggcccaatctgatgcaaaagctcaagaagtggggaaggggcaaggatgacggaagcagcttagcttcaccgacacagtccttcactagtgactccccaaagagcgccagccagaaaccaaaggggcccctagaggctctcatgctcagaaacgcaggagatggtatgggcattacaacctttggaaagagggaacaagatcccagtgatatcatggatgaggcaaatgttgcatcttcatttcatttgatgtcaaagactgtacaaggttttgctgatgacaagtatcccgcttacaaagataggcataaactcgccacagaacgggagaaggcaataaaagagaaggccgagaaagctagggtacaaagatatggcggtgtcaacagttcaggtattgtgccatctccaagatctgcactccctccaaaacttgctcaaataaaggaaaaggctcctacagctaatgctgaatccagtgaccaacctagtgataaccagaacaaccctctagttgtgacacaactgaaacttgcaaatattgagaagagagctccaagagttcctaggccacctcctgcaccatcagccactgccaacactgcaagtgcgttacctccaccaccgccacgcccgccaggtgcacctcctccaccaccgcctcctggcaaacctggtggcccgccaccgccgccaccacgccctggttccctacctaggaatcttgctggtggtgacaaggtacaccgtgctccagaggttgtagagttctatcaaagtctcatgaagcgtgaagccaagaaggacacaacttctctgggatcaacaacatcaagtgtctctgatgtgagaagcaacatgattggagagattgagaatagatcaacattcctcttagctgtcaaagtggatgtggagacacaaggagactttgttgagtctctagcaaatgaggtccgagcagctagttttgtaaatatcgacgacgttgttgcatttgtaaactggcttgatgaggaactatccttcttggtcgatgagcgggcagtactaaagcactttgattggccagagagcaaaactgatgcactaagagaggcagcctttgagtatcaagacctgctaaaattagaacacaaggtttcgtcgtttactgatgatccaaagcttgcatgtgaagaagctctcaagaagatgtattccttgcttgaaacagtggagcagagtgtttatgcgctacttcgtactagagacatggccatatcacgctacagggagtatggaataccggtggattggctgtctgattccggggtagttggcaagatcaaattggcatctgttcagctggcgaagaagtatatgaatagggttgccacagagctagatgccttgcaaggcaccgagaaagagcccaacagagagttcttgcttcttcagggtgtgagatttgctttccgagttcatcagtttgccggaggctttgacgaggaaagcatgaaggcgtttgaagagctaagaagcaagatgtgtacaacacagacatctgctccacaaatttcatagctctaaccatgcatgctgcattccacagttgactggtttattttctttgttgaaacttgaaaggcaagattaattgagtggctaaaaagtagaaaaatacaagtgtaaatcccaatatggcaggaaaggatgattaagtgtacagacgatgaatacatgcatactagattatgtatttctttgtatttaaaggttgcaagagcgcatttttaaaagcaaaagaactagtactaccaatcagctagactgcttatatttttttagatgatggaatataatatcccggcctttgctc

SEQ ID NO: 112 - DNA, 1455 bp, Oryza sativa
tttctctcttcttatttatcttcttaaactatgtttacagctagcttatagtctgctattgtacctgttctaacccgcttaaaaaccccctaccaaatactggtgggcttggagccagcagcaaaagcccattattaacgggacgcacgcgcgcgcgcgcaggggacaagtcgagggagagctagctagcttagcttgcttggttgctttggaggtgtggcttgccatggcgagagcgttccgcgcggcctcgccgctgccgctgccgtcctccagctccagggcggccgcggcgagcggtggcaccggcggaggcggaggcgggaacttcccgtggctgagcaggaagcggctgggcgccaagccgccgtcgccgcagcggcgaggtggacaggagagggagggaggtggagatgaggcggcggggatggggacgacgacgagggccgcgcggttctccgcgacgtcgtccgcggagcctgctgaggtgcagtcgtcgtcgtcgtcgaggaagcgcgcggacgcgctggcgaggctgcgggcggcgttcctggcggcgatcacgcaccggcggcggcggcggcagctggggtcgagcctgacgggcaccatcttcgggcggcgccgcggccgcgttcacgtcgcgctgcagacggacacccgctcgccgccggtgctgctggtggagatggccgcctactccaccggcgcgctcgtcagggagatgtcctccggcctcgtccgcctcgcgctcgagtgcgagaagcaaccaatcaacccaggcgagaagcggcgggcgctgctggaggagccgacgtggcgggcctactgcaacggccgaaagtgcggcttcgcggtgcgcagggagtgcggcgccgacgagtggagggttcttggcgccgtcgagccggtgtccgtcggcgccggcgttctccccgacgacgccgccgccgccgccgccgccgaggagggcgacctgatgtacatgcgcgcgaggttcgagcgggtggtcgggtcgagggactcggaggcgttctacatgatgaaccctgacggcagcggcggcccggagctcagcatctacctgctcagagtctgaccatggatcatactatcatggagcaaaatcgaaaagaaaaaatgagagaagaaatcatcttgatgtttgcaattaattgtacgtaatccatccatccatgcatgcatagtttggcttgtgttaattactttcttgggtttcatgtaatttgaagggtgtcaaggtgtgtacagtattactgatcacttggggggggcttaatatatcaatctggtaaacattggtgtgatgcactgatgctgctgtactatctgtttgtgagacatttcacgtctgtgtgcttcaggactaattcataatgtctttgctaatctatgctgaaactttggttcattggctgatggctaataaattca

SEQ ID NO: 113 - DNA, 2222 bp, Oryza sativa
tccatttccgcccacatcgccttctacctctcgcactccgctagctaagctcgcttgcttccactccagctagccagcgagcgagcgagcgagctcaccttctactccactcctcgcgccgtactctccatgccctcgtcttgaagcaaggtcggcagtggcagtctttgtccggggaggcggaagctttcttgggtttttctttgaggcggctgcattgtttgtgattcttgggcgatggagaaggagaggaagcaggggttcttcgcggcgctgaaggaggaggtggtgcgcgggctgtcgccggcgaggtcgcgggggaagtcgccggcgaggagcgcgtcgccggggaggatgctgatcccgcgccgccgcaaggagaagcagcagcagccgccgccggagaagctgctgcagcagtacttcgcggagccgctcatctcgcggtcggggagcctgcggcccggaggggaggccctcgcgcccctcattgaggggcccgacccggagcgcctcgccgccgggggggacttcgccggcggggaggagtcggcgcggcgggaggggttcggccgatgggtccgcggccagctggcgcgcacgccgtccgtggcgtcgtccgccgccgccgccgccgccgccagtcccgggggttcgggcgactcgttccgccgctccgacctccgcctcctcctcggcgtcatgggcgcgccgctggcccccatcccttcgaagctagcagatcccctgcctctcctctccatcaaggggacccccattgagtcgtcgtcggcgcagtacatcctgcagcagtacatggcggcgtcgggcggctaccggctgctgcagtcggtgcggaacgcgtacgccatgggcaaggtgcggatggtggcgtccgagttcgagaccgcgacgcgcgtcgtcaagaaccgcgggcccagcggccgcggcgccgcctccgtcgagcaggggggcttcgtcctctggcagatggcgcccgacatgtggtacgtcgagctcgccgtcggcggcagcaaggtgcacgcgggatccaacggccgcctcgtctggcgccacacgccgtggctcggcgcccacgccgccaagggccccgtgcgcccgctccgccgcgtcctccaggggctcgatccgctgacgacggcggggctgttcgcggaggcgcggtgcgtcggcgagaagaaggtgaacggcgaggactgcttcatcctcaagctgtcggccgacccgcagacgctgaagcagcggagcgaggggccggcggagatcatccggcacgtcctgttcggctacttcagccagcgcaccggcctgatcgtgcacatcgaggactcccacctcacccgcatccagccgcactccggcggcgacgccgtctactgggagaccaccatcagctccgcgctggaggactaccgccccgtcgagggcatcatgatcgcgcacgcggggcgctccgccgtcacgctgttccgcttcggcgaggccgccatgagccacaccaagacgcggatggaggaggcctggagcatcgaggaggtggcgttcaacgtccccggcctgtccgtcgactgcttcatcccgcccgccgacatccgctccggccccgtcggcgagtcctgcgagctgccgccgccggccgcggcgccgcacggcgagcgcgccaggcacccggcgcgcgtcgccgccgtggaccgcgcgcctccccaccacaatgccggcggcgccaacgtcggccgccgcggcgacaagatcatgtggagagtggaagtgtgacggcgaggctgttagtgttgttgtttactatagctagtagctgcatttcttggagtgaaattaaaccaaagcccaaaaaattgttcataccagtagagtttaatcctcctcatttccaaatgagcaagtatattcagcaaatattagctactcctagctgcctctacttcaattttccaccgtgaaatctgtaaataggagcataaatgttcttcactctcatcaggccactcgtgtttcctcacttttatggcctctgagatggatcttttatcctctgaatgcagaagtttttagtgtaaccttttttactgaacccctactactcctcttgtaggccttcagaaaaatcagagctgtactaatttgagatcacctgacctttcatgttactgcaaattttcttggttgtggtggcacttgaaaga

SEQ ID NO: 114 - DNA, 1054 bp, Oryza sativa
ctagggttaatcctcccgcgccgccacttcctccctccaatcccgcgcgccgccgcgatggccccgaagagaggcgcgaaggcgccggtgccggcgaggaagaaggcggcggcggcggcggtgaacccgctgttcgagaagcggccgaagcagttcgggatcggcggcgcgctcccgccgaggaaggacttgcaccgcttcgtcagatggcccaaggcggtgcggatccagcgccagcgccgcgtcctcaagcagcgcctcaaggttccacccgcgctcaaccagttcacccgcaccctcgacaagaacctcgcaactaacctattcaagatgctgttgaagtaccgccctgaagataaggctgccaagaaggaaaggcttttgaaaagagcgcaagcagaggctgaagggaagactgttgaagccaagaaaccaattgttgtgaagtatggtcttgaccatgtgacctatttgattgaacagagcaaggcacagcttgtggtcattgctcatgatgtcgaccccattgaactcgtcgtttggctcccagccttgtgcaggaagatggaaatcccttattgcattgtgaagggaaaggctcgtcttggatcgattgtgcacaagaagacagcatctgtcctttgtctgacgactgtgaagaatgaagacaagttggagttcagcaaaatcttggaggccattaagtcaaacttcaacgacaagttcgatgaggtcaggaagaagtggggtggtggtatcatgggctcaaagtcacaagccaagaccaaagccagggaaaagcttctagccaaggaagctgcccagaggatgacctaaagaactagcctgaaattttgcgttgtggttgttactaggaacacattgtgatcttataacttcggtctgcaatgtagtatgcttatagttattatgtggatgtggaccttgagtgtactttaaattaaaattaatacctattcctgttgcaactattatgtggagtttacagcagaattagaaatgaattcactattggtgttgggtgtgggctaaa

SEQ ID NO: 115 - DNA, 3095 bp, Oryza sativa
acctccaccacgacgcacgcttcgagcgccgcttcgcctctccccgctccactctctctctctctccacagcgtttgtttttgctcgcgagaaaaaccctgcggaaaatcgaaaaatctcgcctcccctcttcgtcccctcccctcccctccccactcgccgccgaagcttccggtttttgttcctcctcctcgaaccctcgggagagatcgcgtggcttgagcagcgtttcttgctcggcggcggcggcggcggcggcggttgctagatctccggcgtgacaccggtcggaatgggctggatgtcgacggggacgacgttcgggcgttgatggcaggtgtggtgttcccatgattgatgatgtggagatactgggatggttcgagatgaagaaaatgcttgtgaggtgctctgttgagagaaaccttattacctgatgacttgttaattcgaagttattctagcacaccagttgctgctggttggatctttttctttcattgctgagtaggagcgtaggagttggttggttcaagaatttcgttcaagatgatgcagaggccgttccgtccggaggagtactccttgaaggagacttctcctcaccttggtggtggagctgctggtgacaagctcaccaccacctatgacttggttgagcagatgcagtatctttatgtccgggtagtaaaagctaaggaccttccaagcaaggacatcactggaagctgtgacccatatgttgaggtgaagcttgggaattataagggtacaactcggcatttcgagaagaagactaatcctgagtggaaccaggtctttgccttttctaaggagcgcattcagtcatcagtggttgagatcattgtcaaggataaggactttgtcaaggatgacttcatcgggcgggtgttgtttgacctgaatgaggtcccaaaacgagtgccacctgacagcccattggctccacagtggtatcggttggaagagcggaatggacacaaggtgaagggagagttgatgttggccgtttggatgggtactcaagcagatgaagcattccctgaagcttggcactctgatgcagcgtcgatcccaggagatggacttgcaagtattagatcaaaagtttaccttactccaaagctttggtatctgagagtcaatgtcattgaggcacaagatcttataccaaatgacaggaccaggttccctgatgtttatgtcaaagccatgctaggtaaccaagctcttagaacccgggtatcaccaagccggacgctgaatccaatgtggaatgaggatttaatgtttgttgctgctgaaccattcgaggaacacctgattctgagtgtagaagataggattgccccagggaaggatgatgtacttggaaggacaatcatttctctgcagcacgtacctcggaggctggatcacaagttgctgaacagccagtggtacaatcttgagaagcatgtaattgtggatggcgagcagaagaaagagaccaaattttcaagccggattcacttgagaatatgcctcgaaggtggatatcatgtcttggatgagtcaacacattacagcagtgatttgaggccaactgctaaacagttatggaagcacagcattggcattcttgagttgggtatcttgacagcacagggcctgttgccgatgaagaccaaggatgggcgtggaacaactgatgcttattgtgttgctaagtatgggcagaagtgggtgcggacaaggactattattgatagtttcacacccaagtggaatgaacaatacacttgggaggtgtatgatccctgcactgtgatcactattggtgtatttgacaattgccacttgaatggtggggaaaaagccaacggtgcccgggataccagaattgggaaggtccgcatccgcctctctacgctagaaactgatcgagtatatactcatgcttaccctctgattgttctgacacctgctggtgttaagaaaatgggggaggtgcagcttgctgtcaggttcacatgctcatcactgctgaacatgatgcatctgtattcacaaccattgctgcccaagatgcactatgtacacccattgtccgtgatgcaggtagacaatctaaggcgccaagccaccaacattgtatcaacaaggctgagccgtgcagaaccaccactgcggaaggaaattgtggagtacatgctggatgttgactctcatatgtggagcatgcggaagagcaaggcaaactttttccgtatcatgggtgtcctaagccctctgattgcggtggccaagtggtttgatcagatctgccattggagaaatccgctgaccaccatactgatccacattctctttgtgattttagtcttgtatcctgagctgatactgccaacaatcttcctctacctgttcctgattggagtgtggtactaccgctggcggccaaggcagccacctcacatggacactcgcctctcacatgcggagagtgctcatcctgatgagcttgatgaagagtttgacacattccctacttctcgtccgcctgacattgtgaggatgcgttatgaccggctacggagtgttgctgggaggatacagaccgtagtcggcgatctcgcgacacaaggagaaaggctgcagtccctgctaagctggagagacccaagagccacggcgctctttgtgaccttctgctttgttgctgccattgtcctctacgtgactccattccgtgttgtggtcttccttgcaggcctgtacaccttgagacacccaaggttccgccacaagatgccctctgttcctctgaacttcttcaggaggctccctgcaagaactgatagcatgttgtaagctcgactgcctcatgctatgctatcgagctgcccaggcgatggctgcaatgcataagaaattggagaaacctgaactcttatctattctcttttttgtagtctatcagttgcatggttatgtatgtcttcaggtggttttgaacctttcatgtaactgctgaacgcattatgtgactggatttgcatgtatggtgcgtgcgggaaatttgttcgtggtca

SEQ ID NO: 116 - DNA, 977 bp, Oryza sativa
aaaaaatccattattttctctcctttttcgcctcggaacagttgagctgatcgatcgccggatcagagtagattatctccggagccaagtgaccggtggcggccattatttttcctttttagtttatatttttttgaattatttttatttttacgctcatcgtcatcacacgtcgccgtccctttcggtttcatcatcgatcggtttcatccactatcttcccctccccaataagaattcgatctttcggttctcggtgaaccaccccccgtgttttcttcgtatatagcggatcttctgggtctctgatcctgtgaatttcgggaatttttgtgatcgatcgatcgatccatggcggggctgcagcggtcgagcgagacgttccggcggtcgggctcgtcggggctcgtgtgggacgacaggcacctgtccggggagatcaagccggcggacggcggcggcggcggcgcggcggcgagggtggagcgcagccggtcggccgggcacggcgggtacagggcggcggggcgcgtccagccggcgctcgacccgccgtcgccgcgcgtcgccgtgtgcggcttctgcaggttcttcggcggcagcggcaagggcgggaggagcggcggcggcgccgccgccgccgtcgccggcggcaaggccaaggctaggcgccactcgtcgtcgtgatccgtcgagagctagagcgactcatcgtctcatcatctgtacatacatgcaattccccatctgatcggatcatgctccaatccattagtccatttcgtagcctttttattttttcatatagtttctttgcttatcttgtaaattgtttcatgtcaagtaggtgattagcactagaaaactatgacgtgcaagcaactatgaactattaagtatttttcatgtgaacagtgaatgtgtccgtggagtatcatctgcagagcttgataatcttatttcttgtaattaatcta

SEQ ID NO: 117 - DNA, 1411 bp, Sorghum bicolor
catcggcacacagtctcggctctcgttccattgggcgaacgacactgtacacaaacctagctatactagcttagacaacgacccaaaccaaccagcaaccatggctggtggtgctcatcaacaggtggtggttgtgctcgctatggtggcgctcatggtgacggcggccgagggtttcatctccaagaagacatggagcgccatccggcgagcggaccgcgacggcccctttgtggggctggtggtgcccaacacctacgagatggaccccgtcctaagctctcctgacttcaagcctagcaacaacatccccattctagatgtccaagggcgacgattccgcttcggaactattggaagccaaaacgttgtcatggtcatgactgggctgagcatgctgaatgcagggctcaccacccagctgctgctgagcctgttcagggtgaaaggcatcgtccactggggcatcgccggcaacgccaacgaggaccttcagatcggcgacgtgaccatccccgagtcctgggcgcacctgtccctgtggaactggcagaggcacggcgatggtgcggagaacgagctgccgctggagagcgccggcgactacacgagggagtacggcttcctcaacttctccgactacactgtcggccaggccaacccggagctgtcggcgaacactctgaacagcgtgtggtaccagccggaggagatcttcccgatctccggcacgccggaggagcggcagcacgcgttctgggtgcccgtcagcaagcgctactacaggctcgccgcgaagctggaggggatggagctgccggcgtgcgtgaacgagacgacgtgcctgccccgtgcgccccgggtgacgcgtgtgcccaggggttgcagcgccaacatctacaccgacaacgccagctaccggcagttcatccgcgctcacttcgggtgcacccccgtggagatggagagcgccgccgtggcgctcgtggcgcaccagcacggcgtccccttcattaccatccgctccctctccgacctcgccggcggcggctcgtctctcagcaacgaggccgccacgttccttgacatcgcggccaagaacgccgtcgacgtcatgctcaagttcgtgcccctccttggccgcggtggcgagcaggagcaggccgacggtctggcccaagacatgtaatgtaaggcgggccaggagacagatagacgacgctgagcagtcacgtcgtggtacaatacaatttcgtcttgtaaggtttttatttaaaataatttcccacccacgaattaacttgtatcgctattgcaaacctatcttcgggaataaataagattggttgtcgtgccgatgtgttttttatattattaaaaaaaatacttacccttaagcaatgttacctct

SEQ ID NO: 118 - DNA, 1734 bp, Sorghum bicolor
gcgagtcgtcttccccggttccccctttgtgttgtgccgccgccacccgcccgcggcctcctcttccctcccctttaaaatccaaacgctcctccccccccctccctccaaccgtcgtcaagcctagctcaaatccccgcccaaatggaggacccaccagcgcttgctccgccggagccggagccggagccggagcccgaggcctccccggcgccgccgcaaaggctgctgcggctgcgctgcgcggtgcagcactacgagtggggccagcacggagccgcctccctcgtcgcgcgcctcgccgaccagaaccccgacccggctcgcccctacgccgagctctggatgggcactcacccgtccggcccctccacgctcctcggcgacggcgcgctcctcagggactggctcgcgcggaaccccgacgcgctcggccccgccgtcgccgcgcgctggggaggcgacctcccattcctcttcaaggtgctgtcggtggccaaagcgctctcgatccaggcgcacccggacaagaaactcgccgaggtgctgcacgcgctgcggccgtccacctacaaggacgacaatcacaagccggagatggccatcgccttcacggagttccgggcgctttgcggctttgcccctattgaggagctcaaggatgtcctgaggacagttcctgaaattgaaggcctaattgggcatgaagatactggcaagctgatgaacatgaaggagtatgatggggttagtgaagtaaagtccagtttgcgatcagcttttgctaagctaatgacagcaagtaaagacatggtttctgaagcagttgcaaaactgatcagtcgcctgaatactgacagcaagattaggaacttaacagacaaagaacagctggttttgtccctggagagacaatatcaagacgatgttggagttctagcagcacttttctttaactatgtgaagctcagtcctggtgaagcgctttatattggtccaaatgaaccgcatgcatacctctctggggaatgcattgaaattatggccacttcagacaacgttgtacgtgctggtttgacacctaaatacagagatgtgcaaactctctgctcaatgctaacatacaaacaggccttcccagaaattttgcgcggagttcctgtgcagccacacgtaaggcgctacacgccaccatttaacgagtttgaggtcgattgctgcttggttcctccaggtgaactgcttgtcatatccccggtaccaggaccatccgtatttctcgtaatgaccggggaaggcgagattcagttggattctatgtcaggtggagaaaaggcaaaggaaggtgatgttttcttcgttcctgcatacactgaggttaagatctctgcgtgtggccccgagtctgtgctgctgtacagggctggggtaaacagcagattcttcagctaactggcgcgtcgatctttggtcggaaggaggatttttgggttgtcgtaagtggaccacactgtaatttagggaagttttctccagctaagaaatatacgagaaaagaaatgattagttagcaaaaggtttcatatactaatgtatagggcttcaggctgataaaagaataactggttcctttcatatcttgataatttactgtaaagatgccttgcagtgcaatccacgttggatgcgctagaaagaaataaaaatgatgattagtatcaactatttggttgc

SEQ ID NO: 119 - DNA, 1954 bp, Sorghum bicolor
gcttgagcattccaccactttgctacccaccacacttacacgtagctagctagctactcagtgggtgtaggcgtgtagtgtagctctcagagctactagctagacctcgccgtccggcgatcaccatggcggcgaagaagcagctgccgcaggccgtcgcggccgcctccggccacaccaagatgggggaggagaagctgatcatccggtcggagaaggtgaggttcatcgacgtcctgtcgatgctgttcctgcgccgccccatcaccagctacgcgttcgtggaggccggcgaccggaccgccgccgacttcggcagcacgccgggcgactggctcgtcgcgctcacgcagctcatccagaaggcgctcgacgccgcctactacccggcgctcgtcatcggcgccgtcgtcgagttcctcctcaacttcgtcgccctcaacaatggcatactcggcatctttctcaacatcttcagatgtaagctggtgatcccacaccgtgacgcgcccaacttccggtccatgatcgggctcatcgacggcaggacggagctgaagccgctgccggccggcggcggccctgaagaccggcggctgcaggtggtgggcgtctccgccgctggcagcgacgactactacgtcgacgtggagagcggcggcggcggcggcagcagcacgggcacggcggcggtgccgctggtgcagcagcagtacgtgaacgggcggctgatccggctgcgcaccttctcggtgttcgaggtgagcatgatggccgccaagatcgcctatgagaacgccgcctacatcgagaacgtcgtcaacaacgtctggaagttccacttcgtggggttctacaactgctggaacaagttcgtgggggaccacacgacgcaggcgtttgtgttcaccgacaaagcgaacgacgcgagcgtgatagtggtatcattccgtggcacggagcccttcaacatgcgtgactggtccacggacgtgaacctgtcatggctaggcatgggcgttctgggccacgtccacgtcggcttcctcaaggctctcggcctccaggaggaagacggcaaggacgccgccaaggcgttcccgaaagccgcgccgaacgccgtcgccggcaagcccttagcctactacacgctccgcgaggagctccgcgcgcagctgaagaagcacccgaacgccaacgtggtgatcacgggccacagcctgggcggcgcgctggcggcgatcttcccggcgctgctggcgttccacggcgagcgcgacatcctggacaggctcctgtccgtggtcacctacgggcagcctcgcgtcggcgacaaggtgttcgcggcgtacgtgcgcgggaacgtgcccgtggagccgctccgcgtggtgtaccgctacgacgtcgtgccccgggtgcccttcgacgcgccgcccgtcgccgagttcgcgcacggcgggacatgcgtctacttcgacgggtggtacaagggacgggagatcgccaacggcggcgacgcgccgaacccgaactacttcaacccgaggtacctgctgtccatgtatgggaatgcgtggggggatctgttcaagggcgcgttcctgtggaccaaggagggcaaggattacagggagggcgccgtctcgttgctctaccgtgccactggactgctcgtgcccggcatcgcgtcgcatagccctagggactacgtcaacgccgtccgcctcggcagcgtcgtcgtcgccggcaaggaggaggaggtcgtctgatggatgaagatgagaggttttgctagcttttggatgttgtggctgcgtgtgtcgatctctgtgtatggatggactgtgcagcgcgagaggaaatcaagcatatgtaccgtgtgtctgtgtgttcatttccacgtacgtgtatcattgcaataattggatgaaataaacagcaataagcttcttca

SEQ ID NO: 120 - DNA, 724 bp, Sorghum bicolor
aggatgtggcgtatgataggtctacagctccaaaagactgtctggtgtctggatggtacgaggagacgcctggtgagacccaattgggtcatgctgcaaagatggctttggtagagttcacgtacgacttggagaagaacaatgtgcagacatttgatgtgtcagccccagatgtaggcgtgatcaatatgatccggttggatttcaattcgaatcacggaagctcgcagctgacatgcatctaccgcctccgggtccatggccatgaaccggtctctccaggaaccgcaggttctcaggcctgagttgtgtggaagccttgtgtttctatatgctacgtgattcacttgacggtccgctctttgtgctcaatctagttttggtctagggctgtcatgtacacacactgtaaatctaacaattgtttgctggtagcctggcgtcttcctaggtcctagtccagtaacatgtggtaggtgtttagttcgtgctatgaaaacatggaagttcaacagtattttgttgtgcaattgttcgtttgaaccttggcaaggcttgtgctgttgtctttggtttaagcatatacttccattgatttcccgttttcaaattctaatggatgatcttcgtagcaggtacaggtccttcgctgttttttaaaaaaattatcatatgaaagtcgttagcagtgatcccatatttttaagaaaaaaggtcctttgtt

SEQ ID NO: 121 - DNA, 506 bp, Sorghum bicolor
cggcagcagaaaccctagggaagcaaggaggacggcggccgggagcagaaaccctagagtctctcgcacggcctgcgcatcctaaagttgacaatggctgctgttgtggaggtcacgtttgatgcacaaaaacatatcaatgtctccaaggggtctattgttggtgaggatggtggtattggataccttgtgtaccccatgcccccagctggcacttttgacctgtccactgacaaggaattactcaagaacatcaatcaagagctcgtcggttgtaaaggaggtgataacgcccgtgcaggcagcccaaagacactgcgtaaggctcgcgagaaagctgttcgcagggcctttctggcctatctagggcagtaaatgcatttgaacattgtctcaacaaatctgagtattatgtgaataacacgtatgatatgtgctggaagtagcaggggttaacccagtgcgccgggtgaacaagtatggaatgaacaagtagccggaagtag

SEQ ID NO: 122 - DNA, 616 bp, Sorghum bicolor
cgcggctgctcgtccgcgacatcgaatttcagagccgcccccgcgagatcccggccttcgttctcttcccccgagaggtgccgcaatggctgggaaaggcgggccgaccaacttggagaaggagcagatgtttgggatggcagagaaggagatggagtacagagttgatcttttcaataggcttacacagacctgtttcgacaagtgcattgagaaaaggtataaagaagctgagctcaatatgggcgagaacagttgcattgatcgatgtgtttcaaagtattggcaggtgactaatttagttggtcagatgcttgggaaccgtcctcagatgtgaactgagaagcactagttccattttgtagctattgctctgtttcttctttttggttggctttagagtgcctacacctgctactaagtacaccaatacagcaccagacatgctaatgcgccaccgctttaaagaaaaatcacggtgtcttaccctttccagtgatgcgcattctctctgaatcatgaacatggaacatgcctgtaataatttgatacagctctagagtcattctgtttcgaaagcttgtcctgtttcgtagttaaattctggatttatgtt

SEQ ID NO: 123 - DNA, 722 bp, Sorghum bicolor
gttgcgtctgcactgcagaggccgtagctcgctaggaggatcagcgatgccttcccctacgccgcctccgatgtccacgccgcacaagtcctgctcgtcgccgtcgccgccaccgccaaagctgcagcgtgctccggacatccggcacaggcctatctgtagagcaggcggcggagcctgcaggctgccgatcaccaggagagctcacgccgcatccctcctcctcctcggcctcgcgccggcgccggcgccggtcagggcggaggaggatgggagcggcggcgaggagggcgtcctcggcgccatcaagtccatcttcgaccccaacgagaagaccaaggccggcaagacgctgcccaaggcgtacctcaaggcggccagggaggtggtgcgcacgctccgcgagtcgctggaggaggacgacggcggggacatggccaggttccggcggaacgccgacgccgccaaggagtctatcagggagttcctgggcggatggagaggccagcagaccgtcgccgccgaggagtcgtacgtcgcgttggagaaggcgatcaggtcactggcggagttctactccaaggcagggccattcgcgccgcttccacaggacgtcaagaacaagatcctcgatgatctcagcgccgcagacgcctgcctgtagattttgcttctccaggggcattgtattgcatgcacatctcaaccatgatgatttcgtt

SEQ ID NO: 124 - DNA, 1565 bp, Sorghum bicolor
ctcaccactagagccaagaaagagctccattcatttcccccctctctgtctctgaaaagcaaaccagctagcaaagggccggagagaagagaaccaacaaggcatcaaccatcaatatcgatcgaagacaccatggcagccaacggcaagagcagcttggcgaacggcgcctcctccacccagggaaagcccatcaattgcaaagcggcggtggcgtgggcgcccggcgagccgctggtgatggaggaggtggaggtggcgccgccgggtcgcctggaggtccgcgtgagggtgctcttcacctccgtctgccacaccgatctcagtttcttgaaaggagagaacgagctgcagcgcaagttcccccgcatcctcggccatgaggcagccggagtggtggagagcgtgggggaaggggtgcaagacctggcccccggcgaccatgtggtccccatcttcaacggggagtgcggagcctgcgcgtactgcgagtcggacaagaccaacctgtgcgggacttaccgcgtcaacccattcaagagcaccatgtcctccgatggcggcacgaggttctccgtggtggaccgcaactctgggctgcggcagccggtgtaccacttcctcaacacctccaccttcgccgagtacaccgtgcttgacgcggcctgcgccgtcaagatcaaccccaaggccccgctccacaagatgtgcctcctcagctgcggcatctccacaggagtcggggctgcatggaacacggcaaacatttccgcgggcaacaccattgcaatattcggccttggggctgttggtctcgcggttgctgagggtgccaagctacgaggggcagctcggatcatcggtgttgacgtaaaccctgaaaagtttgccaaaggcaaagagatgggcgtcacggacttcgtcaactccaaggcctgtgacaaaccggtgcatgaggtgatcagggagatgactgacggagctggtgtcgactacagttttgagtgtaccggaatcaacgatgtgctgagagaggccttcctgtccacgcatgatggttggggcctgacggtggtgctggggatccacgcgacgcccaagatgatgccgctacacccgatggagctcttcgacggccgccggatcaccggctgcgtctttggtgacgtcaagggcaagtcccagctgccagccatcgtcgacaagtacgtcaacggggacctgaatataaactttgatgggttcataacacacaacatgcccttctcggacatcagcaaggccatccagttgctggaggaaggcaagtcccttaggtgcgtgctccatctctgatgggccaagcatgggagattattgtccttgtttaatttggttatgacaaaaataaatatagaatccagtgttgagtggtacaattcacatgtgcatcagtgctatttttcttgtaaagaagggtgtgattactgaagagaactattagcagtaggaaacagagtaattcacatgtctttgtgctgtaatatatctcaagttgtctccattaagtggttctatttccagcc

SEQ ID NO: 125 - DNA, 1682 bp, Sorghum bicolor
gtctgctaagctaagctcctaagctaaaggaaaggtaaccccacccccgcccccaacctccaccatcgcctgatcggccggccgatcgatccccacctccgggcgcttcctcctcctcctcctcctcctcctcacccccggcgcggcgttctatgacctacacctcctctctccacctccccaagcacctcctccttcccagcccccgccggacaaggcaccgcagtccgtcctccttcgtccccgtctccgcggctgccaacaagatcaatggtggcgttcacggacatcacgcgcccgagaagccggcgttgcccaacggcaaggcgccacagcacatcaacgggcacggcaacgggcacggcaagaagggcgtcaacgggcacgtcaacggccgccatgcgggcaacaaccggatccacctctcggtgagcacgggcggcggcgggggccaggacgggtccgggctccgcgtggcgttccagggcgcgccgggcgcctacagcgagttcgcggccaagacggcgctgcccgggtgcgagacggtcccgtgccgcgccttcgcggacgcgctggcggccgtggagcgcggcgccgccgaccgcgccgtgctccccgtggagtccaccatggaaggcaccgcgctgcggaactacgacctgctcctccggcacggcctggtggtggtgcaggagatcaacctcttcgtgcactactgcctgctggccatgcccggtgtccgcgccgccgaggtgcgccgcgtcatcagccacccgatggcgctggcgcactgcggccgcgcgctggcccggctcggggtggacccggagcccgtggaggacacggcgggcgccgtcgagatgctgcgctcgggacggatgctcgacaccgccgccatcgccagcccgcgcgccgccgacctgtacggcctcgacgtgctcgcgcacgggctccaggacgagtcctggaacgtcacgcgcttcctgctcctctcaaggccgtcggccgtcgccgcgctgcccgtggacgccgccgcaggcggtgccacaaagaccagcatggtggtcgcgcaccggggcggctccatgatggtggtgctcaaggtgctctccgccttctcctcccgcggcatcaacctcaccaagctggaggtcatcaacaacgacggcgccgcggctgccgacgccggatctggcgctggcgcgcgcccgcccgtggtgatcctggacacgagcgccaggggcaagccgacgctgcgcgcgttcccgcacgtcctgtacgtggactgcgagggcgccgcgcacgacccgcgcgtccacgaggccatccaggagatcgagacgttcgccgtcttcgtgcgcgtgctcggctgctacgccgccgactccaccgtctacgacctgcagtgacgaatttagcttagccagtctgccgtgatttcctcgctgttaattggacgaagctgtctgtcagattctagctagtactagcattcagaaagcagcttcagttaggtagattagttgcttgcttatgcgtaatttttgtacagatgcaataagaatgttcctattgcttatgcgtaattaggttgaagcttggtgatgatgccagctgaaggatgtttctactttctactaagatgtattgtcgttgttggttatgactggattatctcttgt

SEQ ID NO: 126 - DNA, 2372 bp, Sorghum bicolor
cttactgttgtgggctgggcctcatgtctccaaccttgtgactcgatccgatcttctctgttcctccttggccccctccccaaatccaccgccatctccgagccctaaccccaacctcgaccgcccatggccgccaccgcggcctcctcggccgccgccgacgccgcgtcgaactccgatgaggaagcaaactatgaggagtacatcccagtcgccaagcgccgggccatggaggccgagcgcctccgccagctccgcctcaacaagtcggcgccgacctccgccgcctccaccctcccgctgccgcctcctccgcctcttttgccggcgcaggcctccgttcccgacgccgccgcgaagcccagcctcctcgtcaaggccacgcagcttaagcgcgccgccccggaggtgaccgccacggagcagcgcatccagcaggagaaggaagtgattgagaatctctcagacaacaaatccctcaggtcagtccgtgagatcgccaagggcatcatctacacggactcgatccagaccgggtggaagccgcccctccgcctccgccgcatgccgctcgccaaagccaacgagctccgccgcaagtggcatatcatcgtcgatggtgacgatgtcccgccgcctgcgcgtgattttcgggacctccgcctcccggagcccatgctccggaagctgcgcgagaggggcatcgtccagcccacgcccatccaggtgcagggtctgcctgttgtgctctctgggcgtgacatgataggcatcgctttcacggggtcggggaaaactctggtgttcgtgctgccgcttatcatggtggcggtgcaggaggaaatattgatgccgattgtgcctggggagggcccgtttgggatgatcatatgcccgtcgcgggagctggccaagcagacatatgatgtgattgagcagtttctcattccacttaaggaggccgggtacccggagataaggcctttactttgcattgggggtgtggatatgaggacacagctcgatgtgttgaagaagggtgtgcacattgtggtggcaacgcctggtcggctcaaggatttgcttgccaagaagaagatgaaccttgacaactgcaggtacttaaccttagatgaagcagataggctggttgacctaggatttgaggatgacatcaaggaggtttttgaccatttcaaggatcaaagacagacccttcttttttctgctactatgcctcagaagattcaaaattttgcgaagaatgcccttgtgaaaccagttactgtcaatgtgggaagagctggagcagcaaatctagatgtcattcaagaagttgagtatgtcaaggaagatgctagaattatatacctccttgaatgcctccagaagactccacctcctgttctcattttctgtgaaaacaaagctgacgtcgactacatccatgagtaccttcttctaaagggagtggaggctgttgctatccatggaggaaaagatcaagaggagaggcagaatgcaattgactccttcaaaactggaaggaaggatgttctggtggctactgatgttgcatcaaagggtcttgatttccctgacatccagcacgtcattaactatgacatgcctgctgaaattgagaactatgtccaccgaatcggtcgaactggtcgatgtgggaagactggcatagcaactaccttcatcaacaagaatcaaactgagaccacgcttcttgatctcaagcacctgctgaaggaggcaaagcagaggattccaccggtgctggcggagctcaacgatccattggaggatgaggaaataattgccaaggagagtggtgttaaaggttgtgcttattgtggtgggcttggccatcgtgtcagtgactgtccaaagctggagcaccaaaagtccatggcaattgctggctcgagaaaagactactttgggggcgggggttaccgaggagaaatatgattgctctaggttgatgcttgtgtgtggttatcaggagctaagatgctgcaacttcagctcaaacatgttacatgtatcagctagccaaggctcctccctcgatgttgaaggaagacgcatcgtattaacgaacttgtgatatgctgggtataacactgcttgctactgacctaccatatatcttgtttgaaggaggcaagtagattattctgccctgttggaaaatgtaaccagaacaattgctggcgtatgtttcttataggaatgttgcgaagcaccagttttaacccctttctgtaatcaatcaacatttcagattaactcatgtatgtatattttgatctcgtatgctatatttccatctcatgtctgctttggcatatgagcag

SEQ ID NO: 127 - DNA, 3425 bp, Sorghum bicolor
tgccaacccggcaccggcaaccctcctccttggccccttgccatctcattcccccactctgcctttgcaggtcgccactcgcagcaagcattccacaacatactttcctccggtcccgttcggcggcgaggctccgatcgagcaacgtcgtcgcgcctgtccatgccggcgccgcggccgtaagggcggtcgatcgagcgaggaagagagagctagcgcgagcgcgggagcagccatggcggcgtcggcggggaagctggcggcagcgctccaccggaggacgcgcagggtcacgtctgcgctggcgtacgcggccctggagtgggtcctcatcgcgctgctcctcatcaacggcgtgctcgcctacgccatcgccaggttcgcggactacttcggcctcagcccgccgtgcctcctctgctcccgcgtcgaccgcctcttcctccaggcggaaggcggcgatgccgaggctggcgccgcgcggtggctgcgggacgcactctgcggcgaccacgccgcagagatctccgcgctggggtactgcctccgccaccatcggctcgcggaggccggagagatgtgcgacggctgccggtccgagtggaaggagaagacgagcgatgctgcaggtgcgtgtacctgctgcaaagctgtcgtacggacttctttgcgcgagcaagaagatacaattacaagggatcaacatgtcttggagaagataaccgaggaagtagaagacgacgatcagggctatgttcttctggctcaagatgatcacgaagaggacgaggaggagccggatgaggtcgagagccaagaacaagaacagcagagcgaggtggaaggccaacagcaagaagacgaggtgatggcttccgttcaggatgaatccttggaattcatggatcaggtcgaagacatcaccgcgatcggggacgaccggttggtgtcggtggtggcgcttgatgagatgacgatcgccgatgattcgggtcttcatcgggatgttgaagaggaggacggagtgaatcgtgtagtagaagatgagcaggattcgagggatgtggatatcggagtggttctggaggagaagaggatgttggattcctcggttgcaacgccggctgatgtgatcgaggactctgtcatgcccatcagccccgtaccttgtcctgagattttaacaaacccatctcatcctgatcataactccatttcccaagatgatggagatgttcctgaagatactgctgaaattggcgattccacggccgaggaagaacacatctttgtgcctcaagaagccaattttgaagatgacaacagaacagctgaggtggacacgaactgcgaagtatcaatcggaagcgatatatgcgaacgggaacaagatgaccatgtcgttccatttcaagatttggcagcattggaggagccggtttctccattgtcagctgcagatgatctgccattgccattggagattctagacccaactgagcaagaagaagctggtgaagttgagcaggaggaggtgacgacgagcacgggattggacctccaaccaaacgagcagagcgagatcgaagaagacaaagcacctgagacaccgacgaacagcgccgctacacaacgctccgacagaatgtttctgctcgagaggaaacggtcgttgtcgctgtctctggatgggagcgtggcgagcgagatggaaggcggcgagccttccaccgtggaccagctgaaatcggcgctgcaggcggagcggaaggcgctgggcgcgctgtacgccgagctggaggaagagcggaacgccgcggccatcgcgacgaaccagacgatggcgatgatcaaccggctgcaggaagagaaggcggcgatgcagatggaggcgctgcagtaccagcggatgatggaggagcagtccgagtacgaccaggaggcgctgcagctgctgaacgagctggtcaccaagcgggagagggagaagcaggagctggagagggagctcgagctgtacaggcagaaggtgcagcactacgaggacagggagaggaggaggacggcgagcttcaaggccaacggggtaagcgtaagccccagtggcaatggcacttccgtgtcctccagcggcgaggaaagcgacgggcattccgacgactactgcgagctcggcgagtctcccgacgtcggcaacgttcagagctcatcggatgctgcacttggctccatgagggatcaggaaggcaccaagcacctagcggctctggatgattccttgacgtactttgagatggagagactttccatcttggaggaactcaagacgctggaggagaggctcttcacactggaagacgatgataccaacaccggcaaacaagctattggccattcctcgattgatttcgatttgtcggccggtggccttcagtcgcctgattatattctcagcggtgacaaggcaagaatcggaggaagagcctctatcagtagagggaagagccttctgcctctgttcgatgcagtcggcgacgagacctgtgaccaaatgccatctgcaggagtaggagaggcagatcaagacgatgattcggcaacaaagccggtgtcggtgcttgtcaaagagcaggagaggctggcaatcattgaggaagttgatcatgtctatgaaagattgcaggcgctggaggcagacaaggaattcctgaggcactgcatcaaatccctgaagaagggagacaagggcatggaccttctccaggagattttgcagcatcttcgcgatctccgcaatgtggagcttcacgtcaagaatgccggtgatgccatagctgcaaattcagcctagcaagttcgtctataggaggtaatgattaccctagcttggtatcgattgagtagactggattggagtaatccaaggcactgcattggtgatggtccctggaaggtactgcctgattattgggaggctctgctcattttgtctgtgggccggaagcaggccctcccttttgtgctggtccagcactgccaacttttttttttctgttgtgatggtcggtcgtaggaatcattaggccttccaacgctgcacaaagctgaatcatggtgacagcttctgtggcatgcacggggcaaaagaaaaaggttagcccaagtggagatgtggatgtttttttttgttatctttccttgtcggatttaatcttttggttaacttcggatttgtttttgagctgaggtagggagtcctcatgtatttgttgtaattttttttgtgaggttgtagcttgaacggttggtacatgcagtttgctctttgtctatagccagatttatgatgaaaagaaaggctgtcttatgatgaaatccccctgtggtaaagattatcccctaaggctctagcccttgggttttgc

SEQ ID NO: 128 - DNA, 2288 bp, Sorghum bicolor
gttggctccaactgaacggagcgagtagcccccaaaactactcgccggcgcgggcgcggaggcggaggcggaggcgactgcgagctcggcggaggcgatggacggggaggaggaaagggaggaaggggaggtgggggagtacaagctgcagagggtggtggggaagggctcgttcgccgaggtgcaccgcgcggcgcaccgccgcacaggcgcgcgcgtggcggtcaaggcgatcgaccgccgccgcgtcgacaagcgcgtccacgacggcatcctgcaggagagggagatcctcaggagcatcgaccaccccaacatcctccgcctcctcgacaccatcgacacgaagaagatgatgtccctggtgcgggagtactgcgacggaggcgacctcgatgggtttttgcacaagcacgcccggctgccggaggccatacccaaggacttgatgcggcagcttgcggaagggctgaaggtgctgagggggaggaacatcgtgcaccgggacctcaaaccacagaaccttctcctatcaaccaatggtgatgccatcgtattgaaaattggtgacttcgggtttgccaggtcactggtgcatgaaaatttagctgccacaatgtgtgggtctccatattatatggcaccagaaatttggcaagggaaagactatgatgcaaagtcggacttgtggagtgttggcgtcattctttttcagctagtcacagggaagctgccattcaccgggagtaatgcttttcagctgcaccaaaatatcctggctgccgatgatcttaacttcccttcagaaattgaagctgatttatgtgctgattgcattgatttgtgcagaagactcctgcaacgtgatccaaaggagagaataagttttgaagaattcttcaatcacaagtttttggcaacaaggaaatgcgatgaatcctgtcaggctatagagttaaggaataactgccagacaatcacctctcctgttgtcctaaaaacaaagtctgaaagcattgaatcaaaaaattcgaaagtttttgattcatgggaatggattgaacgagaatatgtgcttgttccggtaaactgtacttctatggaaatgtcttcactcaacatcaacaagtccacaaaggatgatacagatataagaactgccagctatgataggcccgctgccaaagggtctgctcaaaatcaaatcagagacttaactgatacagctactggtatacaaagccatggatgtgctcctgtgctcatttcccaggagtcagccactgtggactgtagacgagggaagctacctgattatattacaaggtttcattctctgaatcaatatgtgcttgttcttacggaacttgctcgggaaaagctttctaaaggcctgtacttggaggcgctatcaattgaacttgtattattagctatctggaaagaggcacttgatgcatgtagcttactcatggatgcatcagatggtgaaaatttctctaaatcttctcaagaacattcccttcctatgagtggccactcacctctgaatgtagtgcgagggttggatttcactaggacggcttctgttttttcctgggttgaaagtgggttcatgaaggcatatgatcgtgcagagaagatatcgcatgtattgcggaagagtgacgataataccgagatgccagatgcaatggatgtcgtattccaaactgctttggaatatgggaagactggagctgcaaatgaagttttgggacaccaaagcagatccacagcgctatactcaaagtctatcatcttgctcacatttttagtacaggaagcacctatgttgccactaaatccaccgctttccctttcgccgtcagatcagcaacgcatccataggtacatagctaacttgaagagccatctctgctgtgctcaggttgcagggcaacagcagagatcagtttataactgaacatggttgctcaaggattgaaaagattaatttatctgcatctggtgaggttttcttgtgctctggtgcagcgttagtccagcattttatttttttttgggttctataaggaggtggggtgttcaattctttggtgtcatgaacctttgtaaaattgtagttgccgaacaccatgatccttccccctcttttgtatatagataacacctacaagctctatatggtcgtcccttaccatgcatatgttgcaatgactctgaacttgtatatatttgtgactttgtaagtgccttgtgcaaacctgtaaatagaaactggttcg

SEQ ID NO: 129 - DNA, 1408 bp, Sorghum bicolor
ttgccagcctgcctgccgaaaaagatcccgggtggcccacctgccagcctcagcacccgcagcgttaacccctgcccaccccacctctctcctcagctttaagcatcctctgcggcgcaacggccacacctcctcccccggcctccgctctcctcgccgcccgcccgcccgcccgcctctctctcctcgccgctcgccgccatgaacaacctcctcacggattcctttgagctccctcggcgggactcctcaagagatgcggacattgaaatgggaatgcatcaggctgatgcttcagacaacttaaaggatttcttgaagaaggtcgatgcaattgagagtttaattgcaaagctgacaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaaaagataacttattgaataggcaaaaacctggatgtggaaagggttctgccgtggaccgatcaagagagcagactactggagcagtaaaaaagaaattgaaggagcggatggatgattttcagaccttgagagaagcaatcaggcaagagtatcgggaggttgttgaaagaagggtttttactgtaactggtaatcgtcctgatgaagagacaattgatgatttgatagagactggaaaaagtgagcaaatattcaaagatgctatccaacatcagggaagaggccagatactggacacagttgctgaaatacaggagcgacatgatgctgtaagggatctagagaggaagcttttggagttgcaacagatattcatggacatggcagttcttgttgaggctcaaggagacatgatcaacaacatcgagacacatgtctcgaacgccaccaatcacatacagcaaggtgtgaccgcactccagagcgcgaagaaactgcagaagaattcgaggaagtggatgtgctatgccatcatcctactgctggtgatagtggtggtcattgtcgtcgcggtcatccagccatggaagaagggctagcgtggttccaaacagggaggagggcatggcatgggatataccttgttgccctttttgctgtttgtgtaatatgtgtgcagttttttgtggggtgattcgtgatttattatatcgttgtacctatggtcgacacatcagaagctttggcatttctattcattctgtgtgtgtggggggggatagttcggttcggtggtaatgacactccaatggctcccgctccgtgaaatgtcgttgtgatcatatgctgatgaaaaatggcgcttctcgaatgctgctttcttcatatccatcg

SEQ ID NO: 130 - DNA, 1967 bp, Sorghum bicolor
catcctctcacggatggcttcggcggccgcgaggggcgccgcggcgcgctcccctctcctcgtccaccaccaccaccaccgccgccgcggcctccccctggtgcatcccggcggcggcgggggaggctccctccgggtgggcgggcccgggattgagcctcgacgggaggggcggaggcgggcccgggtcggggttagggttttcgctcgctactcccaggcccaggatttctccacacgcctccaagatagagttggcgagttgcctaaattagtcgaggaccttctccagacgtcgattagtacagggcctcgaggtgctttcaggatggcacaagggatccaagctgtgcttggggttggcggggagtggctgaatgacctctcaaagacagccaacacagcagcaggaattccatctcagatgcagcttggtttactttctccagtttaccttagaagactttttgagcgcatgggtgcaacttatatcaagttaggtcagtttgtagcatctgcaccaactttgtttcctgcagaatatgttgaggaattccagaagtgctttgaccaagcaccagccgtcccatatgatgtgattgaatcaatattacgtgaggagctgcagcggccattggatagtgtatatgaatacattgatccggtgccaatagcctctgcctccatagcacaggttcatggggctaggttgaagagctctcagaaggatgtggtgattaaagttctaaagcctggtattgaggatactttggttgctgacctgaattttatctatgttgttgcacgtgttttggagttcttgaaccctgaactacagaggacatcactggtaggcattgtcaaggacataaaggaatcaatgcttgaagaagttgactttagaaaagaggctgcaaatattcaggcatttcagggatacctagatgcaatggggtttgacaggcaggcaaaagccccatttgtgtatcaacactgtagtacaaaacgtgtgttgactatggaaagattgtatggagttccgcttactgatcttgattctataagatctcttgttcctgatcctgagttgactttagtcactgcccttaatgtctggtttggaagcttgatttcatgtgaatccttccatgcggatgtgcatgctggaaacctatggttgctccgtgatgggcgaattggttttattgatttcgggattgttggtcgaatatctccaaggacttgggcagctatggaggtctttttggcttcttttgcaactgaggattatgatgctatggcctccgccctttctgaaatgggtgctacagggaatgatataaatatcaatgaatttgcaaaggacctgcagaagatattctcatcaatacaggacttggatactgaaatcatagttgcaacagcaaggacccctgatgctacagcagtatctgctaatgttgtccttgatgagagacagatgaatgctctatttcttgatctggttagggtaagcgagtcttatgggctgaaatttcctcgagagtttgctcttctcatgaagcagcttctgtattttgatcgctacacaagactgttggctcccagcatgaacatgctgcgagacgagcggatcaacatctccaccaatcggcaactgagaagaactgatagattttagtgacaccattttattagtcaccagacatactagaggagttgtgatgggcgataatagcaaagctcatgtgacccaatactgtatatagttttgccagaccagcatagaaatgaaccacactagaaattgtactcttattcgtattctggaattcggcgttatatatgtcgtactagctataggcaacatgtaaaaactgtatgtaaactgtcaagtaaattttagtagacaaatcaagttaagatgcagctgtactatactacaactgtcagcacaaaaagtgatg

SEQ ID NO: 131 - DNA, 1429 bp, Sorghum bicolor
gccgtctgaattcgcaaaaccagcgagcagtcagagcgaacgccgccgcggcgcccgtgtctgtgtctggcgggcgccacaccgagccaatggagcccgcgctgcgcgagctgtgggcggagtcccgggacctgctgggcctcccttcctcttctctggacgccgccgccgccgccgccgtgccgcgcgtcgacctgcccccgacaccgctcgcgttcctccgcgaccacgtttccccgggccgcccgctcctcgtctccgccgcggccacccgccactggcccgctgtgtcgctctggcccaccgcctcctacctcaccgacgcactccgctccaccgccgtctccctccacctcacccccgacggccgcgccgacgcgcttgcctcgcacccgcggcgccccggcggccccggaccctcgaggtgctttgcatccgcgcacgtccgccgcgtcgacttccctaccgcggtccggctcatcagggcatccgacccggccgccggcctggtagcgtacgcgcagcagcaggacgactgcctccgcggggagtacgcggcggtcgccggtgacgtggatgcgcacgtgccctgggccagcgaggcgctcggctgcctccccgaggccgtcaacctctggatcggcaacgcccactccgtcacctccttccacaaggaccactacgacaacatttacgtcgttgtctccggcgagaagcacttcctcctgctgcccccgaccgagcaccaccgcctctacgtccgcgagtaccccgccgcccgctatgttgccgcagagcaggactccgaaggggagcatcagttgaggcttaagctggagatggaagagcccgagaggatcgtgccgtggagcagcgtcgacccgtgcccggcgtcgccggaggagatggccgtgcaggcgtcgtcgtttccgctctacttcgacgggccggctccgatgcggtgcacggtccgggccggcgagatgctctacctgccaagcatgtggtttcaccatgtcagccagagcccagggtcgaacgggctcaccattgccgtgaactactggtacgacatgcagtttgacataaagtatgcctacttcaacttcttgaggtcgctggatatcgatggttgttcatcgggcaaagctggtgcgttggaaggtgatctagaggagaagaaagattgagatggcgggcagtcactctgattactcctgtttcttgcggccattgtcttacagagtaacagatcttcaagcattagaagatgttgctggacaccaattaatcggccatgtatatttgtacaacatttgcaggtgccaattgacatatcaggctcaatatggttgcaactagaacatttgatttggtggtgcattggcaaattttggctgcattcacaaaagagaacatgaattttgaa

SEQ ID NO: 132 - DNA, 2396 bp, Sorghum bicolor
acctccgattcctcgcgccctcgtctgagtcgtctcccgcccaatttccagaagcttctggaaccgggtttctagccctaatcccgcaaaaggatgctttcttgcgcctagtagcctgggacggaggcatggacagcggcggcggggaggttggctcgaccggcgggaggttccccattctgcaggcgaacagggaccccgagtcgaattgggagctggatgttgccaagagcctcgaggagtacctgctcaagatctgctcaggggaggtctccggcgaggacggggcccactccgtcaactttgccgaagcggcgttattactccaaggatcggttcaagtgtacagtaggaaggtggaatacttgtactcattggtgcttcacgtgttagagttcctctcgcaaaagaagcaggatcaactggaaaatggcttggttcaagctaatcaaaacgaccctagcatgattcccagtgaagaagatgatatatttatggggttagatgatgtcccagtggaaacaaggacatctctggataacaatgtcaatcgagatgatttacaaagaaaaaatgtgaggccaccagcaaatctactggtgtttgaaggggactgtctggatagtgaagcgagtgagctagacacatatttgttagcaacatgtgatttttatggagatttccttctgctggatccttgtgatgcaccagctatttttgactttctgcaaggaaaacattctggtaaagaaaatagtgtggctcatccaggcagttcagcaccttctaaaagccgagccaatgttttcagttccccaaatttaagatcagcgggcacaggtcgtaaatcggccgctggaaaagtcctaggaggtctagatccaacccaggagaatccggaccaatcaactcaaggaaccagtccggataacaaccattggtctgatcctgtcgaacctagctttgctgatgatgttgaaatgcctaacccagattatatagaggatcctgttggagattattctgatgacgaggatccatggaaacctttgaatccacatgaacctggcaacctaaagatccggccttacaggagagtgaaaggttctccacggggggttattggcactcagaaaaagaaaactctcacatttctatttcctatggcaaagatggatggcgtcgtcatacctgaacatgctaaatcttttgaagcacagcagtgtcagcaggaggaacattatgaaaagtttttgagatcatttgaatttggagaagaaaatcccaatgtgtttggagatttgaaagatgacaatggatcaaatactggcattaattttgatgatgatgatccagacatgccaaacgacatagatgttgatcctgatgttccagcatatcctgacgagcctattgctgcaactcccaatggtacacaggatgacatagatacacatgcaagccttgacgacttgtgtcggtcacatctgaatgctctccttgccagcatcgctgaggttgaaaagcagagtgagatggatgctcgagtttcaacatggaaagaaagaattgaggatgccttggaagagcaggataaaaacccaccttttgatatcggttcatatggggagcaaattcttgacacactttcatctagaactgacaatacaggaactgcatcttttagtgagattgttagcggcagaccaaagtatgaggttgccagaacattctctgcccttctccagctggtgaatggcagaagtgttgatctggacaaaggacaagccacaaatgagttggtgtgttacacagcagagaatccattccatgtaaggctcattggtcccaaccggaggccagaaatggaggcacgctttgctcggaagagagtcaagtcgccactgcaaaatacaggcaaaagcggtgggtcctccctggcacagcatgagtgctccaagaagccgttgcataaaaatggcaagattccagtcaagacagcgatcaggcttactccagatgggaagcgaaggcgaaggtcagccactcacctaatgcagccgatcaatctggaatacagcggatgaacgccaatggcagactgactcatgggcatctagagtctgattcttctaattgttgtgacttcagtggcggcttcataggcaggacgagctgtgacctgtaagttatgacataggcgtagctagcaggtgtacatgtacaatagttcattgtgctgttttgtatgtatattggtatcagctctcaagtgtaatgctaacagggcaagaattgttggacggacttgccctttcatagcggtacagacatcgatagattcatttctatttctaattcaataaactagcactatgccgagtctattttatgcc

SEQ ID NO: 133 - DNA, 820 bp, Sorghum bicolor
aggctccctagtcgtcgtctaatcaacaatcccgcaatccccattgcactccgtctccgctagggtttttctccgcagccgcaccacgccgccggagcagcgcgagacccgaggcgagccacgcgcgcgcgagagagatgaggctcctgacgcacaacatgctggcgtcgaacgtccggggcgcaaccaccggctacccgctgacgctggaggcgaccaagtggtgcaccaaggaggtggagctcaacgccgacttcatccgcggcctcctccccaagatcgactggcgcgcgctcgtcgacgccacccgcgcgctcggcctccccgagctcctccccgaggagcagccccccgaggaggagatcttcgccgagggcgccgccgacgtcgagggcagcgccatccgccgcatccaccacgcgctcctcgaggtccacgtccaggagggttccctcgtctgccccgacaccagccgatgcttccccatcaacaagggcatccccaacatgatgctccacgaggacgaggtctgatctgtgtgtgtcagtttcgccctggccgcttttgcttgctcacctgctcgtcatggtctgtcgcgaagggtatccacggcttgtgaacttcgtactcagtcagattgtatctgtgaagtatggaatgcagtcttgcagattgtggccttataatatgatagatagccgtgtagtactcggaattcccgttttgtgttggtaatttggtgcacgtcatgctttgttctttactgtgggcaaattgtttgctgccctgtgactgaggaaatcgaaagatgtagttattt

SEQ ID NO: 134 - DNA, 1341 bp, Sorghum bicolor
actgcagccagccactctcatttccccttccataccctgcaggcagaagaaactttcagccatggccaccaccgcgtccagcctcctcaagtcctccttcgcgggcgccaggctcccggcgtccacgcgcacgccgtcgtcgcccgccgtcgtggccaccccgcgcggcgccggggcgatccgcgcgtcgtccatctcctcctcgaacccgccctacgacctgacgtccttccggttcagccccatcaaggagtcggtcgtctcccgcgagatgacccggcggtacatgacggacatgatcacctacgccgacacggacgtggtcatcgtgggcgccggctccgcggggctctcctgcgcgtacgagctctccaaggacccgtccgtgagcatcgccatcgtggagcagtcggtgtcaccgggcggcggcgcgtggctgggcgggcagctgttctcggccatggtggtgcgcaagccggcgcacctgttccttgacgagctgggcgtcgcctacgacgaggccgaggactacgtggtcatcaagcacgccgcgctcttcacgtccaccgtcatgagccgcctcctggcgcgccccaacgtgaagctgttcaacgccgtcgccgtggaggacctgatcgtcaagggagggcgcgtcggcggcgtcgtcaccaactgggcgctcgtgtccatgaaccacgacacgcagtcgtgcatggacccaaacgtgatggaggccaaggtggtggtcagctcctgcggccacgacgggccgttcggggccaccggcgtcaagaggctgcaggacatcggcatgatcagcgacgtgcccgggatgaaggcactcgacatgaacaccgccgaggacgagatcgtgcgcctcacgcgcgaggtcgtgccaggcatgatcgtcaccggcatggaggtcgccgagattgacggcgccccgaggatgggcccgacgttcggcgccatgatgatctccgggcagaaggcggcgcacctggcgctgaaggcgctggggaggcccaacgccgtggacgggaccatcaaggtggtgtcgccggcgttgcgtcaggagttcgtgattgcgtccaaggacgatgaggtcgtggacgcgtgagcgcggggaggagcttagcgcgcgctctggcttcgttttttggactttgccttgttgatgactttgtccgaatgaattccctttcagttagcgtacatctcgctagcgtcgtgttaataccccagcacatcatgccacccgcatgttaatagcgtcgtgttatttgttggaataataaaaccttgttgcctagcatgcaagtgcatctcaattaattcccc

SEQ ID NO: 135 - DNA, 2036 bp, Sorghum bicolor
agcttggcgctgtgggggtctggactctggacggtggatgcttgggctcgtcggcaaccggacaggaggaggacagcaaggcgaaagcaaccggggcgtcgcaggtccgacgggcggcacgtgtcggcgagcgtgacagcggcggcagatccgggcctccacgtccgtatccatatccatccagcaaacacggaagagagagagagaggcgttgttattttggaccagttccaccgcttaatttgcaggaccgccaccaccgcccgcggcgccgacgatcacctccggcgtgcgcggatatggggcgccgcggctcctccgaccgcctcgaggcgctctccctcgagatcgagcgcaagctccagaaggctctggtctccaactcccagcgtcttcagatacttcagcaattgtttgctgacattgcattgaaggtcgatgatcgtgctcgagatgcgattatgagtgagaatgatgatggcattgctccagtagatgaacgggaagatggttggctatgcttctatgagattctttccagtcattttgttagagtgcctgaaagtggcaggcgtatactcgagttgatagtgcaactctggagccagtccttcgcgtccaacatatttgcacttctttttcacaaatggttgtttgaagcccctcttgatgaaaaggaaatatcgctacgatatagctctgctcttgttcaaggtgctacaaatgtattttggattgacatacagacaaatacaagacattttctctctttgtatcattacctccttgaggatgttgctctagtccctgaccgacttactaaaatatcattacaggctggtagagaccttttccttctactctctagattcatgttcttctatgatcaagatcacttgctttctagtttcctagagcatttccccacttttccaaattccttcttggttggtggaccagcagattactttgtaattgaactcactgatcagcttcaaaagctaaaaattgagccagtactactgcactacctctcccgcatgagcatacttcaagggttggaactgagattgagtacaagcaccagattaaaggcctgcctgtacagcttcacttctcctggtggccctacttacccaacacgagcggtgcggcatgcagcctggaatacattggatttgctgttccctatcggtcggtacccaaggcatgtgatcagcctgttcttccggctgctgtatccgtggtactggccttcctcttgctggaacttcgtgatgacctgtgccatgactgtctactactacatcctaaacctgctggtgtcaagttgggagaaactgaggcggcccagtcaccagagaaggcatggtgaatgaagacgtggcagcccaacaagtagcaccttgtgttgttgttgttgttgttgttgttgttcattttctttcgtttgcgcaagcagtgttgtagtaagttggccagcttatgcgtttgtccaaacagcatctcctgtataaactgctgtgtttgttcagttgttgatataggaagaggaacggatggtaaatgaagagagagcatgtgcgtttctggagtcgtttcttatcaggatctgcagtgtcctgcacccattcatctccaaaatctttggacggactatggacagactccagaaggattgcctagtggtactacttgctttgcgtagatggaagttgagttgcctcctgctgctttttgtttactgggttgctggataccagtcacactaatggctaattggtccaggcctttgatttatatttgttttggactgcgttgagcataacctgaatgactgtaaagatctggaggtacaaatcttctgtcatccgtttggaggacatggtctctgttgggattaagttgcttgctgccagtttttgtacctgctaccaagggaaagggtagtgatttattatattatatctctctctgatgtatattgcttggtattttgtactgttacattccctggttaatgggccacaagccca

SEQ ID NO: 136 - DNA, 1612 bp, Sorghum bicolor
tgcaactgcaaagcaaggggaaacaaaaatctccccacctgctgaaaattcttcagtcgtccctctgtctcggtctctccggttctcccctcgaaatcgaaagggaaggcgaaccgcgacgcgaacccaggatcccgtcgagggcaggcgggaggatcccggcgtgcggcggcgatgggcgaggcggacgcgagcgccggcgggagcggggccggcggagatccgcagcggctgaagcggatcgccgctgcggcgtacgactacgagaacgatgcgcggtgggccgggtactggtccaacgtcctcgtgccgccccacctcgcctcccgccccgacgtcgtcgaccacttcaagcgcaagttctaccagcgatacatcgatcctggtttggttgttgagccaatgtcctccatgacttcaactcagtctagcagaccagcagcaaggtcttcagctacaccgtctggcgagaatgtcagatctcgtgactcagcctctagcacgagatcaactggggcttcccaacagccatcagcagagaggactgcaaattctttacggctagacggacggacaatacatttttctatcaatgcctgggtactggttgtagctagtgttggaatactcccagttctgcccaaccatatctcaagtaaagcatacagactttcattgctaggaacaatatgctcgtctgcatattctttatatagcacttatgggaaaccaagagcatggaatatgcctgcaattcagtcctggctgcaatctattattgtagccaaggactttgttcacttgatgttctctcttatgatgttcacatctaacgtgcactttaagattgctctacttcctgttctttgctgggcacttgatcatgttgctcgattcctaaggcgtaattttacgcattcttctttatacaggaagtacttagaggacccttgcctatgggtagagacaaacaacactacactcagcctactttgttcgaatgctgaaatcaccctggggtttctcatgatcatctcacttttctcgtcaagacgcaatataattcagacatttatgtactttcatctgttgaagttgatgtaccattctcctgtgacatctggttaccaccagagcgtgtgggcaagaataggccgggctgtaaacccgtacatttaccgctacgcgccattcctcaacacacctattttggcagttcagagatggtggctgaggtaggaaagcatggatcccaggtatcatcatcactacagtgagaatttgcctacacagctacagtgagctccgcccctcaattttttttagaagacgtgcttccatagtgttctgttcttgtacacggttgtatttttagttcatgtctgaccgagctactgaaggcataacaccgaatcttttcttacgataagcagtagctcttgagcgaattgtctgacgatttgatgggatacagtttcagacattcagtggtagcacatataattcataaggatgcttgctgcagtcaataggatggtgaacaatgaaatgcagagtggaaccattgattcttgaagtaataaattgttgcccttgtctctttttattttgc

SEQ ID NO: 137 - DNA, 1353 bp, Sorghum bicolor
cacacaaggcgagctctatagccaggagcccaggacgccggaccgggaccgccgccgcgaaccgccgtccgactcgctccgcacctccggtcctccaaaccggcgctcctaccctcgctgcaatggagtcgaggaagccggcgccctctcctctcgtcgacaactacgtggtacccggtgacgtcgtcctggacctctccgagatgaacaaccagaccattaagctcggcgcaggcctgcgtcaggagtgtgacaccatccaggctaccagtgctgggaagctgcggctgttgaaacccaacaagtattggattgagaactcccagaagaggtatataccttctgtagaagatacagttcttggtattgtggttgacaccaaaccagataactttttggtagacataaagggtcctaatttggcctttctaccggtgcttgcatttgaaggtggcacaaggagaaacataccaaagtttgagattggtacgttaatatatgctcgagtggtgaaagcaaatagtatcatgaatcccgagctctcatgcatggatgcttctgggaaagctgctgaatttggtcagctgaaagatggttatatgtttgacacatcaactggcatgtcacgaatgttgttaagttcgccaacatgtccagttctggaggcccttgggaaaaaactgtcatttgagattgctgttggactcaatggtcgagtctgggtgaatgctcctgcagcaagtactgtcattcttgtatcaaatgcaattatgaggtcagaatctttgagtggcataaaacaaagagctatggtagaaaatctcttggagagattgtcatgatggcaatgtgtgcttatgccatcaatgtattatggagaattgctttttagatgccacagccgattctgggaacaggaaaaatggtaatccctatcattccaacagggcatgctaaatggatcaaggatgttgcacataaattagatatgacaaaaagaggcttgtgttcttcgatgttgtagactgaaatgatatattggctagttttgtaatgaaatttctgcaaatggtccattgtttgttgcctatgtgatgaaggctttgtaagtcagatatcggcacaaggttccttgccgatcttgttgaaaaaaagcctcatgatgactcagtttcaacatttttcatattcgttgcattcagaaatccacctttttggtgatcccagctgttgactttaggtacaactttttgggggactggatatgattttttggccgtgtccccaagaaaactgaactcatgctgtggcttattttgtgacaagttgagctggtgtagaaatggtttgagc

SEQ ID NO: 138 - DNA, 2229 bp, Sorghum bicolor
ccctgggaaaacgcccaactcgtggctctcgtcccactcccactcccacgcttccgcgagcggagaaagagccggagacagaagcgaggagagagagagaaagacaagcggtgggcttgcggtggcgtagctcgcgatccgggcgccgagctggtcccgtacttttacctgggttggtcgcgcggcgcggtcgggaggctaggctagggctcggcgtcggcggtcggtcgcgatggggaagggcgcggtcgtggggacggctgtggtggtgggcgccgcggctgccgcggcggtgggggtggcggtggtgtcgctgtcgcgcaggaggcgtcggcggcgggaggcggaggacgagaggaagaggaaggcggccgcggtgatcgaggaggtggagcagcggttctcgacgcccaccgcgctgctccgcggcatcgcggacgccatggtggaggagatggagcgcggcctccgcgccgagccccacgcgccgctcaagatgctcatcagctacgtcgacaacctcccaaccggtgatgaacaaggactgttttatgcactggaccttggcgggaccaactttcgtgtcatacgggttcaacttggaggaagggataaacgtgtcgtgaagcaacaatatgaagaggtctccattccgcctcatcttatggttggaacttctacggaactgtttgatttcattgctgctgagctggaaaaattcgtgcggactgaaggagaagatttccacctaccaaatggcaagcagagagaactgggtttcactttttctttcccagtgcaccaaacatctatatcatcagggactctaattaagtggaccaaaggcttttccatcaatggcacggttggagaagatgttgtggctgaattgagtagagccatggaaaggcagggtcttgatatgaaagttgcagctctggttaatgataccgtaggcacattggctggtgggagatatgctgataatgatgttgttactgctgtaatattgggcactggcacaaatgcagcttatgtggaacatgcaaatgcgattcctaaatggaccggactactgcctagatcagggaatatggtaatcaacatggaatggggaaacttcaggtcagataaacttccaatgtcagagtatgataaatccttggactttgaaagtttgaaccctggtgagcagatatatgaaaagatgatttctggaatgtatcttggagaaattgtgcggaggatcctgctgaaactggctcatgatgcttcattgtttggggatgttgttcctccgaaattggaacagctatttatactgaggacgccagatatgtcagccatgcatcatgacacctcacatgatctcaagcacctgggagctaagctgaaggatattctgggggttcctgatacttctctcgaagcaagatacattactcttcatgtgtgcgacctcgtcgcagagagaggtgcacgcttggctgctgctggtatatatggtattctgaagaagcttggcaaagacaaattgcttagtgacttcagtcaacaaaggactgtagttgctattgatggtggcttatacgagcattacaagaagttcagtgcctgcctagaagcgacgcttacagacctgctcggcgaggaggttgcctcatcggttgttgtcaagttggccaacgacggctcaggaatcggagctgcacttcttgcagcctcacactcccagtatgctgaagttgcatagttctaggagctcggctcctagtgtaacctttttcgttttgctcccttttccccttcaatcgcgagccaccctcgtgcgaatgtgcgattcgcatctctctcttttttgcctcagccgcggggtatagctaggatggtgccattgagcttggagtacattatcactagcattagcaacggcagaaaaaaaagtggaagcggaggtctgaataagccattccactcctgccaattcttttttttccccaatcccttgaagtttgtattatgatgcgatatcacaaaacaaccagttcttatctgtgtgatcttgtcttccagaataaagagagaggtggggggctcattttttattgaatgtgcagagctcctgcctttatctcagaaacaactacaatataatttgcttgttcttatgtttgattggtctaatgtatgtgtgatttaataggaatacattatgacaagttatgatgc

SEQ ID NO: 139 - DNA, 1855 bp, Sorghum bicolor
ggaaaagggaatcgccatcagcgtgtgaccccataaaaagcagggcgtgggcaggggacgggcagagcagagcgcgggctgcctccagctccaacccaccaccagacgagccgtctagccgagaggaggacgcggcaccgctcggtagcagccagggttgtcgcgctgagcacttgagcgcagtggccgcttgtctgttgtctccccgctgccactctcccacttccccgtctcgcgcccccccctcgcccgtccggctgtcccggcgtcccctgcagcttgtgctctgggtcggagggagctgagctgcgagggagcgcggaggggagggtttaggagatggagccagattcggcgaggaagaggctcgcattgctggctctgcttctcctcctggcggcgcccgcccggccggcctcggcggctccggtggaggatggcctgctcagcaatggcgactttgagacagcaccagccggtggttttgtaaaatctgcgtctgttgctgagggtgcatcgtcaatccctggttggacgatcaatggcacggttgagctcatttcagcaggccagcaccagggtggcatgatcctgattgttccacagggggaccatgctgtaaggctagggaatgatgctagtgttggtcaggtggtggacgttgagaagggctcggaatatgctatcacattcagcgctgcccggacatgtgcgcaactggagtcactgaatgtttctgtgctaggtggcatatcccagacagtagacttgcagacattgtacaacatagaaggctgggacgcgtatgcactggcttttcaggcgacggaagagcaggcacatcttcaattcatgaaccctggcatggaggatgatccaacttgtggtcctatcctagacaacgttgccgtcaagaagctcttcactccggacaaaccgaaggataacgtggtgctgaatggagactttgaggagggtccatggatgttcccgaacacgagctttggcgtgctgctcccaactaaccttgacgagcagacatctgccatacctggttggatgatcgagtcaaaccgcgctgtccgctacattgactctgatgagtacaaggttccccaggggaagcgtgccattgagcttctgtcaggcaaggagggtatcatctcccagatggttgagacgacccctcagaaggtttacagcctgacgttcacactgggcacggcaggggactcgtgccaaccaccaatggccatcatggcgttcgccggggatcaggcccagaacttccactactccccaataggcaacgccaccagccaggctgcgaatgtgacgttcactgcacgtgctgagagaacacgtgtggcattctacagcgtgtactacaacacgaggagtgacgaccacagctctctgtgtgggccggtgatcgacgatgtccgggtatggggcttgaacgcagcggctgggttgaaggcaagtattggactcgttcttggcattgttggtctcgctggcatggtgctcttctgaaatctgaatgcctcagtgcctgtggtcttgggaagtatggatgtataactattctgttagttggaggtggctgctagttttggtagtaagcttgaagtttgctgagtggtatgagcttaggctaaaaagctaccagaacctacatgttattgcttgtgttacttcatttgtgatttccgaagtaacttgcaattatatgggattgtatggtttgtttgccctagctatatgagatgtcagaattgttctaagttcatctcttcaatatattagaaaagagtaaagtacaacagcaattgttcttatctcgtagcccctc

SEQ ID NO: 140 - DNA, 1230 bp, Sorghum bicolor
aacccgcgcctatcgactccgcgcctcgctctcgctttcgcctccctcccccgcctagcgtgcgtcgaccatggccgccgcggcgcacgaggtctccgccgtgatctttgatctcgacggcaccctccttgacacagagagggcgacaagggacgtcctcaacgaattcctggcggcgtacgggaaggtccctgatgcgcagaaagaggagaagaggctgggccagatgtatctggagtccaccactggaatcatcagagattacgggctgccgctcacggtcgaggagtactccaaggcgatgcatccgctctacctgagaaggtggcaaaaggcgaaaccgcttccaggagtgaagaggcttgtcaagcatcttcacaagaacggagtgccactcgcaattgcttctaactccgttaggagaaatattgatcacaaacttccgaaactagaagattggggagagtgtttttctgttattcttggtggagatcaagtccctaatgggaaaccttcccctgacatatttttggaggctgcaaagaggcttggtgtaaatccatcgtcgtgcttggtcatagaagattctgttgttggcgtcaagggtgccaaggcttctggggcaaaggcggttgcagtaccatcacttcaaagtcagaggaaacactattatattgctgatgtcatcatctattcacttttggactttgatcctgagctatgggctcttcctccatttgaagatcgcattcaaggtgtactgccgattgatcccttactttcaaatgccaggataggtgataaaattgtaaacaatcttcattgggtaatttcagatgactgtacctacgagtgtattcctgaccaaatatcaggaatttatttgggttgggccgagtccaaagtgcatggactctccaaggttatcataggtactgggtgggacttctcacagcagactgtcgaaagagtgatgcaagtagattttcttgattcctctggcaggattgaaacagagcctgtgaagctgcttgtaattggctacatccggaagctccaaagtgcggatgatatattgcaagctttaagtataaccgacgaagacaggagcattgcaagggaagcattggacctcccaactttctctgaatatgctaatgaccttcatcttgcctaagtcgggccttatcattgcaatctctcacctcactgcctcacgtttgtatttgt

SEQ ID NO: 141 - DNA, 1223 bp, Sorghum bicolor
gtgcctttggttcgctagcgtagcgacaccggtgattccgtgcgccggcaggcgggcaggccaggccaccaacgccggcgcaacgaaatggcggcagccggggacgccggcggcctcctcgtctgcgtgacgggcgccagcggcttcattggctcctggctcgtccgctgcctccttgaccgcggctacaccgtccacgccaccgtcaagaacctccaagatgagggcgagacgaagcacttgcaggccatgggcggcgccgacgcgcgtctccggctgttccagatggacctcgtcgaccctgcttccgttcagccagcgatcgaaggcgcccacggcgtcttccacctggcgtcgcctatgatactgcaggcagaagatccggagaaggagctgctggaacctgcggtgaagggcacgctcaacgtgctgcgagcagcgaaagattgtggagtcggccgcgttgtgctcatgtcgtcacaggcggccatggtgcccaatcccaactggcctccgggtaaggtcatagatgatgactgttgggcagacgttgagctgctcaagaagcttcagctctggtacagcgtttctaaaacactggcagagaaggctgcatgggattttgccgaaaaggaggagttgcagatagctgtgctcaatccagggatggtattgggcccaatgttaacaccatcagtgaacgccagcctgcgtctcttgctgcaaattctgggaggcgagaggattgacttggacgacatctacatgggttgtgttgatgtgagagacgtcgcgcactctctgataatgttgtacgagaacccatcagcacaaggacgccacttatgcatggaatccgctgaacgcctggttgatttggccaataagattgctgatctttaccctgaacacccagttcagagaatccgggaggacaagcaagggtgggtggtgagagcaaaggacccttccaagaaattgatcaaattgggtgttcgtttcactccactggacaaaaccatcagggacaccgtggattgttttaggagcaaaggactcatctagcttgtgagtgtgcttcaagaaaaacttttgtaaactatgtggtcaaataaatcacccgaaatgtggcaaagtaatatctgcctttaaaggcatatagaatatgccaggtggatatcatcattagatgtacatgttgcctaaatgcatatgctctttct

SEQ ID NO: 142 - DNA, 1596 bp, Sorghum bicolor
ggtctggccaccccctagtctagagcgcgcaagcagaagcaagcagctgcgacgtctccctcccttccccgcaccgggcccgtgtccacagatattttactcggaaatcaaatcccccaccccgcagctttcttccccttccgtcgcgcgcgactcgttcgcctgtccacgccgccggacgagaggagatgtgcgaggcaccgcgactcggctaccgcgccgccggcgccggcgacgcggacgccgctgacgtcgacgtcgtcaccaccggcggacgccggaggatccccgcgcattcctctgttctggcctcggcgtcgccggtgctcgggagcatcctggagcggcgcctccagaaggacagggagagcggcaagcccggcaggtccgtcgtccggatccgcggcgtcaccgacgacgccgcggccgccttcgtccgcctcctctacgccggcaggtgcggcgacggcggcgaggaggaggaggaggatgacgccatggagaagcacgcggtgcaggtgctggtgctggcgcacgcgtaccaggtgccgtggctgaagcgtgcgtgcgagggcgccatcggcgcgcgcctcaccgcggactcggtggtggacgtgctgcagctggccgacctctgcgacgcgccgcgcctgcacctccgctgcaccaggctgctggccaaggagttcgccgccgtcgagcgcaccgaggcctggcgcttcctgcaggagaacgacccctggcaggagctccacgtcctgcagcgcctgcacgaggccgacatgcggcggcgcaagtggcggcggaagcgcgcggagcagcgcgtgtacgtggagctgagcgaggccatggactgccttgaccacatctgcacggagggctgcacggaggtcggcccggcgaggcgggcgccggcgccggcgccgtgcgcgcgctacgccacgtgccggggcctgcagctgctcatccgccacttctcccagtgccaccgcaagagctgcgcgcggtgccagcgcatgtggcagctgctccgcctccactccgcgctctgcgaccgccccgaccgctgcaacaccccgctctgcatgaggtttaagcagaaggagcaggagaaggtggctgccaaggccggcgatgacgacgacaaatgggggcttctggtgaagaaggtgaaggctgccagggtcttctcttctctagccaacaggaagcagacgagcacctccacccagtgctgagcaaacacaggagcagcctgggatggttagaggtaggtagattagtgagtatgagtgagaggttggagtgagcagtttttttgggtccgttttcagatgtcagatctatgttgagctatgtacatgcctactttgtcaccctgtgatgtactcctacgttggtagaatagaattcttttagtgaggtcgccaggtcggagtcagtgagccgaaagtcaatgtaaaaactgcatgtaccatatatatagtagggaaatatgaggtaaataaatagtcttgtgataatattatatatctttcagaattctggcaccctgacaaactgatcgatccaaaatgacttgaacgcggaatgaac

SEQ ID NO: 143 - DNA, 1487 bp, Sorghum bicolor
accccgcccgcaacccaccctctcaccgcggcatttcctcgaacgccccgcgcgtgccgcgcccctcgccgcccatgggctccctcccggtgccagcctcggcggaatgcgccccgcaggggcgcgccacggtgtcggcgtcggacctggcgccgctcttctccgcgcagcgccggcacctggaccacttcttcgacagcctcgacatgtcgcaggcggcggcgttcgcgcaggcgctgatcgacgcgccgggcgccgtcttcttcacgggcgtcggcaagtcgggcatcgtggcgtgcaagatcgcgcagacgctggcgtcgctgggcttcgcgagggcggggttcctggcccccgtcgacgcgctccacggcgacatcggcgcgctcttccccggggacgtcctcgtgctcatctccaagtccggagcctccgacgagctgctcgcgctcgcgccctgcgcgcgcgccaagggcgcctacctcatctcgctcacctccgcggcctcgggggctgaatgcccgctcgccgcggcctgcgacctcaacgtccacctgccgctgcagggagaggtgtgccccttcggcctcgcgcccgtcacctccaccgccatccagatggtgtttggggacaccgtcatcgccgccatcatggaggcaaggcgactctccagggaccagtacgcctccaaccatcccgctggcaagatcggcaagaccctcatcttcaaggttaaggatgttatgaagaaacagaatgaacttcctctgtgcaaggagggagatatgataatggagcaactcactgagctcaccagtaaaggttgtggttgtttgcttgtggttgatgaagagcatcatttgattgggaccttcactgatggtgatctccggcggacattgaaggcaagcgggccagctatcttcagtctcacagttggagagatgtgcaacaggaatccaagaacaataactgcggaggcaatggcagttgaagccatggagaagatggagtcacctccttcacctgtacagttcttgcctgttatcaacgataacaacatcgtgtgtgggatcatcacattgcatggattggtctctgccggattgtagacttttgtgcatcatcgacttctgctggattgtaagcttatgtgccagcttaccgggttctaaacttctagttgcagttgcagatatccttgctgcccaggaggcattttattgctagagtatttatgtgaagcctagactctttagtgtacccttatgtatagtggtggataagaggaatatggtacactgctgttttgcagttggctgttaaataatgcttgtgttttgtacataacttatttaaaatgtcgattatcttggtttctcttaacgcatctgtgtgtgttgcagactgagctcacgcactttgtttggcttaaacatgttcaaatataacgtccatcttttctagatgacagattgtgtcgtgct

SEQ ID NO: 144 - DNA, 1769 bp, Sorghum bicolor
aaaccgcccggattaaaccctagcagcgattcctctccagtctcgtctccagcagtccagctcgatcgcgatcggcgaccagcagtaatccatggccgcccccactgccgcgccgctcgacgagggcaaggcgaagaaagtccttcgccaggtggagttctacttcagcgacagcaacctcccccgcgacaagttcctgcgggagacggtcgagcagagcgacgacggattggtgagcttgcccttgatatgctccttctcgcggatgaagtcccacctggggctggatgcagatgtgaaggccgagactctcccagaggagaccgtgcttgcggttgctgaggtgctccgccgttctccggtcctccgtgtatcggaggatggaaagaagattggtagagctagtgaactcttgaagccagatgagatcatagaacaagtagactctaggaccattgctgtatctccacttccttacaatgtaaagctggaagacgtccaatcttttttcacaaattatgcaaaggtaaacagcgtgagacttccacgcaatattgtcaacaaaaaacacttctgcgggacagctttggttgagttttctgaagaagaggaagcaaaaagtattatggacagttctttagtatttgcaggggcaaatctggaaataaggccaaagaaggagtttgatgccgaacaggagtccaaaaaagaagcatatgaaaaggaacgccctagaaaggacaaccaggatgaaggctatccaaaaggtctaattgtggccttcaaattgaagaagaccacggttgattctgtggtgcagcaagataacatagatgaacggaatgactctgccacgaaattagaagattccagttccatggaaaaactctctggccaggtgccagagtccacccttgagagcgatggtactaagcaagggaagtcctcagatgaaattaccaaagagaaagaactaaacactgcagaagctacagaatctgagaagtgtattggtgatgccccggtagaaagtgagaaacatggtgatagtgaatcattgagcagggatggcaaaagcatttctggcaatgtgaatgcgaagaaccaaatatcaagggaggatctaaaagaagcattcaaaaaatttggaactgttcggtatgtggacttcagcatcggggatgattcaggataccttcgctttgaagattctaaggcagctgaaaaggcccgcatgtctgctgtacttgctgatgaaggtggcttcataattaaagaccacattgttactttggagcccgtgactggtgaagctgagaaggattattggaacagaattcgcggtattcaaggaaagtacaaggatagtagaagctacaagggaagggctttaaagaaccagagaggaggaaagcatttcaatgggaagcgagatagaaaccccgattcggagaagaattctaacaaggcccagaaggttgaagctgctgcgtgaagttaacttaggtaccttagctcgacttgagaagtaacatgttatgccagcatgatcgacttcactagtctctaagtttggctatcatttttattttggtcgttttgccaccttactcgatgtttatctctatgctataatccttttgtaatggctttactgtgttatggggtcacccaatggcgtgtaaattgaacgcaccaagtttaggcttcccttacgaaactgtatagcctttctattcttccactagcaaatttgcccacttgtctcg

SEQ ID NO: 145 - DNA, 1539 bp, Sorghum bicolor
ctccatttttgctggctccaccaacaaaaacccgacgctcccacccttcccttttcctccccaaacccgcgctcccatcctccgtggcgtgcaccgcgctccccagctcccgcgggcggcgacctgggagaggccgggcggcgtctcacggcgaggcatttgaggccagggttttttttggtgctgttaatatagctgattggtgagggtctggacctagcaatggcggaaaatactcatggtagtggccgatgcgcgcttggggacttgacgaatgtcctttgcaagcgaccagccacatcagatctggagaagagtacaggtgggataaagatcagacggattgaaaaggacactgggactgggaaagggtttgatgaaaatgcaaaaaccagcagtagagggaagggaattgtatttgggcatttgtttgatggtgttgccaaagagaatttcgaaaggccttctatctttcagaacactagggttcaacacatggctgccgaagcagctgggctgttatccaaggaggccagtgacttgaagaaccattatgcatcaattgattcatttgatctcagtgataaggagcaggattcttcgctggaatctgaaggtgactacgatgatgaagataatgatgagatgaatggtgaactgccacaccatttttgcacctcagagctagctaataaaacatcaacaaatgacgacgagtgcttgactcaggaggagatagttggttcatcaggaaatcagaagcctctgtcttcattggatgctatggcaggtggtgacatgccaagttctagtattcagcacgcttctatgagaactgggggtttggaagaagctgtcgccacaaaatcttgtgcttgttctttctgtcttaaggctgcttttatgtggatggatctccattatcaggatgcaagaagccggctttctgtattgaagaaaaacatcaagtttgccaggttgttggaggaaagaagtagaggaagtgaatatgctgccaatgtagccggatataactcaaagcgagctgtgggaatggagttcgaactatctcaacaacagagatcactctttctttatacagaaaatgcccttgtccgcgagtcaacacagcttcattctacttttgtgaagttgaaagaattgagagagaactgcaagacaaatcttgagacgatcagcaagtcttcaatgagaaaatgagtgctgcatgttgcgctgctgaactgttagttttcctgagacttagtatgatcagctggcttggtttgaagcaagatgtgcattgagatttttcctcaacttaggaattatgatgcttaccatcagtttggcactttggctgtagtgattactcctatcataaagcattgttctagtatgtttttttttttggataaggattctagtatgtttgtaggtgatgtaaaaataaccatggtaaggtaggaactgtaagacatcggcatcttgacttgtactttgcagtgagcttctttcatatgaaaattctttcctctc

SEQ ID NO: 146 - DNA, 4369 bp, Sorghum bicolor
cagccgccgcagctcacgcgacgccctagttttcgaaatcctccgagcgggcgcttctcgctctcacccgttcgccatttcgctcgtctctctctctcctcgaggggcgatcgatccccaactcgccgcatcccgaacccgcaatccacgcgcagcttgccgttgtatgttgcagggcgtcgccaatccggtccgatccgccggtttgagggttccgatggagacctcggaggcggcggccgcgcatccgcagaaggatagcgtgaaggtggccgtcaacataaggccgctcatcacggctgagctgcaggagggctgcacggattgcgtcaccgtcacgcccggcgaaccgcaggttcaaattgggccccatgtcttcacctttgaccacgtctatggcagctcgggtccttcatcatcattaatatttgagcaatgcgtgcacccgttgattgatgcattgttcagcggatacaacgccactgtcctagcatatggccagactggttctggcaagacatacacaatgggtactgactacagttgtgaaggcaactctggagggataattcctcaagttatggatacaatatttagaaaagttgatacctcaaaggatggctccgagtttttaattagagtgtcttttattgagatattcaaggaagatgtttttgatttgcttgatgcaaatcaagctgctgcaagacctgatgcaggttctatggcaaaagcatcagcacctggcagagtgccgattcaaattcgagagactgcaactggaggcataacccttgctggtgtcacagaggctgaggtgaagtcaaaagaagaaatggcatcatatttgacacgtgggtcctcgtcacgtgcaacagcaagcacaaacatgaataggcagtcgagtcgctctcatgccatctttacaatatgcgtcgaacaaaagagaatatctggtacatctgacaagtcagccagcagtgattatgacataatatcatcgaagtttcaccttgttgatcttgctggttctgaaagggctaaacgtactggagcagatggacttaggcttaaagaagggatacacataaataaaggccttctagctcttggcaatgttataagtgcactaggcgatgaaaagaaaaggaaagaaggagcatttgtaccataccgggatagcaaattaacccgtcttttacaggattctctaggaggaaatagcaaaactgtcatgattgcatgcattagccctgctgatataaatgcagaagaaaccataaatacactcaaatatgccaatcgcgcacggaacattcaaaacaaagcagtggtaaaccgtgatccagctacagcagagatgcaaaaattgaggagccagctggagcagctgcaaactgagcttttgttttcccgcagtgggagtgcagcgttagaagaacttcagttgctgcagaaaaaggtctctcttcttgagctaaagaattctgagcttaacaatgaactcaaggaaagggaattgtcatgtgagcagttggcagagcgggcacgggctgctcagttggaaagggatcagttgatgctgaagattgaatccgcgaggaatggaaaatcatgggatgatattgaaaatgctgataatgaccaagacatggacctcttgaagggctacatatcgaaagtacagcagttggagagtgaactgatgcggcaaaacttctccaatgcttgcagacatggcttaaatgatcaacttgccatggagcgggacattttactaaatgaattgggttctggatgtgaagtaggaacacctgatgcttcaagtgaagttgatgaagaagaaaaggagagagaacattcatccatgcaagaccaacttgacaaagagctgcaggaactagataaacgtcttcagcaaaaggaggaagagatgaaacaatttgccaagagtgatacttctgttctcaagcaacattatgaaaagaagttaaatgagttggagcaagaaaagaaagctcttcagaaagaaatagagaatcttcgccatgctttaaccaatatatcttcttctacggatgacaatgctcaaaaactgaaagaaaactatcttcagaagctgaatgcacttgaatcccaggtccatgagctcaagaaaaagcaggaagctcaacaacagcttctaaggcagaaacagaaaagtgacgaggcagcaaaacgtttacaagaagatattcatcgtataaaatctcagaaggttcaacttcaacaaaagatcaagcaagaatctgaacaatttaggtcttggaaggctgcccgtgaaaaggaagtacttcagctcaagaaggaagggagacgaaatgaatatgagatgcacaagctcttggccttaaatcagaggcagaaaatggtcctacagaggaaaactgaggaagcagcagctgctacaaaaagattgaaggagttactggaagcaaagaagtcatcacgtgaaacatatggaggtgcaaatggttctgggatgcaggccttaatacgagctattgatgatgaactggaagtcactgtaagagcacacgaattacgctcatattacgagcgacaaatgcaggagagagcagcaatatccaaggaaatagcaaagctgaaggaggaatcaaagcacaagatgagtgattgtcctcaagctatgtctcctagtgctagaagttctaggatatcagcattagagaacatgttatcctcatcatctagtgccatggtgtctatggcttctcaactgtcagaagcagaggagcgggagcgtgtattcaatggtaaaggtagatggtaccatgtcaggtccctcccagaggcaaagaacataatgaactaccttttccagtcagcatcatccgcaaggtgtcaagtactggataaagaggtgatttgtaatgaaaaagaacacaccattagtgaattgaaggaaaaggtggttgtgcttaatagtggaatgaggcagttagaaacacaactgatggatctaaggagccaaaatacacagcttttcactgcattgaataatgcaaagaaatctgctaggtcaaatggcactggatttgctcagcgtaagagcgttcgatcttcccagcattttggttgtagtaaggacaacttcatcaattgggtggacgatatggacatttcagatggtgagcactcagacgagttagagagtatgagtgatggatctgattcagactgggtacagtcgaacaggaaagcgaaaaaacatcagagaagagtgtctagcaattcaaatcataagctggattgtcaaaatacacaagacaatgcagaaccagagaagccctcagatgaaaagtgcattctgccaaaaaatcttccatcagacggctgttcatgctcaaaatcctcatcatgcaagaccaacaagtgcgagtgcagaggctcaggtgcacaatgtggtgcaggctgtggttgtaaggactccaaatgttctaacagggattcttcttctactaaagaaaaggccaatcagggagccatgcttcttcagaacgcgttttctgagaaggaagcccaagatgcaaagccaagaaagcctttggctaacattggtaataatgtggttaaccaaactgccgagacagagaagaagcccaggaaaaactggcgcaagtcgacagttcaactcgtcccagggcctctcctgccgtcggagccagagaccaccgaagctgctcctcgggacagagccgatattcctctcaagctaccgagagccatgtcctcagggactcctgcggagagcaaccctccccccctcacggaccgcaatgctgccaagccccaccaatccgtgagcacaggcaacaaggatagcaccggaactgccgccacgaggccaccgtctcagctgagaaaaaacgcagccaccgagaaggagaaccagttgcgataattcaattgctgagtatccgtgtcggggaagtcttttgtcttaacagcggtggaggctgcctcggcgtcctatggagaggcaggtagaccctggaagggctcgcgctctctcgggttcctgagggatgatgactgcgaaggcaatggcgtgttctgttgcaatgttgtgccttgtaccgttgtacgcgccgccttagctctgctttggctggaacgcaaccatcttgtagtgaacaaaacatggtggattaagttatatatcagtctcgttaatggtctccgttccttttgaacatacttaggaaatcaatctgccaatctgtatgcttagacaatagatactgactgctagagatgctattggttaaggcgtcatctgtgcaaccgtatcttatttcaccaattc

SEQ ID NO: 147 - DNA, 1142 bp, Sorghum bicolor
ccaccaccaccaccaccacccatcgccatggccaccaccacgctcttcctcctcctctgcgccgccgcggcactcgcatcagcggcagccgccgccgacgacaccgggttcacgaccttcaagctctacttccacgacatcgtggcggggacgtcgtccccaaccgcggtgcggatcgcgcaggcggcgtcgtccaacacctcctccacctccttcggcgccgtggtggccatcgacgaccctctcaccacggggcccacgcggtcgtccggcaccgagatcggccgcgcccagggcacctacacgttcgcggaccagaccacgttcggcctcctcatggtgatgaacttcgtgttcaccgccggcgaccacaacggcagcacgctctccatcctcggccggaacgaggtgctcaccgacgtccgcgagatgagcatcgtcggcggcagcggaaagttccgcatggccaagggctatgtccaggcgcacaccattgattccggcgccaccaccggggagaccgtcgtccagtacaccgtcaacgtcaagacgccctagctagcttagttggtttcttgctccggccggccgggggcctgctggtgctgccatggcttgttgtattgtgtgcgtctccggcagctttgtacacacctgcttttgccgttcttcggtgttagtacatgacatgacatgtggtagattgagatttcagatcgactcgatcttcatcactattgagcgggatttatttggatttgcagaactgaatttctagtactacgcttaaagaatcgatagaaatgtgtcaagaacatatcagagttcagagcccaattcttggagtagtttcctggaatggaaccagtcaatgcaacacaacagcaaaaggtgagtggagcaagcatgtggctgtttgatgattgcctcgacccatccaacgaacagcaaacatgtgtctggagagactagaaaacgtaggtagaacgccaatggagtaggtgggggcaacgactccaaagtagatcggtcgtgcatgctggtggagctgtcggcgtgtaacaacctaaaatttacttgttttttttttaaatagttgaatttgtttttataatcaattttgtgagcattaaatatagaaa

SEQ ID NO: 148 - DNA, 1997 bp, Sorghum bicolor
actcgctcttcttcctccaaaccccaaaccctcgtcgctttccccacctgcggcggcggcggcggcggcacggccatggccttccggctccaggcacggccaggcttcagggaccgcagcatccagggcctagctcaccgcggaggcagggacccacaggagctggaagcgcttttcggccgcgtgctctcctacatccaccatgcgctccctaccccgcccgtctccgtcgacggtgacctctgcatcctcttcgacgccgacggtgggggtgtcgaccgcctcagccgcctccccgacaagctcctatgcgacatcgtctctcgcctccccatcaaggaagccgcgcgcacggcggtgctctcccgccgttggagccccatctggcgcgccgccccgctcgtcctcgtcgacactcacctcctcccggccggcgacgacgagatccccatcgacctcgaccacgcccactctgacgccgtggccgccgcggtctcccgcatcctggtcgcgcacccgggcccgttccgctgcgtccgcatcacctgctgctacatggaggaggaccgcgcccgggtcgaacgctggctcaagctcctcgcttccaagggcgtccaggagctcttcctcatcaaccgcccgtttccgctcaccatcgacaagcatctccccgccaccttcttcagcatgaccacgctcacccgcctctacctcggcttctggaggttcccggacacgaccaccctgccacggagcgccgccttcccctgcctccgcgagctcggcctctgcggcaccgtcatggacagccacgacatggacttcgtcctcgccaggagccccgtgctggagatcctcaacattgagggccacctgctgccaccgctgcgtctccgcatcatcagccgcagtctccggtgcgtgcagatcaacgggtccagagtggacagcatcacagtggtagacgcccagcgcctcgagcggatcctcctggggtatgggagaaatgaggattcgtgcttcaagatcaagattacacatgccccagctctgcgcatgtttggaaaaattgagctggcaaaggacgagctgcaggtcggcaacaccatcatcaaggctgggacaatggtgaacccaagtgtcatgttgtcagctgtcacgatcctggacctccatgtccgttttggggtccgcaatgattccaagatgctgcccacaatcctcagatgttttcccaacatcgagacgctgcatatccattccaagaaaactactgaatccactggcaggctcagcaacaagttctggaaggagtctggtgccatcaaatgcgtcatgtcgagcattaacatgctgcaagtccatgatttccgaggggagcggagtgagcttgccttcctcaagttctttattgagagtgcacagatgctgaatgtgcttgtggttgtgtatgccaatgggttcttcagttcaaggggtgaggccaattccaaagtgaaggctctgtttgctgggagaaaggccacacaaagctgtaaagtggtggtctgtgagagtaggttttctgaaggtggtagccgttgggacttcgaacaaggctctgatttctcttttgatgatcctttcggaatcatcgggtgtagttcctttggagttagtcagtggtttgtttaagtattcagatgcaggtattgttctgggtcgtttgagtttctttgcctttttccttaagaaccttaagccagtctcttactagcaattcaagaccatgagcctttgtcttgaggttgctagtaatatcatccacgcaaaagactagtgctacatgaataaatgctgctttctggatgtcatccctatcttctacttttgccaagtgtcttgtgatgttgatgagatgcatagatatctcttgttttccttactttgttccatataatatgtgtttaatttcttgcacaaactatatcgcctgaatgcctgattaagtatgcaag

SEQ ID NO: 149 - DNA, 1062 bp, Sorghum bicolor
cttggctgcctcccctctcctcaccgcccggcgcgccaccaccatggacccggaagcggtgcggaaaagcctggagcccaccgcaaccgcagagaaaatcacgggctccacccctgcgcggctccacttctacgaccccttcgtcctcagcggcgtcagcatcgaagccgccgagcacggccgcctcctctgctccttcgtcgtgacacctcgccttgcgagtcccgtggggtacctccgcagcggggtcacagcgacgctcgccgaccagctgggatcggccgtgttcttctgcagcgggctccccagcagcggggtctccatcgagatcagcgtctcctttgtcgacgcggctgcagtcggggaggaaatagaggttgaggggaagttgttgcgtgctggaaagtcagttggtgttgtctctgtcgatttcaggaagaaaaagacaggaaaattgatggcacaggcccgtcatacaaagtatcttgtggcatcaagcaaattgtgaggtgctccccttctgttaacaagatatcaacataattgcacccaaaccctccattactggtgccatcattaataggcagcaatcatacaatgcttgtgatatatctttttttgtcaaaaaaattgctgtatatatactatatatgtatgaaattcaagtatcatcattggtgcctctgatgcatattggtctagtcatgttactttcacttgacagacatgatcggataacatgtttcgacagaggcacttggttgtaacttcgcaggaaataacagttgttgcattggctcggtctgccatcatcttgggagattcaatccgtttataaaaagaattgatcattgctgcatcattctattattggactagaaggtgcatggtatttaatctggtgcacacatcggcctgagatagttggtgaaagtaggcccggctgccaccacgctgtgtttacagtggtacgagctctaggtccttgtgggctatcatatcctgtctattcagctgttagttgaccccaatttgttattgacttgtggtaggatcccaaca

SEQ ID NO: 150 - DNA, 843 bp, Sorghum bicolor
aaccgtgcggtttgccagtatccgttcatcagcgtgagggctgagggagagttgccttttctctctcccgtcatcccgtctcctcttcttcgtgaactctcttttccagatcagaagaagctcggaccggcggcggcgggtgacgcaggatctgttctggtggcgacgtcgaacagcacgcggatggacggcggcggcggcggcgacctgcggagcgccatcaagaagtggaacgtcatctaccctgtctacctcaactccaagaagacggtcgccgagggccgccgcatcgccgccgccaaggcctgcccggaccccacctgcgtcgagatcgccgactgctgttcgcacctcaagatcccccacgccatcgagttggataaggcgtacccaagggatttcttccaggtggggagggtcagggtgcagctcaagaaagatgacggctcccccgtcaatcctgctattaaaacaaagaagcagctgatgatccaaatagcagagctagttcccaagcaccacggaaggacaaagaagcaggaggcagcaaccagttcttcagccggtggcagttcaaagaacacaaaaggcgggaaaaagaaaaagtgatggcagtatcattttgtgttttttttttccttctgttcgtcctcatactaagcgtctgtggaagttgtctttctgaggcctgaaaatcattgtgagttttggtgggattttggtccatttgaaaatttatgtacccatctttcatgttatcttcagattcagaagtccacctaacctgaggcagctgcttgatagaactttgactaatcctgcgtagattcttcatttcacaaa

SEQ ID NO: 151 - DNA, 2027 bp, Sorghum bicolor
agtaaagaaatacagataggaccgggccccacaggtccagtgaaatgcttgcccacgaacagaaacaggcaaacagcaagaaccaccaaggcgactccgatctaaatcaagcgagtcctcccgtttcatcgcctgcgaaaaaggcgagaaatccccaacggaaggagcagcagcgccagtgctactgctagcagcagaagcagcagcgattcgttcctcaatcctcgtacctctcgccgcgctcgcccactcggatcgaaacccctagggtttcgcatcggcctcccgccacttcctatccctccccctcccctccctccgccgcgcgcgcgcggcgagtcaccaaaccctaggacggcaaatccggtgcgatcgcccacggtggaggcctcctcggctgccgagaggagccgctcagggctcgggtcagggttccggtacctcgccggcgccgcctctgggtggtgggaccggtggatggtcatgggagccagcggctccaagcttgagaaggccctcggtgaccagttcccggaaggcgagcgctacttcggcctcgagaacttcggcaacacctgctactgcaacagtgtccttcaggcactctatttttgcattccatttagggagcagttactggaatattatgcaaataacaaaactccaggtgacgctgaagaaaatcttttgacctgtttggccgacctttttatgcagataagccaagcaaagaaaaagactggcgttattgctccaaaacgttttgttcagagagtgaagaaacagaatgagttgtttcgcagctacatgcaccaggatgcacacgagttcttaaatttccttttgaatgaacttgttgatattctggaaaaagagtcaagtgctgccaaggattcaccccaattgtcatctcctgaaaaagctccaaatggcccagttcaacctttagccaatggagttaaaaaagaacctccagttactctggtccataaaaatttccagggcatattgaccaacgaaacaagatgcttaagatgtgaaacagtaactgcaagggatgaaacatttcttgatcttagtgttgacattgaacaaaatagttctatcacaagctgcctgaaaaatttctgttctactgagactttaaatgcagaggataaattcttctgcgacaaatgctgcagtttgcaagaagcacagaagagaatgaagatcaagaaggctccccacatattggtgatccatctaaagcgtttcaagtacattgagcagcttggccggtataagaagctttcataccgggttgtattccccatggaactgaagctcagtaatacatccgacgatgtagacactgagtactccctctttgctgtcgtggtccatgtcggaagtggccccaaccatgggcattatgtaagccttgtcaaaagccacaaccactggttgttcttcgacgacgaaaacgtcgagatggttgaagagcagaccctacaaacattcttcggttcctcacatgaatactcaggaaacacagaccatgggtatatcttattttacgaggggcttggcgggaagagttagatggggtttattcaccttccctgttccttttctcctttttctctttggagcttgcaagttcactcttgtacctacacagctactatttcattacctccatggaatcgaagaggttgtatgaggtgaggacgccagattttgggtggtttcagtgtacaggggataatggaatctagctcccaacgatgaaataaggtgtaatttttaagttcgcctgaccagtttcttctcagggctaacatcttttgttaaagagtgggactttactattggacacactgtacatcaattctagttcataactctgcgcatttaccagttctgatccatgtacgtgctggaatcgtgtggcatgtagcatgtttgatttccattttccagtttaccgtgtcgtggattcatgtaacagtattttctgcgtcaagcctccactgatcctctcc

SEQ ID NO: 152 - DNA, 1739 bp, Sorghum bicolor
cccacaccccccccaaagaaaactgaaatagcgaggaagggacgggctcggcctctctgcccgattccgcctccgacgactccgagatcccgtcaggcatggacgggctcctgtcgaagctccgcagcctggacgcgtaccccaaggtgaacgaggacttctacagccgcaccctctccggcggcgtcatcacgctcgcctcctccgttatcatgctcctcctcttcgtctccgagctccgattatatctccatgcagttactgagacaacactaagggttgatacttcaaggggagaaacacttcgcataaattttgatgtcacctttccagcccttcaatgttctataattagcctggatgcaatggacatcagtggacaggagcacctagatgtgaaacatgatgtattcaagcagcgaattgatgcccatggcaatgttattgcgactaggcaagatgcagttggtgggatgaagatggaagcacctctacaacatcatggtggaaggcttgaacacaatgaaacctattgtggctcatgttatggtgcacaagaatctgatggtcaatgttgtaactcatgtgaagatgttcgtgaagcctataggaaaaaaggttggggtgtatcaaatccagatttgcttgaccagtgcaaaagggagggctttcttcaaagtataaaggatgaagaaggcgaaggatgcaatatttatggcttcattgaagttaataaggttgctgggaatttccattttgctccagggaaaagtttccagcagtcaaatgtgcacgtccatgacttgcttccgttccagaaggacagcttcaatgtcagccataaaataaacagactaagttttggagaatactttcctggtgttgttaatccacttgacggggcaagttgggtacagcattcatcatatggaatgtaccaatacttcatcaaggttgtccctacagtctacactgacataaatgaacacattattctctctaatcagttctctgtaacggaacattttagaagtggtgagagtggtcggatgcaggctcttccgggtgtgttcttcttttatgacctttcaccaatcaaggtcacattcacggaacaacatgtgtcatttttacactttttaactaatgtttgcgctattgttggaggtgtgttcaccgtttctggaatcatagattcatttgtataccatagtcaaagagcaatcaagaagaagatggaaatcggcaaattcaactgatgttgctttcccgattgctgcaattaagtagctccttttgcagctccaagttccagaaatgggtgaatcaatgcacagtggcttttgctctggaactcttggcacactagcatagtttacaaacaattgctcatcagataagtcttggtgagctttccaacttgcttccagcaaagataccagcgagcaagatggccatcgtgtacacttcgatatgttattcacacaagaaaatggaacaattcagaagtgctccatttttgtacgctctagtctaacaagaaaacattgtacttccgtgagctgcagaggtgttcgtgtactgttgtaaatttgtggtaggggggagcctatctgtattatttttctttttcttttttacaattattatgtgtctgtaccagtttttttttctgagacatagcttcgacaggtaaagattgaaaaatatatttaaaaaacaattttcaaagaaagcaa

SEQ ID NO: 153 - DNA, 1194 bp, Sorghum bicolor
ggtttcccccatttcgctccgcataggcgtagcatccgcaatctcccatggcggcgtcgcccgccctcctctcgctgacccccgccgtctccaggcacccccacctcctcttctccccttgccctccgccgcgccacgtccgcctcgccccccctctagccgccgccacaccctccccgggcgggaacggccctggccctggccccggcgtcttcctgtcgccgcgcgcgctctcgcagctcgacgagctcgcggcgttccgctacgagcacgccttcccgcacggcctcctcaccgtgcgcgccctcacgcgtggccccgacgacgacgccgtggccgaggcgctcgtccgcctcctcgcctcctccttctccgagaccgtgcgctgggccccggcgcagcggtacgcgcagctcctcacgttcgtcatccgcaggtacctccacgaccgccgcgggctcgcgccgcacgccgcggtgctcgtggggttctaccgccccgctgacgccggcagcgacgacagcgccgcctcggaggagggcggccgggatgatgagggcggcgaaggggagggtggagatgaaggggagatggcgtgcaccgcggaggtgtcgtttgacgcggtgggcgcgcccggggccccgcccacgcccactccgccgctcgacttcccctacatctgcaacatgactgtgaagacgccactgagaaggagaggaattggaaagcaacttcttaaggcatgcgaggatctggttttcaagatgaatgccagaagacgtgtgtatcttcattgtagaataatcgaccaagtcccattcaacatgtacaggaaagctggatatattattgtccagactgacagtattttggtctggctgagccttcaaaagcggaagtacttgatgagcaaggaattaccccaagcttctgttgttagtgagacttcaaccaaaaactttgatgataatattgacaagctgaatgtgctacgggactaacaggtacacataagaatggtttttgtgtataaatgggttctgtttacctcacatttccactattgtgtaacttgtgatgaaatcaactgccattcataattgttaattggccatcacaagatgttttaactgaaaatgagttggtagtggttttaacccatatggccagtaatcagaaatggattctgcttcc

SEQ ID NO: 154 - DNA, 423 bp, Sorghum bicolor
ataacagtcaggtagtcagtccagagagacgccatgtgcaagctcaagttcagcaaggagcatgtggggtgctacctgctggtgatcctggtgatctgcctcctcgtcggcgtcctcttcggcctcggcatcttcaggcacggctacgacaggatcaaggacctcggccgcaaccacacctgcttcgactgcaacacaacagccaggtaccaactgactaattaactgactgagccacctggggatcttggtctgcgctggccgccgctgcaggcgtgcaacctcctccgtggaggcagcagagtagcagtaaattacttgtaagtttctgttgcttggtgtatagtgtatgtaagtgtagtagacttttttagacagcagtgtttttatctcaaaataaattagtcaacagtaatttcagcc

SEQ ID NO: 155 - DNA, 1363 bp, Sorghum bicolor
acggcctggccagtggccatccatcccttcgcttccacgcaccaatcttgtcccggcgcctgccaaatccagcaaggccacatcccacccgagacagggcagcaggcaggaacagagagcagttgcgcactagcagcagcagcagcagcagcagcacccgctgatgggacgcgcggcaatggcggcctcttccgggacgacgacgcgctccgtgcgcctgctgctgctctccctgctcggcttctgcgtcgcgctgagccaccaggagtcgtcgtcgtcgtccacggactcgtgcgccacggccaaggtcgccgtcgccagcctcgtgcccttcgactccacctccttccgctgcaccgccgcctggaagcagcaggacttcgtcctcaggtacaagaacacggggcccagcgagtggagcttcatcctctcggcgccggacaagggctcgtacgtggcggtcggcttctcgggcaagggcgccatggtcgggagcagcgccgtcgtcgggtgggcgtccaacggcaagggcaccgtcaagcagtactacctcggcggcaagagccccgaggactgcgccccgaacaagggactcctcaagctcgtcaagaacaggtccgtcgtcgtctcgcgctcggggcgcctctacgtcgccttccagctcagcaccgactacccgcagccgtacctgatcttcgccgtcgggcccgacggcaacctgccgcagtccgactccctgcggctgccgatgcaccagaacatggcctcccgctccttcaactacacctccgggatgtcttacaacaccgccggctcgtccggcgaccaggcggcgttcccgacggagaggaagcacgggctgctgggcatgatggggtggggcgtgctgatgcccatcggcatgatcaccgcgcgctacttccggcagctggacccgtgctggttctacacccacatggccatccaggtgtgcggctacgccatcggcatcgcgggcatcgtcctcggcttccgcatcaacgaggacgggctcaagaacgtggacgtgcacaaggcgctcggcatcgccgtcttggccatggcgtctcttcaggtgctggcgatcctggcgcggccggacaagacgtccaaggtgcggcggttctggaactggtaccaccacaacatcggccgcgcgacgatcctgctggccatcggcaacatcttcctgggcctgtccatcgcgcaggaggtcagcgcctacgtcgtctcctacggcgtgttcgtcgccgtgtgggtggtcgccgtcgccgccttcgagatgaagcggtgctacgccgacgacgactgacgtacggtcgacgccgagccgtggcaacggcga

SEQ ID NO: 156 - DNA, 1392 bp, Sorghum bicolor
cgcggatccgaatattctgcggtgcgaggcgctgttaataaatagtcgggctccccactgctggtgtggaagtctcccgaagaaacgaacggagcgcgaaaacagatctatgagtgagcaactgaagcgcgactacgagatcggcgaggagatcggccgcgggcggttcggcgtggtccaccgctgcgtctcccgcgccacgggtgagcccttcgccgtcaagtccgtggaccgctccctcctcgccgacgacctggaccgcgcgctggccgagctggagcccaagctggcgcggctggccggcggagagggcgacgagaacccgggcgtcgtgcaggtgcgcgccgtgtacgaggacgacgcctggacgcacaccgtcatggacctctgcacggggcccgacctgctggactgggtccgcctccgtcgcggcgcgcccgtgccggagcccgacgccgcgcgcgtcgtcgcgcagctcgccgaggcgctcgcgggctgccaccgccgcggcgtcgtccaccgcgacgtcaagcccgacaacgtgctcctggacctggaccccgcaggcgagacacccccgcgggtgcggctcgcggacttcggctccgccgcgtggctcggcggcggcgagggcggcggccgccgccgcggcgccgaggggctggtgggcaccccgcactacgtggcgcccgaggtggtggccggcggcgagtacggggagaaggtggacgtgtggagcgccggggtggtgatgtacgcgctgctctcgggcggcgcgctgcccttcggcggcgagacgcccgcggacgtgttcgcggccgtgcttcggggcagcctcaggttcccgcccgcgctgttcgcgggggtgtcgccggcggccaaggacctgatgcggcggatgatgtgccgcgacgtctcgagaaggttctccgccgagcaagtcctccggcacccgtggatccagagcggagggggagtccgagaggtggttcggccaacgccaacctgaggagcccacggggctcctcaggtttggaacgagaccggaaccgatcgtgtatcatcgtagcgatgcggtgtgttgtccccgacgagttttgtgcagacgcctctgtatatccagcaagtaggcggcggcggcggcggcggcggcggcgaggagtgtgagacactgagactggagatcgtcgctccgccgcgcggcggcggcgcccgggtgtgtgtgtgtgacggtgacctgggccgttttcctcttttcctttttgggcttttttttttcccggccgccctgtgtgcttttgggagtataaaagtgtagtgcgacggtgatgtatgcacgtctgtctagtctaaccgtgcatgtgttatgtgtacaaatgaataagtactact

SEQ ID NO: 157 - DNA, 1788 bp, Sorghum bicolor
atccaccttccgtcagagctcaagatcggccatggactcgccaccgcttagccccgctctgctcgcgctgtccctgctcctcctcctagcgctctacatcgctcgccggcgccgcggcggaggcaggaaccggaactacccgcccgtggcgggcaccgtgttccaccagctgctcaatttcggccggctgatggagtaccagacggagctcgcccagaggtaccgcaccttccgcatgctcaccccgacctgcaactacgtgtacaccgtcgagcccgccaacgtggagtacatgctcaagaccaacttcgccaactacggcaagggggtgatgacccacgacgtgctggaggacctcctcggcgacggcatcttcaacgtggacggcgccaagtggcggcaccagcggaaggtcgccagccacgagttctccacgcgagtgctgcgcgactacagcagcggcgtgttccgcgacacggccgcggagctcgcgggcatcgtggccatggccgctggcgccggggagaggctggatgtcgccgacctgctgttgcggtcgacgctggactccatgttcaaggtcgggttcggggtcaacctgggctcgctgtccggctgcagcgacgagggcgcggcggcgttcgccagggcgttcgacgacgccagcgagcaggtcctgtaccgcttcttcgacgtgtcctggaagctcaagaggctcctcaacatctcgtcggaggcggccatgaaggggtcgatccgcaccattgatggattcgtgtacggcgtcatcgacaggaagatcgagcagatgggcagagaccaacaggaattcgccaagaaagaggacatcttgtcgaggttcctgatggagcgggagagcgatcccggctgcttcgacaacaagtacctgcgggacatcatcctcaacttcgtgatcgccggccgcgacaccacggcggggacgctgtcgtggttcctctacatgctctgcaggaaccagcacatccaggacaaggtcgcgcgggaggtccgtgccgccaccacgggcgaccgcgacgtcggcgtccaggagttcgtcgcgttcttaaccgaggacgccatcagcagaatgcagtacctgcacgccgtgctgacggagacgcttcggctgtacccggctgtgcccatcgatgtgaagtattgcttttcggatgacacgttaccggacggctacgctgtcaagaaaggtgacatggtgaactaccagccgtaccaaatgggcaggatgaagttcctgtggggcgcggacgccgaggagttcaggccggagaggtggctcggcgacgacggcgtgttcgtccccgagagccccttcaagttcacggctttccaggcggggcctcgcgtctgcttgggaaaggagttcgcgtacaggcagatgaagatcttcgcggcggtgctgctctacctcttcagatttgagatgtgggaagccaatgctaccgtgggtttccggcccatgctcacgctcaaaatggatggcccgctgtatgttcgtgcaacgctccggcaatgaggtgggcggcggtgtatgcccccatcgttctagcagcagcactttgaaagtagaattgcgctatttccatctgatgccatcttggataacgtcgaggctcagaatgtactactgtgttattttcagagatgtaggaacaagttggtcagagcaaatatggtttgaccgggtaaattattgtactgccctaagtgcttactatacaatctaaataaacactctgattcagttat

SEQ ID NO: 158 - DNA, 2074 bp, Sorghum bicolor
ccgcaggcatgcaacagctgcagtggcacggggagaaaaaggtcagcaaaagcgggcacgaaacagaagaagcgctcgccgacccacccaccgcaccgatcccccacccaaatcgccgaccgagaggagacaacccgagctgaggagagagagggcagcaggcggcggcgcggagcaacacgcggaggggaggggaatgcgcgacccgtgtgaccctctcgcccccgcgaaatccaacccattctgattccgccggcgaaatcgggcgcctcgcggcccggccggccaagtggtggacggcggcgtcgagtggttcgttcgagacggtgagggtcaggtcgtgaggagcagcagccacggcgacggggacaatgaagggaggagggggcgggaaggagacgctcaccgcctccttcctccgcttcctcctcctgctcctcctccccctcaccgccctctacttcttctacacgctgcacctcctcctcacctccgcgtcgtcggccgcctccaactgcgcgcctgacgccgcgtcggtctcccgggtgtccgccaacctcacggcggcgacggcgtcggcgtcgacggcggcggcggagaagcagctgcccccttcccccttggctgtgccctcggcgacgacgctgcagcacgtggtgttcggcatcgccgcgtcgtcgcggttctgggacaagcgtaaggagtacatcaaggtgtggtggcgcccgcgcggcgccatgcggggctacgtgtggctggaccgcgaggtgcgcgagtccaacatgtccacggcgcgcacggggctcccggccatcaggatctcgtccgacacctccgcgttcccctacacgcaccgccgcggccaccggtccgccatccgcatctcccgcatcgtctccgagacgttccgcctgggcctccccggcgtgcgctggttcgtaatgggcgacgacgacaccgtcttcttcccggacaacctcctcaccgtgctcaacaagttcgaccaccgccagccctactacatcggctccctctccgagagccacctgcagaacatctacttctcctacgggatggcgtacggcggcggcggcttcgccatcagccggcccctggccgaggcgctggcgcggatgcaggacggctgcctccgccggtacccagcgctgtacggcagcgacgaccggatccaggcgtgcatggcggagctgggcgtgccgctcaccaaacacccggggttccaccagtacgacgtgtacggcgacctcctgggcctgctcgcgtcccacccggtggcgccgatcgtgacgctgcaccacctggacgtcgtgaagccgctgttcccggacgcgaggtcgcgcccggcggcggtgcggcggctgttcgacgggccggtgaagctggacacggcggggctgatgcagcagtccatctgctacgacggcgccaaccgttggacggtgtccgtggcgtgggggttcacggtgctggtggccaggggcataatgtcgcctcgggagatggagatgccggcgcgcacgttcctcaactggtaccgccgcgccgactacacggcgtacgcgttcaacacgaggccgatggcgcgcagcccgtgccagaagcccgccgtgtactacatgtcgtcggcgcggcgccaggccgggcgcggcggggagaccacggtgacgcggtacgagcggtggcgccacccgaacgagacgcggcccgcgtgccggtgggacatagccgacccggacgcgcatctcgatcacatcgtcgtcctcaagaagcctgaccccgggctctgggacaggtcccccaggcgaaattgctgcagagtggtgtcttcgcccaaggatggtggggagaacggggagaagacgatgaccatcgatgtaggcgtatgcagggaaggcgagttcagccaagtagcaggagcgtgagctttgattagagacagatgaagataggaagattcagattcttttcttcttcttcttttccttgtacgaatccattcttcttcttggagggcatgaactagtctcgtttcaaacgatccatcgcgttttgc

SEQ ID NO: 159 - DNA, 1792 bp, Sorghum bicolor
gtcttctacctcgcggcgatccagattccgcagcaacggcccctctcgtcttctccctcgcgggctcgatccctccggattggcgcgtagcgggttcagcgggtattcttaccattttcagattcagctggttgaacaaaactcgtaaagatggcatcagaagggaacaaagatgtacctaatgaaactttgtctgtggaccagtcatcgatttctggtgtaaagcgcaagcgtggccgcccaaggaaatacgagtatcctgtatatgaactaccacagaaggtacagcccctccagagcgccccacctcttcttcactgcacacaagatggctcaagtatggccagccatacatcaggtggcagtgttcatggtaattggtctgctcaacctagaaattcggctaatgtttctcttcaaggtaattctggcaaggataacgttcttggcaagcattttgttggcaagctgaccaagaaagttcctgggttttccctcattacggtaaaagtgaaggacaatcaggtgctcaaaggttgggttccagatgaaattaatctccgtccaataacacctaaggatgaccttgccccagagctacccatgcttcgaccgagtcaagttcgaaagcgagcatcagcaattcatatgcaacctgctcttcctgtgccaatgcacctggaggatgttacgcttgcaaagcctctgcagatgaggagacctgttgagaaaactattgctaagcatgctgtgcctcttgctcctaggccttacattggttctggtgttgttgcagcagtacctatatcagttgctcccagtaatcctgaaatgagaactttggccaggcaggatgctgaacttgtgatcccacaatcatcagttgctgcggtgccaattaaatctgtttgtcctgtctcggtaccatgcaagcaaccggctaatcaaaaagagtttactggaaagaagtctgttgatgaggttcagaaagattcagaacctccaaatgtgaccaaggaatcaccagtgaaagctgagaaaccaaacattgctcttgtggatgtagtggtcaaggattctccaggggaaaggcaacagcttaatgatcaagtaacagatgtgattagggaatcttctggtcaaactcagaatgttgatgtgacaatgtctgatgagatcaagatagcatcaggcgccagagatcagccaaattctgcaaatagtgaacagcagagttctaaggaagcatcagacatcacagaacaatctgagcagctgaagacagagaccgatgtcaataaaggagtcgatgcctcaaagtcaaatgcctcagatgacattcagcctgcgcatgatgaacaagaaatgaaggttggcggtaaatgaaagtagagatcaagattcaatgaacacaacacagatcctgatgtttagtgaaagtttgctgcctgtaatgtttctgtcaggcttattgggatgtatagctcgagtttttgtgaatggaccaatgctttaggtgcagactcctacctttacattttagttttattcccctgcaagtataggtgagagattaagtagagatacagaaaccccaaaaatatcacctaggacatcagttatagcaccagatagaattgtaaaccagaaaaaaaaaggggagaaagaaacattatttgatgtactttcatttttaggaagatgacatgacttaaagttattttgaactcctggtcttgtaatatggctttttgacatttgataagctctgattcacaggcatatggaaatt

SEQ ID NO: 160 - DNA, 1437 bp, Sorghum bicolor
ttggcgcctagtgcctactccactgtccactccgctccatcctcccttcctccttcccgatgcctccgactacgatgccttccacttccctcgccctccccaccgccgcccgcgccggcgctcgccgccatgccttcttcagcaaccgatcaccctcaagcgtccccatcgcgcggcggaggcgcgcgccccggttcgtcatggtctccgcctcggcgtctctggaggcactcatctttgattgcgacggcgtcatactggagtcagagaacctccatcgccaggcctacaacgacgcgttcgcgaactttggggtgcgctgcccgccggcctccgccgacccgctgtactgggacgaggctttctacgacgaactacagaaccgcatcggcggagggaagcccaagatgcggtggtactttggagaaaatgggtggccttcttcagagctctttgagacaccaccttcgactgacaccgacaaggagaagttggttgacataattcaggattggaaaacagagagatacaaagaaataataaaatctggaactgtgaagcctagacctggtgtgttgcggttgatggatgaagtaaagaatgcgggtatcaagcttgctgtttgctctgcagcaactaaaagttcagtcataatgtgccttgaaaaccttattgggcttgagcgatttaatggtctggattgcttccttgctggtgatgatgttaaactaaagaagcctgatccaacaatatatataacagcatcagagaaattaggtgtcggaagcaagaactgccttgtggttgaggatagtgttattggattactagctgcaaaaggagcagggatgtcatgtataataacatatacaccttcaactgctagccaagatttcaaggatgcaattgctacctatcctgaccttagtaatgtcaggcttgaagacctcaagctattactccagaaaactcttgttactggataatacatgcgattattccctggatgttgaacatttggtgctggatgttgagcaataggtgaatccaagatatacatcttgttgaatagttggtgttatatgttggaagacatgattactcaaatggaagtgaagatccgccttgaatcattgcccccacaccaactcgcaataaaatccttccaagatgagctctagagaggttttttttttaagggaggagtgaatgcctatgaataagtttgtttcaaattaacctgaagtcagtttgtttcaaattaggctaaagttaataaggccctgtttagttactcacccaaaaattttgcatccatctcatcaaatctttggacacatacatagaacattaaatgtagatataaaaataaactaattacacagtttggttgaaaatcgcgagacaattttttcaagcccagttacttcatgatta

SEQ ID NO: 161 - DNA, 1271 bp, Sorghum bicolor
agaagggaaaagaaaatctctgatcgagattcctgcccggctgatagaatctttggcagccacatccatggatatactgctaggttccgggagattcttggcgcgacggcttcctcccctcgcgctcgtccctcgctgctctcgaggctccccggacaaaagcggcagcgacaaaggtgaaacctctactgactgggacaaggcatgggctagctttaagaataaagggaagaggaccctcttttctgatttctcaccaaacaagtacgtgacctggaacccacggcgcagcgagtatccattgtcagaagaggttgatccaatcaagagaactgaaagatctaacttgatgctgtggacaagtccccagtttaccttggtgggggcaattatcatcgtcttgacattactaatctatacactagttgttcctcccaagtaactgcagaggtgacagctaggaggtgagctgtaaactaatatttctactgggaagtatgtattgtacatttttacatgtattaaaccaactatagcagtattgcttcaattgcaatcaagtagatataacaccacgtccattccattctggaggttttcttcaattgtatactaaatggctgctctccgagtctttattcctccattataacgaagaaatatttgggatgggtagaataatatgttggtcggttttctataatcacaatacatgttgatgctcctgatgcaacttttgtgcatgttatcacttctcagcaactgcagtgtgtgatcatcgaatattagctgtattaatctgtgaagggtagtttgtagtgttgggactgttcgggcaagaggacatgtgcaaagtatcaattggaaactgatggacacatgagaatcacgtttcttattacagacaagttcaagtcaaacaagacagatcattgcctccatacaataataagccctaggcagacaggaatcttgcttagatgtaaagctatataactaaccttgtttcctaggccctaaataattggcttatgtcccttgtgttggaggcatcaggatggtgtgttttaacattttgttaatatatagagagcaaatgcaattgtaaaataacatagctaggctctcgcgttatgtcgaagactttggtagttgcatctttatatgaagcatcttggatcaagtcaaacttcagactttttatccttcagacttgaacagtttccaagttttgattcttgtgtgttgttgcacactgtcggtcagtaaaa

SEQ ID NO: 162 - DNA, 2537 bp, Sorghum bicolor
cacgagcagtgcttgaaaccagccgccccacttctccacccactgactgaccccaatggcgacgccggtcccggcggaggcggacgcgggggaggcgcgggagctcctctacgaggcgtacaacgagctgcaggcgctggcgtccgagctgggcggtgcggcggtggcgccggcggtcgtggtcgtcggccaccagacggacggcaagagcgcgctggtcgaggccctcatgggtttccagttcaaccacgtcggcggcggcaccaagacgcgccgccccgtcgcgctgcacctccgcttcaacccgcgctgcgacgagccccagtgccgcctgctctctgcaacaggggacgccgacgagcatgatgaagccggggttgccgcgcgccccatgccgctcgccgacatccaggcatatattgaagctgaaaacttgaggttggagaatgatccatgccaattttcagagaaggaaatcataattaaggtagaatacaagcattcccccaatctcaccattattgacactccaggcctcatccttccagctcctggccgtaaaaacagagttttgcagagccaggcttctgctgttgagaggcttgttcgtgctaaaatccagcataaagagaccatcatactgtgccttgaagactgtagtgattggagtaatgcaactacacggagagtagtaatgcaggtcgaccctgatctcgccaggactgttctagtctctacaaaactggacactaaaataccacaatttgctcgcccctctgatgttgaagtgtttcttcacccaccaacatgtgtgctagatgtttccttattgggagattctccctttttcacatcagtaccctctggtagagttggttcttgccatgaagctgtgttcagatcaaatgaagagtttaagaaggccatcttatcaagagagatggaagatattgcatctattgaagataagttaggaaggtcacttacaaccaaggagagagatagaattggagtgggtaatttaagattatatttggaagagttgctgcagaagaggtatgttgagagtgttccattaatcattccacttcttgagaagcaacatcgaaatacaacaagtaaattgcgtgaagtcagtcatgaactcagtgatatgaacgaagccaaactgaaggagaaagctcagctattccatgactcatttttgaccaagttatctttgctattgaaaggcatggtggtggcaccccctgataaatttggagaaactttagttaatgagaggattaatggaggaacatttacaggaagtgagaatttccagctcccgaacaagatgatgccaaatggtggaatgcgtctttatggtggtgcacaataccatcgggcaatggctgaatttcgtctggtagttggtagtatcaggtgccctccaataactagggaggaaattgtcaatgcttgtggtgttgaggatattcatgatgggacaaactactccaggactgcttgtgtaattgctgtggcaaaggcacgtgacacatttgagccattccttcatcagctgggttttaggcttttatacatactgaagaggctgatcccaatctgtgtttatctgctggagaaagatggtgagggctttagtagccatgaagtgcttgtaaggcgtgtccaggaagctttcaagaggtttgctgaatccactgagcaatcatgtcgtcaaaggtgtatggaagatctggagagtaccactcgttatgtcacttggtcccttcacaacaagaaccgtgctggattgagacacttcctcgattcatttgttgcaccggagcaactatcagtgaatacactgaacgagcagttttctggcttgaatgacaacaaacaggacagggcaaagggtgactcgaagtcaaaccattcagacacaaattcgtccagtgctgtgccagagacaagactagttgatctattggatagcacactctggaacagacgtctggtgccctcatctgaaagacttgtttatgcgctggttcaccagatttttcttggaatcaaagagcattttcttgtcaccactgaactgaagttcaattgctttctcctcatgccgattgttgacaaattaccagcacttctaagacaagaccttgaatcagcttttgaagaggaacttgatagcatctttgatgtcactcagctgcgccagtcacttgggcagaagaagcgagagctggagatcgaactgaagcggatcaagcgcttaaaggataagtttggggagataaacaagaagctcaattctcttcaggttaggcagtagccagtaggtcagcccaaaatttagcagtagcttggtagacagtctaggtagtgtttcaatgctgtaataaaatcattggtcatctagagttacttcttgttgtatccatttagttgtaaatatgaagtcttcctatatatgttttaatgtatgttgttgctcatggttttcgaagtcgtttttcttttccacggttcctaaatccgaa

SEQ ID NO: 163 - DNA, 854 bp, Sorghum bicolor
aatagcaacttacaaagccatcccaatttccaaaaggacaagtaagcaaagcacctaaaactagccgccagctcggaatcgtcgtcggagccactccacccacctgctctgctcctcatggccagcaccagcagcagctaccccctgctgctgctgctcctgctgctggcggccccggccgcagccgccgccgaggcgtccgtcggcgtcggcgtcgtcggcggcggcaacgcgaccaccacgacgtcgtcgtcgccgacggcgtacgagatgctggagcggtacgacttcccgcgggggatcctgccggcgggggtgtccgggtacgagctccgcggggacggcagcttcgaggtgtacttcccgcgccgctgcgagttcctgctggcggggacgtggctggtccggtacgagccccgcgtgcggggctccgtcgcggccggctccctcacggcgctggacgggatcagcgtcaaggtgctcttcctgtggctcggcgtcggcgaggtggaccgcgccggcgacacgctcagcttctacatcggccccgtcgccacctccttccctctcgacgacttcgccgagagcccgcgctgccgcggctatgactatgatggcgatggtgatggcgctgctgccggcgacgacttattcccggcggcggcggtggcggcctcgtcgtgacccggcgcgatgattagtatttgtacaattgtatgtatgtacctgccgccttgatgatttagctggctatatacacgtgtgcatcgatcgagaattcgagacgagccggcgattagctacttcatcttcatttttgtttcagggaattggaattggatcaggttatttag

SEQ ID NO: 164 - DNA, 1166 bp, Sorghum bicolor
cccccaacattccctgccccccctcctccctccctccctagctgtgtcctgcctagcggtatcaatacctggctgcagctcaccacccaccaaccacaccacaccagagttcccagctcccatataaccactgatcagcagcaactcaaggctggctggggaagttcagagtgcggctacaccatagtatacctctgtaggcagatcagtgtgtcgttgcagaggagggaagaggaccagccatggcgacctccttccaggggacgaccaccaagtgcaccgcctgcgacaagacggtgtacctcgtcgacaagctcaccgccgacaaccgcatctaccacaaggcctgcttccgctgccaccactgcaagggcaccctcaagcttgccaactacaactccttcgagggagtgctctactgcaggcctcacttcgaccagctgttcaagaggaccgggagtttggacaagagcttcgaaggaactccaaaggttgtcaagccagaaagaaacgttgggaatgagaatgctgttaaagtctcaagcgcctttgctggcaccagagagaaatgtgttggatgcagcaagacagtctatccaattgagagggttactgtcaacaacactatgtatcacaagagctgcttcaagtgctgccatggaggatgcaccatcagcccttctaactacattgcgcacgaggggaagctctactgcaagcaccaccacattcagctgatcaaagagaagggaaacttcagccagcttgagaatgatcacgagaagacgtcacaggctgggtcactggaggatgaagaagagtattaatcactgagcactatcacagatgaataattaatcttcttgcatttgcttagagcactatatatttctgtggcatggttcgatttcaattttaccaatggagctcatgtgcgttcagagaacaatgaaattatcgtcttgtatctgcatgtaaacctttgttatctttgagtcaaatactctacctgtttcaccattttcattgatcagaagatgcctctgcagtctgcaccaagaagacacagaactgcaagctcttggtccatattttgtttaaaatgatatttggcaaatggatgcataacaatagaaaaataacgaatccaaacaaaaataaggaaa

SEQ ID NO: 165 - DNA, 917 bp, Sorghum bicolor
gcatttgcatccccgcccaaccaatcttcctcgttccgccgctcccactccagcggcgccggcggcgaggcgaggatctccacagcggccgcacctaccaacgtccaggagcaatggctctgtctgcgcctatacggatttctctcatcgtctcgttctttgggattctgtcgttcatacttggtgtcatcgccgaaaacaaaaagcctgcttctggaactcctatcccaggaaaggatgtggtcatctgcaagtttccaagtgatccaactcttgcaatgggaagcctgtccattgtggcacttgttgtagctgccattgtaggccatgttgctatctttttcccatactcggacaagtcagttcctcgcggagcactgtttcaaagcaccagcttgacagtgttctttgttgttgctgagctcgtctcagccctggcttttgcaatgttgttgtgggcaactatcactgagggacttcaccgcagcaagaacatccaccacgacatgaattaccagtgccctactgcaaagaccggcctgtttggtggtgctgctttccttgcccttgacgctgctctcttctggcttgtttgccagatgctggccctcaatgcaagggctgactacctggacgaggatgacaacaagggcgaatatggccaggtttatgccgatgaagtcgatggctcgaaggtctgagcctatgcagtcatgcttgtcagggttttatgattagtgtcacttaactatattgtgtcatcaacaaagtcgctttagctctcgtaaatttgtatataagttggaaagtcttgcataaggctggtggttattctgcattttcaggtttcagtgtgatcaataaacagtttctcagtacaattggtttgctacttcccttggtgaactactgaacct

SEQ ID NO: 166 - DNA, 1592 bp, Sorghum bicolor
ctttgttaaaaaaaaaacggttgtgctgcttcagcatctcctcctcccgctcccgtgtcccgttactctgccgcagcgtgctcctcgacctcgctaaaagccaactggagtagtagccaaccgccctcctctcccttccctccctcacgcacaaagcagagcaggcaacggcacagcacagcacagcacaggtagagagagaaagaggagcgcagagccaaagaagcagagcaacagcagcaggtcgaggaagaagagaagggaagaggaagaggagagaaggccaggaggcagcagcaaccaagaagggggaagagagcaagatgctgcgcgggggcacgagcgtgctggggatcatcaacttcatcaccttcctgatctcgatcccgatcctaggcggcggcatctggctagcctcgcgtgccaactccaccgactgcatccgcttcctgcagtggcccatcatcgtcgtgggtctcgtcctcatggtcatctccctcatgggcttcgccggcgcctgctaccgccagacctggctcctccgcctctacctcttcgccatgttcttcgtcgtcctcgccctcctcttcttcatcgtcttcgccttcgccgtcaccgaccgcggcgacggacaggtcgtcatgaaccgccggttccccgagtaccagctctccgactacagcggctggctccgcgaccgcgtcgctgacccggagtactgggccaccatcagcgcttgcctccgcgacggccacgcctgcgccggcatgaggcgcctcgcaagggaccccaacaccggcatgctcgtgccggagacgcctgccatgttctacggccgcaacctctccccgattcagtctggatgctgcaagccaccgacatcatgtgcattcacctatatgaacgagacgtactggacacaaaaccctggtgtgccgactgtgatgaatgaccctgactgcagcaggtggagcaacgaccagcagatgctgtgcttccagtgcgactcatgcaaggctggcgtcctagcgggcatcaagaagagctggcgcaaggtggccatcctgaacatcgtggtgttgatcatccttgtgattgtctatgtcgcgggctgtgccgcattccgcaatgccaagaggatcgagaatgacgagccgatcggcatggcacggatgaccaagtcccatcctagcaggttccagttctaggcagctgctgctgcgggtttggaagcttttgccttgtacaaatgatcacaatgggtggtgctaaggcttaggctttgttatatcttactgaaatgtggattctactgcatttggtggtgaaaaggggaagttcagtgtggtttgagtttgtgtttgtgtttgctttagtgtttagggtaggcctattatgttgtaggggtacaatatgagatctgcaaagaacaagagaagttaaatcatctaggagctgttctgtattggagatttttaaattctgggggatagttgtatgatggtgccagtcatgatggaatattttctgaatatctcactgtatggcaatactagaggtgtgatgagatggctgtactgcagcttccagta

SEQ ID NO: 167 - DNA, 1403 bp, Sorghum bicolor
atgctcatgcatccagatcactaaacggcagcagcagcaacagcacgagctccctgcagtagccatgacgactaagcgctgctgcctgctcgtcgccacgctcctcgcggcgctgctggtctcggtcacagcccgcctcgacgtcggcttctacaacaagacgtgcccctccgccgagagcatcgtgcagcagaccgtggccgccgcgttcggcaacagctccggcgtcgctcccgcgctcatccgcatgcacttccatgactgcttcgtcagaggctgcgacggctcggtgctgatcgactccacggccaacaacacggctgagaaggattcgcccgccaacaacccgagcctcaggttcttcgacgtggtcgaccgcgccaaggcgtccctggaggcgcagtgccccggcgtggtctcttgcgccgacatcctcgccttcgcggcgagggacagcgtcgtgctcaccggtggcctcggctaccaggtgccgtccggacgccgtgacggcagggtatccaatgccacccaggccacgaacaacctgcctccgccgtttttcaatgccacccaactggtagaccgcttcgcctccaagaacctcacccttgaggacatggttgtcctctccggtgcacacaccctcggtgtctcccactgcagcagcttcgccggacctgccaacctgggcgaccggctctacaacttcagcggctcagctgacgggattgatccggcgctgagcaaagcctacgcatttctcctcaagagcatctgcccgtccaacagcagccagttcttcccgaacacgacaacgttcatggacatcatcacacccgacaagttcgacaacaagtactacgtcggcctgaccaacaacctcggcctctttgagtcggacgctgcgctgctaaccaacgcaaccatgaaggcgctggtggactcctttgtgcgcaacgagaccacatggaagaggaagtttgccaagtccatggtcaagatggggaagatcgaggtgctcaccgggacgcagggcgagatcaggcgcaactgcagggttatcaaccctgctagcgccaccgatgttcttgccagtcagtcaggttcttcaggattcactggagtggctgcaagttaaccataccggttgtcagttcatgtgcgtgcagtgtgtttggtgtgggatgtgatcgatattgtaataagtgatgagcaaattagctgtataacttgcttgctagactagatgaacacggagacagcacaaaaactgaagaaaaaagtaggcagtctgttgtacatcgcgtggtgttcaattgactctggtgtttgattgtgaggataaaaataaaactgtaccaaatactttttcccgtggcaaacatgtatgaccatctgattat

SEQ ID NO: 168 - DNA, 1920 bp, Sorghum bicolor
cgctcccgccgcccgcactgccatgggccaggctcgccgcgcgacgctctcgtcgacccccgccgtgctcctctgagagactgagaggcagagctagccagccagccagcccctgcttgcttgagtgcttgccgtgtgtcgggctcggcttctccttctccttcgcccacgcgcggcgcggggttgttggatcaaagcttgaccaaccatggcgtcggtcaggtcgtgcgtgtccgtgaagtccgccgtgagcccggtcaggtacagatccacgagggccagggcggccggtctgggggctccgggaaggctgcgcgtacggtccccgtccctggcgctcggcggcgacggtggctgcgccagcgccagcagcagcgggaggggtagcgtcgtcgtcagtggcggcggtctcggcgtgctcggcggcgatggaccgaggatcatccggcggggcggcgggcgggaggtcctcgccatgtgcagcgcgagcttcgacggggtccgtcccgccgccggcgccggcgctgccgtggccagcgccgtgcagcccgtgccggcggcgttccccgagcgcgtcaaggtggtggcgctggtggcggccatcatgctgctctgcaacgccgaccgggtcgtcatgtccgtcgccgtcgtgccgctcgccgcgcagtacgggtggtccagctccttcgtcggcatcgtccagtcgtcgtttttatggggatatgttttctcatccatggttggaggagctttggcagacaaatatggcgggaagaaggtgatggcaggtgctgctgcactctggtccttggctacaattctcactccttgggccgcctcccgctccaccatcatgttgcttgctgtacgtgcactctttggccttgcagaaggtgttgcatttccgacaatgagcaccttcttaccaaagtggttcccaacacatgagcgttccactgctgttggcatttccatgggtggattccatcttggaaatgtcataagcttcctagcaacaccgatcatcatgtcacacataggcctctcgggaacatttgccttcttcgcgtcgcttggttacgtgtggctctttgtatggatgttaaatgtagaaagtgatcctcttgacagccgtactataagcaaatctgaattggaattaattctagctggaagaactggatctaaagtccaaggcagtaaattcccatccctaagggaattgttctcaaggactgaattcttagctgtcactttggccaatgtggtcaacaactggggctattttgtcctattgtcgtggatgcctgtgtacttcaaaacggtttataacgtcaatctgaaacaagcagcatggttcagcgccataccttgggcagtcatggcgatgtccggttatgttgcaggagcctctgcagatttcctgatcaaatctggttactctattggactagttcggaaaattatgcagtccattggtttcatggggccttgtgtgtcattactatgtttaagatttgcccaaactccatcagttgctgcagttctcatgaccactgccctgagcttgagttctttttgccaagccggatacttttgcaatatacaggacattgctccaaaatatgctggatccttgcacgggttgacgaacggcatagggacggtggccgccatagttagcaccatcgggaccggctacttcgtccagtggctagggtccttccaggccttcctcaccctcacggcggcgctctacttcagcgccaccgtcttctacaacatctacgcaaccggcgacctgatttttgactgagacgaacttgctaaatgccagtaatgattcttttgtgcagacgcagaatcccaaagtgtaccaatgttaatttgtatctccccaaggatggaataagatggagg

SEQ ID NO: 169 - DNA, 1305 bp, Sorghum bicolor
ctcttattccctccgaacccccaagtctccaaccgaggaggagcctctgtcgtgtcaggttacttgccggcttgccggccgtgtccgcccgacccgactcttctcctcgccggcggggagctggagcctgcctgctcgatcgagctcttgcgcgcgcgcgcgggcgggcggttggttgacgatgtcatgtggcccctctgcgtcatctccgagaagctcttcaagatggcgggcgacgacgccgtgcagggcgcggcgggctcgccgtccctcgacggacagattccactagcacgccgatcgtactacgtcgatgttccgcatgtgcagcaggccttcacctgggactgcggcctcgcttgcgtgctcatggtgcttaggacgctcgggattgattgctgcgacggcattgcccatctcgagaggctctgccgcaccacgagcatttggacggttgacttagcatatctgttaaacaagttttcagtcagtttttctttctttacggtgactcttggagcaaatccacaatattctgctgaatccttttatagggagcaattgcaagaagacatcaatcgtgtggatgagctatttgggaaggcacttgatgctggaattagtattcaatgcaggtccatcaccgcatatgacattgcttttctactgctatctgggcactgcattgctattgctttagtggacaaatcgaagctaaatttgccgtgcatgagtgatcatgatgtgcaacagttcaacgaggagtcagactacatggggcattatgtcataatatgtgggtatgacgctgatgattgtgaatttgagataagagatcctgctagttccaggaaacgcgaacgggtgacaatgaagagcttagacgaggcccgcaaatcctttggaacagatgaggatattctcttggtttccttaacgggaaagagtggaatgaagctctcacgtaaactacttgcctgctccatgtaaataggtcactagcaagcaaccaaccaccttgtgaatacgctgtacatgtccctgtagttatgattgtcgattgtcagccttgtatgtagctgagatgagaacgttctttcagctgataggaacagtatgctagtgaacttagtaagcatccggtttgttggctcatgccatcaccaaactttggctgcgaaggccaaaagggttcagcagcagcaaaaagctctgttgatgttgtaacttgcaaatgttatactacgatttagagctgaacgtgtacagatcttcagaaataatagaaaaaaaaagtgctcctct

SEQ ID NO: 170 - DNA, 3560 bp, Sorghum bicolor
caactcacaagcgacatcgcccgctctttcttctcgcgcgcgacggcgcgaccaaacaaactcctcactaaaccctagaagctcccggtcgccgccgccgccaccaccgcagacgccgccgccatggataccctcaagcgcaaggccccggacggccccgaagctgccgaccaggcctctcctctgaaagcaccgcgcgtcgtcgcccccacctcggagcctcccgctcccaccgccctcgcgaccgcggaaccagtcgcctgcgtgcacgacgtctcctaccccgagggctacgacgcgtctgcctctacgtcccgcgccattgccggcggcgctgacgcctctgagccagcaaggaagttccccttccagctcgaccccttccagtccgaggccatacgctgcgtcgacaatggcgaatccgtcatggtttcagctcatacgtctgccggaaagacagtggttgcgttgtatgcaatagcaatgtctttgcgcaaccaacagcgggtcatctacacgtctccaatcaaggcactgagcaaccaaaagtacagggagttcaaagaagagttctctgatgttggtctcatgacaggggatgtcacgattgagcctaatgcctcttgtctggtcatgactacagaaatttggcggagcatgcaatacaagggatctgaggtcatgagggaagttgcttggattatttttgatgaggtgcattacatgcgggatagagagagaggagtggtctgggaggagagtatagtgatggctcccaagaactcacgctttgtcttcctctcagcaactgtacctaatgccaaggagtttgctgattgggtagctaaggtacataagcaaccctgtcatatagtatacactgactatagacctacacctcttcagcactatgtatttccttctggaggggatggattataccttgtagtggatgagaagggcaagttcagagaggacagttttcagaaagcattgaatgcccttgtccctgctagcgacagtgccaagaagaaggagaatgggaagtggcagaaagttatcatggcagggaaatctagcgaggaaagcgacatattcaagatggtgaaaatgataattcagcgccaatatgatcctgtaatacttttcagctttagcaaaagggaatgcgaatttcttgctatgcagatggctaagatggacttgaatgaggatgacgagaaggcaaacatcgaaacaattttttggagtgctatggatatgctttctgatgatgacaaaaaacttcctcaggtttcaaacatgctccccttactgaaacgcggcattggcgtgcatcattctggtctgttgcccattttaaaggaagtcattgagatactcttccaggagggcctcattaagtgtttgtttgccacagaaacattcagtattggtctgaacatgcctgcaaagactgttgtgtttaccaatgtgcgaaaatttgatggagaccgattcagatggttgtcaagtggagagtacatccaaatgagtggccgtgctggtcgtcgaggtattgatcagcgtggtatctgtatactgatggtagatgagaaaatggaaccttcaactgccaaaatgatgctgaaaggaagtgctgatagtttgaacagtgcctttcatctgagctacaacatgctgttaaatcaaatgcgatctgaggatggggatccagaaaagctcctccggcattcattttatcaatttcaggctgatcgttctctccctgatcttgagaagcaaatcaaggaactggaatcagagagaaattcgatggtcattgaggaagaggagagcttgaaggattattatgatctcttacagcagcacaggagtttaaagaaggatgtccatgatattgtcctctctccaaaacatgttctgcctttcttgcaacctggaaggcttgtccgcattgaatatagtacagatgagccagccaacttttccattgatgaaaatgtcacatggggaattataataaactttgaaaaagtgaaatcccatggtgaagataggagacctgaggattctgattacacggttgatgtccttaccagatgttctgtaactaaggacaacaatggtaagaaaacaatgaaggttgttcctctgaaagcgcgtggagaaccagttgtagtttcattgccactttcacagattgatggactaagcagcatacggatgtacatacctaaggatcttttgcctgtagaagctcgagaaaacaccttgaggaaagttgaagaagtcctttcaaggtttgctaaagatggggtgcctctattggatccagaagaagatatgaaagtacaatcgaaatcatttcggaaagctaccagacgaatagaagctctggagagcttgtttgagaagcacgatatccgtaactctccacatatccagcaaaagctgaaagtctttcatgctaagcaagaactatcagccaaaataaagtccataaagaaaacaatgcgatcttccactgctttagctttcaaggatgaactcaaggcccggaaacgtgttcttcgcaggctgggatatgttacgagtgatgatgttgtggaagtgaagggcaaagtggcctgtgagataagttcagctgatgagcttacattgacggagcttatgtttagtggtgctctgaaggatgctacagtagagcagatggtggcactgctttcttgctttgtttggcaggagaagctccaggatgccccaaagccaagagaggagcttgatttgctcttctaccagctgcaggagacagcaagaagggttgctaaccttcagcttgaatgcaagatccaaattgatgtggaaagttttgtgaattctttccgacctgacataatggaagcggtgtattcatgggccagagggtcgaagttctaccaaatcatggagatgacccaagtgtttgaaggaagcttgatcagggccatcaggaggctggaggaggttctgcagcagctgattctggcatccaagtctattggggaaaccgagttagaagcaaaactcgaggaggcagtcaacaagatcaagagggacatagtgtttgcagcatctttgtacttgtaatgtctagatgggtcaggggctaggtcaaaagctcatagggaattaagcgctcttaatttgctgctgttgtcagagtgctgttggcatgatgaagctgcctgatttgctgttagcagtaatgtggcagtgaaattttgttagggttaaccatgcagggtctatttgaaggtcaagaatttttgtaggaagcaatacaattctggcagaaattcaacaaactcacagtaactgccttagcatgtacgataaatagctaattatttgttaggaatagtccagggatgcaaatctgtatgcagaattacaaatgtaccggattgcaatatatacgtatgtgtggagtataaacaagtgtaagatttagtgcttgtgttgtattattgtaagtgcaattcaaagtcggtcgatggagatgtccctggatggaaact

SEQ ID NO: 171 - DNA, 851 bp, Sorghum bicolor
ccgcaacctgacagcgctcgacaagcggcgcggagccagccaaagccaacgggcacccgaaccagacgcctccccagtctccacctcgatcgccatggcgacgacgccgccgcctccgcctgctcccgccgccgcgcacacggtcttcgtctacgggagcctgatggcggacgaggtggtccgcaccatcctcaagcgcgtcccgcccgccgccccggcgctcctcccgaactaccaccggttcaacatcaagggccgcatttacccggccatcctgccagttgaaagcaagaaagttgctgggatggttatcacgggtgttactgacgaagagctccaacttctggatgcttttgaagatgtggagtacacgaggacaagagttgagatatcgttgactgactctttggagaaaatactggctgacgcttatgtatggagtgatgcagaggaccccaatctttatggcgaatgggattttgaggagtggaagaaactgcatatgaaggatttccttgcgatgacaaatggtttcatgcatgaactcgaacagcctgaatcgaagaccagggtggagacctacgagtcattcatgcaacaacaggaacagcctgtgccggggacccaggttgagggttgagagttgcaatctgctgactgctgatctacatctaagtcattctcctggaggaattgcattggcattggactgtaccatctgtaataggtcacctatatgatttgtgaaataagatcaggattatcctattataataatatagtaatagttaagtacacaagtaaaatgcccaccgaaatttctgttgattctttttttttacaacaatttc

SEQ ID NO: 172 - DNA, 2300 bp, Sorghum bicolor
ctaaccccgcatcctgggacgccgccgacgccgccgataccgccgccttgtggcctccagcccctagcttgccaccctcccgcttgcgctgctgaggtggtcgctgtagagaatggggaaggggaagaagtcgaaggagaaggagatggagaagaaaccggtggacatcctcgcggggtccgacgaggactccgatggcggggaggatctctccaaggtccagatcaacgaggagtacgcgcgccgcttcgagcacaacaagcggcgggaggcgctgcagcgcctcgaggagcgcaggaagcagggcctcgtccccgcctctgacgacggcgagtcggattccgagtccgagtcgactgaggaggaggacgaggaggccgccattgcctcgcgcctcgtcgaccgccgcgtgttcgaggtgatccgccgcatccgcagcggcgacccccgcatcctagacaaggacgccaaggtctactcggagtcagaggaggaagagggcggcgaagaaggtgaggacgccgagaaggaagaagagtccaagcaggggaagaaaaagaccaagaaggagaagcctctatacctcaaggacgtcaatgcccgccacctgctcgaggagggcccggagttcgcagcgcaggccagccggagcagcagcaagttcgagaggatcgcctatgatgagcagcagaagaagggtttggaggctttccttgaggcacagaaagaagtattaggagacgacgacgacgacaatttgttccaggtgaagcccaaggttagagcaggggctgatgatgaagtggaggaggatgaggaggagaagcagaccaaggagcttgctggtgaggtctttgggaacgatgaggagctggatgagaatgagaagttcttgaaggaatttttccttaagaggccgtaccttgaggcagagaagaggaagtcctatctggatgatatccaggaattgtcagatgatgaagaagagctcgagattcaggaagaatatgagcatggttataattaccggcatgaggaggccatggcatcaggggcagtggtggcggaccgggtaatgggacattcaagggttgttgaagggtcagtaaggaagaaggagagcagcaggaagcagcagcgcaagagcaaagaggagcggatggctcgtattaagcaacagcaggcagaggagctgaagcatctcaagaatttgaagaagaaagagattgcagtgaagcttgagaggatccgaatgatcgctgggattgaaggcgatgctgcatgtaagcttggtgctgatgacttggaggaggattttgatccagaggattatgacaagaaaatgcaggagatgtttgatgacagttactatgatgctgatgatgttgatcctgagtttggaagtggtgtggagatggatctggagaagccggattttgacaaagaagacgaattgctcgggcttcctaagggatgggctagtgaccagtcaaaagaagagtctactgccgctgatgcgaaaggtgcaaaagggaagatctctctcaaagacaaggtggagcttgagaaagagatggaggagtactacaagttagactatgaggacactattggagatatcaagactcggttcaagtataaacaggttaagcccaacagttttggtctgagtgcctgtgatatattgacatcagatgacaaggatttgaaccagtatgtttccattaagaagctagctccttacagagaggatgaatggaaggttacgcatcataagatgcagagcaaggatttgatccttggaggccagaaggaagggaagaaggacaaatctgtcaagaaatctaggtctgaggaaggcggccctagttcttcaaaaacagagaaagacaggctgacaaatgggcaagagtcaacagatgacaagaaaaagactacccgaagtgagcgaaggaagcgtcgtaatgctgacctaaagatatccgatgatcgattagcggcatttggaaagacaaattcgaagcgtcacaagagccattgactttctgagattcatctaagtacatctgaggaattttgctgttctttttatgcattatggatcggtcaaagtcttaggtttagcagtccttgcttctattttgggagatgcaaaactagtgttgtcctagtagaaacatctgtttatttcgtcaaaaaaagaaacatctgtttctctgtgagttttgcagacattgtgttgtgcacctccatttgtggaccatatctaatgtaattgccctgcaatttgttgtgtactc

SEQ ID NO: 173 - DNA, 730 bp, Glycine max
agcacagaacgaagctgctatcgataacatatttcacttgagacagttatctttatctacgcaagagaagaatagaaaatggatatcaggttgatggatttggactctccattgttcaacactctgcaccgaatcatggatctgacagaggacgcagagaagaacttgaacgctccgacgcggacatacgtgcgcgacgcgaaggcaatggctgcgactcctgcggacgtgaaggagtaccctaactactacgtgttcgtgatcgacatgccaggcctgaaatccggggacattaaggtgcaggtggaggatgataacgtgcttctgataagcggcgagaggaagagggaggaggataaagagaaagaaggggctaagtatttgaggatggagagaagggttggcaagttcatgaggaagttcacgcttcccgagaatgccaacaccgatgctatctctgccgtctgccaagacggtgtgctcactgtcactgtcaacaagctgcctcctcctcagcccaaaaagcccaagaccatagaggttaagatcgcctgaattaatttcttcgtttgcactgagacctgctatcatttcctcttttccttttgtgtgtgccaatgcttttctatctttccgtctctgcttatggtcatgatatgacactgtagtttgatcatggatgatataatgcatgcttttctatgaatttttaatttcctaattcctctga

SEQ ID NO: 174 - DNA, 949 bp, Glycine max
ttacgattattttttttcccttggattggagctggggtttcttgtggtgagagaaagaacccttattctttgatttgggaacatctaggtctcaatttagtggaacacccttcgtagttggaagttaaattttgaagctttggacgaagatggtaaatgggaatgtgaaaataaccagttgggtccaaaagaagatcactgatccccttctctccattatccgaagaggaactgaaccaaaccagttggctttctctgctgctcttggtattacattgggactatttcctatatgtggtgtcactgtgttcctctgcggaatggctattgcattgcttggatcattttgccatgctccaactgtgatgcttgcaaactttattgctactcccatagagttgagtctggttgtaccctttctacgccttggtgaggttatctctggtggatctcatttccctttaacatctgatgctttaaagaaagttcttactggccaagcttcacgtgaagtcttattaagtgtggcccatgcgttattagggtggctggttgcatcaccatttattttgggaactctatacatagttcttttaccatgcttcaaaattttagttcataatttctcaagtgttcctttaagtccaaagaagccgctcaatccacactcagaagtaaagctgaaggtaagggatgtttgacaaagtagcaacgatatcatagtctcaaaatctgctttgtcacagtgatcaatcattgattcctatattcttgcgtgacacaaattgtacataatcaacaaaaacttgtcactgtttataatgctgagattgacgtatcctatttgtaaagcatgctatgtgatgtgatgttattacaaaaaatagtataatgttattggccatgggacatttgaagatcataaggaacatggatatcaaatttttca

SEQ ID NO: 175 - DNA, 792 bp, Glycine max
gaacgatctttttaatttgatgtttgtttttctaatacttcactcagatcgacgttcataaactgttttagtccttttgacgcacattcacaagttagggtttttgttagtaccatctgccccaccagtcatttcgtgctttaccagttatcttatctgggaatatctgctatgccattctaggattaagaatataaaaaaaaattgttgacagagatgtcagcgtatgacaatgttgttggtgggaaattgaagttgaagggaaaagcactggatgtggctggtggagtgaagaagaagaaaaagaagaacaagagaaatcaggaacaacttttgcaagtcgccgaagatgaagtttcagcaggtggaagtaaagaacaagccaaagattcaaatgatgaagatataaatgatgtgagtgaattaagcggggaagggaagacagctcattatgatgatcatcttacaccggtggagaggcgttacatagagcagagggagcaacttgatgttcacagattggctaagatatctaataaatctcaccgtgacagaattcaggatttcaaccaatatcttgcaaacatgagcgagcattatgatattcctaaagttggtcctggatgattcaatgaaggccaatccttatcatttgtatttgttcgttaatattaatgccgtgtgcccgcacaatggttattgtcactgcatattgatactttgttttggattcatatgatagatatatttggtttctctccctgtggatggagaagtatgccttcaacgaaa

SEQ ID NO: 176 - DNA, 2654 bp, Glycine max
gattattgttagggtttatcaggtgaagaagaagaagataacagaaagaaagggtttgtgaagatgggaagaagaaacggtggtaggtcccttcaagaaaccctccgtcgccgacttgagtcatgcaaatccaaatactccaccgccgaagaattcgccaaccatctccgttcaacttatcccgattaccaccgaaccaagcaccaaaccctaattcgatttgttcaggaagctcttcattccaccgccaagcttaatcacactcccacacccaagcactgcgacggcgacgacgatgacgacgaagaaggagaggctcaaagcgcgtctcgaaagcggcggaagaaaatcgatgggagtgaagagagattgcagaggatggaagcgttacacgtccgaagcaaggtgcagagatcttcctcatcgtcctctgcttcggagagcgacgatgaagatgaagaagaaaccgtgtcgacttcggaggacgcaatttacggggagaaggtggagcctgagtttgatttgatgaagacaatgctgcgaaagtcgtatacgccgaagaaggttgccgcggaggaaaaaaacgttgaattggaggtggggaatagcagtaaggacactcttgtgaacgaggaaaggaaggaagtgaagggctcaagttcgggttcggtttcgaacaggaaggacggaccgaggtttaaggatttgggtgggatgaaggaggttttggaggaactgaagatggaagtgatcgtgcctttgttccacccccaattgccaagacagttgggagtgagaccaatggctggcattttgttgcatggaccacctggctgtgggaagactaaacttgctcatgccatagctcatgagactggtcttcctttctatcagatttcagctactgaggtggtttctggagtttcaggtgcatctgaagaaaatattagagagctttttgctaaagcgtacaggtctgcgcctgctattgtctttattgacgagattgatgcaattgcatctaaaagagagaatttgcagcgtgagatggagaaacgtattgtgacgcaattaatgacttgcatggatcaatcaaataggcttcttcaaccagcggatgatgtggagagttctggtgatgatcatcatcctggctatgttcttgtaattggagctactaataggcctgatgctgttgaccctgccctaagaaggcccggccggtttgatcgtgagattatcattggcaatcccgatgaatctgccagggaggagatcctttctgtgctcacttgcgatcttagacttgagggtttatttgatctacggaaaatagccagggctacatcaggattcgttggtgctgatttggcggctctggttgacaaggctggtaatcttgctatgaagagaataattgatgaaaggaaacgtgaattatctcaagatctcacgagtgagcatgctgaagactggtggagggaaccttggtcggttgaagaaataaacaagcttgccatcaaaatgtccgatttcgaggaagcagctaataaggtgcaaccttcattaagaagagaagggttctcttccattcctaatgtaaaatgggacgacgttggagggcttgatcttttaagaaaggagtttgaacgttacattgtaagacgtataaaatatcctgaagattatgaggagcttggggtggatctcgagacgggatttttgctttatggacctcctgggtgtggtaaaacactgattgccaaagctgttgccaatgaggcaggggctacttttattcatattaagggacctgaacttttaaataaatatgttggagaaagtgagcttgcagttcgtacaatgtttagccgtgcaaggacatgtgcgccttgcatacttttttttgatgagattgatgctttgacaaccaaacgtggtaaagaaggtggttgggttgttgaacgactattgaaccagttgcttgttgagttagatggcgctgaacaacgaaaaggtgtttttgtgattggtgctacaaataggcctgaggtgatggatcgtgctgtcctacggcccggaaggtttggtaaacttctttatgttccacttccaagcccagatgaacgagttttgatattgaaagctcttgcaaggaagaaggctgttgatgcctctgtggatttgagtgccatagcaaaaatggaagcttgtgaaaacctaagtggcgcagatcttgctgcattgatgaatgaagcagcaatggctgctcttgaagagagattgacctctattgagacaacttgtgatacattgaccatcaagaggaccatcaagaggcaccattttgaggtagcactgagtaaagtgtctccgtctgtgtcagacaggcaaaagcagtattatcagcatttgtcagagggctttaaagcagcatgagcagcatgacattcactttgttattttagcaggtgtcgacattcctttaaagaatggggtgaaagaaatcatttatatgagcgtcaagtatttagagtatttgcttttgtaatgagatgtacatgtttcctgcagtcaggacataatttttggcaaatggttataatttatggttcactttatccaataatattgttccaaattttttgttaaca

SEQ ID NO: 177 - DNA, 994 bp, Glycine max
gtatcttcgtttgctttatatctcctgaagcagaacatcacctttcctatttactcactgtgtgatctaatcttcttctatgggttggcttagtcggttcataactgccgtggctttcttagccatcggagtgatattctcaccggagacactggggtcaaaatcaaccacactttccacctacctcaaactcgctcacctcctctgcttctccaccgccttcggcgccgctctgtgggtaacattcatcggcggcatcatcatgtttaaaaatctgccgcggcatcagtttgggaacctgcaaagcaagatgtttccggcgtatttctcgatggtgggtgtctgctgcgccgtatcggtggcttcctttggctaccttcacccgtggaaaacttcctccaccactgagagataccaacttgggtttttgctctcttcctttgcgttcaatcttaccaacttgtttgtctttacacccatgaccattgagatgatgaagcagaggcataaagtggagagagaaaataatataggggaagaagttgggtggtcaaaaaatgtagaagttgcaaagtcaaacccaaagcttgcagccatgaataagaagtttggtatgattcatggattatcttcccttgccaatataatgtcgtttggcagtctagcaatacactcttggtacttggcaggtaaaattgatctctgattcagtttctgcttccaattctatgaaagacaagtgagtttcttgtgaagagatgtataagtgaggatctcagtgttctctctatcttccactttcttgctttattgccaagtaaaaagagtctagaatgtctgtgcaatttatgaaatgtactatctaagtattacagcatattgattggtcaagaaaatcttatgggttgccatggaaacataatgtaatcatcctacctcacatgaataaaataagtagtctctttgagacggtttacattttggatactctcag

SEQ ID NO: 178 - DNA, 1312 bp, Glycine max
ataaatatcacagtgcacacccactctgaaatcctctccttttttcataaaccctacttctacttcccccctttgctctcaaaccttatcacctaatccttatcctcccaaaccagaaaaccatgtctacctccgcagcttccctcgcactcccaaccctcactctccgaacccgacaacctctatgttctccccaatgcttctcctcgtccctctccctcacacccaacaacaaacccatttccatttctgctgtttttctcaaaccaacaactctgtcgtcgtctcgcttcgttccccacgtcgtggtgtcgtcggatttggggcaggaggaggacaccttcagtgacggagacggccccagcttctcccccgaccttaagctctttgtcgggaatcttccgttcaacgtcgacagcgcgcagctcgcggagctctttgagagtgccgggaatgtggaggtggttgaggtgatttatgataagactactgggaggagcagggggtttgggtttgtcaccatgtcttcggttgaggaagctgaagcggctgctcagcagttcaatggctatgaacttgatggaagagcattgagagtgaattctgggccacctcctgctcggaatgagagtgctcctcgttttagaggtggttcttctttcggttccagaggtggtggtccttcagatagtgaaaaccgtgttcatgtaagtaatcttgcttggggtgttgacaatgtagcacttaagtcattgtttcgtgaacaagggaatgtcttggaagctagggtaatctatgacagggaaagtggacgatcaagaggctttggatttgtgactttcagtagccctgatgaggtcaacagtgcaattcagtccttaaatggcgtggacttgaatggcagagctatacgagtctcattagcagattccaagcccaagcagttctgaggatttagcttttcgtctatacccgagagaggatttcggtatttgggacttgggagttatacagctgcaagatgtcattggcaaaaacagtttgggaaagaaatacacttacatgcattgagactacatgtacacagtttcaatatctgacaggcttcttcctagatgagtgtctgttgaaagtttaaatgtatgttccaaatttgatggttgtcatttgaaactgatttgtagtccgtattttcactatagaagtagatgtctcaaatttattggttaccccgttccaatattgttgtggaagaattttataatcgtgatgtgcctggaaaattatctaccacggatttatctgttggttc

SEQ ID NO: 179 - DNA, 1161 bp, Glycine max
gcagaagaagcgagagagagagaagaaagaatcaagcttagtcaaagtgtctgtgactgtcacacacagtctttaagatctggaagcgcttctcacttgcccacaacaacaattcctctcaatttcaaaattttcagcttcaaaataataaaaccctaagagaggggttgcaagcaaaatgagaagcgcaaagatgtggacggttttgatgtgtctgatggtgagcttcttcgctcgcattgaatcgctgtctgtgacggtgaacgacgtcgagtgcgtctacgagtacgtgctttacgagggcgacaccgtttcggggaactttgttgtcgtcgaccatgatattttctggaactccgatcaccccggcattgatttcacggtgacatctgctgcggggaatactgtccacaatatcaagggaacctctggtgacaagttcagttttaaagccccaacacatggaatgtataaattttgttttcataacccttactcaacacctgagactgtttctttctacattcatgttggtcacatcccctctgagcatgatcttgccaaagatgagcatttggacccaattaatgttaagattgctgagctcagagaggcactagaatctgttacagctgaacaaaagtacttgaaagctcgtgatgcgagacatcgccatacgaatgagagcacaaggaagcgtgttgtattctacactgtgggagagtaccttctcttggctgctgttagtgcactgcaagtcatatacatcaggcgcctcttcagcaagtcagtggcctacaatcgtgtttgagtccccttcatgattaacgttatggtttccttcattagcaacaggattaggtttattacatatgcgttctctattcaacagtacgattacaatcccttggtgaacactttttttcttttcaagagagactccacttgtatgttgatacccaacaagatatttaaattccttacaacttgaatttcaatggattcacagaaatcaaaccgtgtgggaatcaatgctaagtttgtaaaatggtagtctgagttcttaaaatggttgaaaacctgaaagtaaaataagacgttttttgtaattctaagcccatactgcttatttttaacctgttcttttatgattttgctctc

SEQ ID NO: 180 - DNA, 913 bp, Glycine max
tgtgcagtggtgatcaaccataaacttattcaccaaagagaaaccaaaaggctcaaaacacaaccatgatcaatcatgctctttgtttcttagtattcctatctgcactccatgcaacacatggagttgaatacactgtcactaacaacgcactctcaactcctggcggcgtggctttccgtgacaaaataggggctgaatacgccaagcgaacacttgactcggccacccaattcatatggaggatctttcagcaaaacaacccttctgacagaaaaaatgtgcagaaggtaagcttattcgttgatgacatggatggtgttgcatatactagcaacaatcaaatccatctcagtgcaagatacgttggaaacaataaaggggacgtgaaaacagagataacaggtgtgctgtaccatgaaatggtgcacgtttggcagtggagtgggaatggtcgtgctcctggtggattaattgaaggtattgcggactatgttaggctgaaggcaaactatgcacctagtcactgggtgaaagcagggcaaggacagaaatgggaccagggttatgatgttactgcacgctttttggactattgtgatagtctcaaaagtgggtttgtggcacaacttaacaagttgatgagaactggttatagtgatcaatacttcgttcagttactgggaaaaccggttgatcagctctggcgagactacaaggccaagtatggcaatattgcctaataacctaagagctttttcatttaaagaataagcgagtatatcgcaatgtttttcaataagattgtatcagctctaagattctgctattacaagttttggtgttttatttaaaataaaaatattctgagtttttaaccataagcatgacaaaattagaaaaacaaacggat

SEQ ID NO: 181 - DNA, 1173 bp, Glycine max
ctcttccaaattccacacttttccatttcccaaacccaccctccaatccatggcttccctgaacctccttccccaccctccacttttctcttctttccttcacagaccacactgcaacacccatcttcttctcacaccaaaaccttctcaacgaaggccttctcttgtggtcaaatctactgtgggtgtggctgatccttctccatcttcttcttcctacgctggggatacctctgattccatctcttctttgaagctcaatctgctgagtgctgtttctgggctaaatagaggccttgctgcaagcgaagacgatcttcgaaaggcagatgatgctgctaaggaacttgaagctgctggaggacttgtggatctctcgcttggtcttgacaatttgcaaggaagatggaaactcatttatagcagcgcattttcgtctcgaacccttggtggaagccgtcctggtcctcccataggaagactccttcctattactcttggacaggtttttcaacgaattgacatcttgagcaaagattttgataacatagtggagcttcaactaggtgctccgtggcccctaccaccccttgaagcgactgccacattagctcacaaatttgaactcataggatcttcaaagataaagatagtatttgagaaaaccactgtgaagacagctgggaatttgtcacagttgccaccattggaggtgcctcggattcccgatgcattgaggcctccatctaatacgggaagcggtgaatttgaagttacatatcttgactcggatactcgcatcacaagaggagacagaggcgagctaagggtctttgtgattgcttgagttcctggtgaatgcaactatgcactatgcattttctctgttggacttaaaaaaaaaaaggtttcaacaccttgtgccatcattttgtttagttttttcctcctgatggtatttgttctaagttcttcaatattgtaaacatgatggaattaaactctactatatagttccaaggaagcagggtactttttgtttaagtgtaacatatttcttttttaaggaataattgcttacagatcattagatatggatacttgaatacactgttgagagaattccccttcagtcttagactctgttcgcattggtataatgtttttttttta

SEQ ID NO: 182 - DNA, 1140 bp, Glycine max
atcggaatttcagtggccaacactgaatttcatagcttgaatccaagttgggaagaaaacaatggtttcagcttcgcttcaattctggtcttggatagcacctactcctatatcccaccgttacacccataaatttgcttccctaacctcactcaaattagccactcctgtttcttctactaataccgtttatcttcccaagcctctagttgtgcgttttgctctaactgagtccgactcgcccaaatccatagaacctgaccctcaaactcttctccaagaaattgctgacagttttgatcttccttccgattacttttcaaagcttcccggcgatcttcgattagacctaaacgacgcggcgttcgacctttcaaacggacctgttttagatgagtgtggccaagagttgggagagactttgctgaatctctctcgagcatgggaacttgctgacacatcaacctcccactctttagtgaaaaagctccctttgattgaggccaagctgacgggttatgccaaatcagcacttggaaagcgtttggtatctgccggaagaaggtttcaatcaatgggacagtatggccaaggtgagctgcaaaagattgcaaaagcaatgattgcagctggtagagttctgactgctagttcaacgtcagcagtgatagttgaagaacccaaagaggaagctagggtgctgaaatttggagaattgcaggttgaagtaaccccagataaggccaatattggggctgtaattgggtttctttttgggattctttgttggcaaatagcgcggggagttcaaaacgttcctgacagttcattgcagtatgcaaatgacaatgctttgctgcttgctaagtctttaaagggagcattgcttgctatattctactcctcaacgttcttgtctgcatttacctcggtgggacttgttctacttgggttacagctcaaatcaaagaaaaataaagattgagttctaggtgtgcccttccctcagttttgcttgtaaatggagtagatgcacggtctacgtttgtgagtaataattgtatattattaaagtatctaactcatcacatggttgtaaaacaatgcacatagtagcaatacttttgttcaacttggacc

SEQ ID NO: 183 - DNA, 629 bp, Helianthus annuus
gacggagtcatagaatatagggtttaaatcaagctgaaattcagatctaaatttgacgccgacagttgtaccaacaaccgctatcaccgtcgcaaaatggccagcaccgtcaccatttcttccgttttcatcatcctcttaaccattgccaccgtcttcacatccaataccgaagcatcatccgtcgatttcgtcaagaaaactgtctcttctcaccccattgtcatcttctccaaatcctactgtccgtattgtaaaagggcaaaaggtgtattcaaggagttgaatgtgaaaccttatgtactcgagctcgatgagagagaggacgggtcgaaaattcaggatgcattgagtgagatggttgggaggcgtactgttccacaagtgtttatcaatgggaaacacctcggaggttcggatgatactgttgaagcttatcagagtggagaattggcaaagcttcttggcattgagagtcataaaacggacctttgagcttcaagccttagacagcctaataatgccgtaatttgtacgaatgttggtagtttaagttgacttgagtttacgattatgtcaaaatatgtaccaataaatttggatatgataccgtttgtattacatattcg

SEQ ID NO: 184 - DNA, 1969 bp, Helianthus annuus
agccctgacccccctggtccgaaaaacacaccacatctcttcaattttcaatttcaatttcaatttcaatttcatttcaatttcagtttcaatttcaacttcaatctcaattcaaattcttgtttgattcacgttcttcatattcaaattcaaaatcagttaatcaccgagttgttgaacagatcgtacatttgtgtatcaaactataaacacattctccagatttgttccgtgaaaaaccctagatcattcaacagatttgatccaacggttgcagatttcattcacgcaagctgaggcaattcatttcccaatttattaacacaaggtggactcattagtgggttttggagaaagtgttggtgtcatgcagttggctctttagagtctaaacacccccttgcttacgtaatctagaaatacccttgtcacatagtggtatttgatctatgggcgagtgggtgattggagctatcatcaatctttttggcagcattgccattaactttggaactaatcttcttaaattgggtcatgatgagagagacagacacgcgatgctaggtgaaggtatagacggaaagacaatattgaggcctattataagtttccagtcttggagaataggtattctatttttcgcttttggaaacgctcttaactttatttcatttggatacgctgcccagtcacttcttgcagcattgggatctgtacaatttgtgtcaaacatcgcatttgcctactttgtcttgagcaaaacagtaactgtcaaagtattagttgcgacaatttttatcgtcctcggaaacacctttcttgttgcatttggcaatcaccagtcacctgtttacacacaggagcagttggcagagaaatacagtaacattaccttcctttttaactgtctatttttggtggtagtggttgtcatgcatcactacgtatacaggaggggagaattgctgcttgctatcccagagaaagaacttacgccctactggaaactactgcttccgttttcgtttgctgtcgtttccggggccgtaggatcgtgttcggttctttttgcaaagtcactttcaaatcttttaagattgtccatgtcaagttcgtatcgcctggatagctggttcacgtattcgattcttgtattgtttctatgtactgctggattttggatggcaaggttgaatgaaggattatcacagtttgatgctatacttatagtccccatgcttcagatcgcttggacctttttctcaatttgtactggatttgtgtatttccaggaatatcaggtctttgatgcgttgaggactgtgatgtttattctaggaatgatttccgtattcataggaatttcattgctggcacccgatgactctaaaggagaagtcaaggatagtccgtctccctcatcaaaagtcaacacggatgtagaaaggttgattgaagactcgtcaatcaaggatatgaagtcgcttgcaagagcaatggcaacaaaagcctcagctgcagttatcagagcaaagagtgcttgcacgctgttgttgggaatgggagacgacacaatgcatgcatcatcagtttttgcaatgcctatggtttcatccaaaatgacgggattcagagcagtgaacggtgaccggtcaaagttgctgtccttgagaagcccatcgggatggaacaggatcccggtggtggaagaaactgtaaatatgatggacagtatgtcgagtgaagaggattagtacacgggattgtatgggtgttatgtatgtcattctaatggaaggagtgtggttgttgtagtaatggggaaagaggaaagcgcgacgtgaagcgaatgtatagttgtttgattggttggattgaatttggatgtatatcctctatgattcttaattttttggggccaattgtaggctgtgttttctggcaaaaaattaagaatcatagaggatat

SEQ ID NO: 185 - DNA, 1062 bp, Helianthus annuus
caaaatgagaagcctaaaatgtgaaaaaagaatattcaaacaaatcaaacaactttacgaacaacaaaggtttaataaataaattcttcttgttggattctgaaccgaattcatagaatatgaatccaatttcatcgcaaccaaatcattagtcaatcagtagttgatggagaattaaaggaggttttgattaaaaaacaaaagcgttcgttcgtaaaatttgattaatcaatcataatcataagaagtttgaagtaaatcaatgggggatttgtcgagacggtctggattacgaggaattggtacctggtttaccaagcaggttgttgagccgtttgtggaaatcatcagcaggggagcacagcctaaggagttggcactctctgcagctcttggaattactctaggagtgttcccaattgttggagtgacttttttcctgtgtgtgctggctataacaatgcttgggactgccgtcaatgctccaaccgtcatgctcgccaattttatggctactccaatagagctgagtttgataatagtgttcctacggtttggtgagtttattacgggtggagctcattttcctttaaccgctgatgctttaaagaaggtattgactggcaaagcttcaaaggagatcttgctaagcattgttcatgcgttgttggggtggttggttttggccccttttatccttggcctactgtacatagttcttgtaccatgtttcaccatgttggttcgtagattcagtccttccatttccctggagaatgaggatgaagcgtcgtataccgaggtgatgcttaaagtaagggatgcttgatgtagggaaatatgactactactatgttgtttggtttcacctgtacatgtatattttgtatctttagtgggtggttgttattcctagcaatttcaaaggatataaaaaaagggacatcctttaagaatactaatgctaactgtatgataaacgtatgttgacatcttggtcaaattgttccttttttgttagttttgttttaatatgagtgtatgataattagaggggtgaat

SEQ ID NO: 186 - DNA, 1501 bp, Helianthus annuus
accgatgacttaaaactccaaaatgccacccaattctctctcaccacttttccctctctctactcctctttaaaaaccacttacattcacaccttttcatctctctctgcaaaacaaacatggaggagataactaatggcggcaacaaaaacgaaccacagcttctgaagcttaaatgttccgtacagaactacgactggggacgaatcggttacgattcgcgcgttgcaaccctgtttgagaaaaattgtggtgttcagattgatgagaagaagcattatgctgagttttggatggggactcatgtgtccggaccgtcggttgtggatgctggtgatggtgataatgtgagtttgaaggtgtggattgtgcaaaaccctaaggttttgggtgatgttgttgttgataagtggggagttgatcttccatttttgcttaaggtcctttctgtgggcaagtcattgtcaatacaagcccatccagatcaggaattagcaggattccttcataagacgcaaccaaatgtgtataaagatgcaaatcacaagcccgaaatggctctggcattaacagagtttgaggcgttatgtgggtttataagttcagaggaacttgatgttgtgcttgaaactgttcccgagattaatgaagtggttggcaatgcaagtgcaaaccaaatcttaactgtcgacaaacacattggtgaactcaaagaagaacgcgctcttcagtcaatattcactaaactcatgtcagttgaccaagaggttatttctgaagcactatccaaattagtcaaccgtctaacccatgaaaaagagaaagggcggttacctagtaaagaagaactagtgttgaagcttgaaaaagaatacccaaatgatgtcggggtgttagccgcgcttctctttaatcatgtcaaactcgaacccggtgatggtttatacatagcagcaaatgaaccacatgcgtatttgaatggtgagtgtatcgagtgcatggcagcttccgataatgtggtccgtgccggtctcactccaaaatatattgatgttaaaaccctctgctccatgctcacatataaacaggggttacctgaaatattgaaaggtgtaccgatgaaccaatatgtgagacgatacacaccgcctttcgaggaatttgaggttgaccaatgcgtgcttgaccaaggcgcgtcagttgtatttcctgcacttccgggcccgtctgtttttgtggtgatttctggagaaggaacgatggcgacggcatcacgtgaagatcgagtgtcggaaggcgatgcgttgtttgcacctgcagggaccgaggttcatgttagtactgatacagaactgcagctgtatagagctggagtgaatcacaaggtgcttttgaacccttgactgatgaggatggaagaatgggtcactagtagtttatgtaaatctgtgtgtcattctgtttacagaataacggttttaaagttatagtagttgtaatg

SEQ ID NO: 187 - DNA, 885 bp, Helianthus annuus
ggggaacaagtaattgaaaaaagtttatcgatttcgaacgagaaatgaagcagccgatgatgcccaatccaatgatgtcttcatcctttcctcctacaaacatcaccaccgatcagatccaaaagttccttgacgaaaacaagcaattaatattagcaataatgaccaaccaaaacctcggaaagcttgctgaatgcgcccagtatcaggctctactccagaagaatttgatgtatctagcagccattgccgatgctcaaccaccgacaccatcaccagcaccgacaatttcatctcagatgggcccacttgcacacgcgggtatcccacaacaaggagggtttttcatgcagcatcctcaggcggctgttatggctcaacaatcttctagctttccacaacaaatgccagccatgcagtttaatagcccacaagttatgcaacctcagatgggtgttaggcccggtgggccaagcgggccaagcagtgtgccgccaagctcagccgctagtgatatctggagaggaggtatgcaagatggtggtggcgctgacggtagtggtgctggtaaagatggtcatggtgctgcagccggtggaccagacgaagcaaaataataaaaatgaggggggttgttagtcggatggatgtggataggtggtctgttatggtagaactagaagcttaatatgtgatctttaccaaagttcacgagcgatgaactttgtgtatgtgtgtgtgtgtcttctttagaaatggctagttatgtgtttgttttacagaattagtgaggtcttaatgaaaagagtgcatgatacttctttaccgtttttctaagctaatattctgcaaggcaaatgggtaatttggtcttatcttaaaaaa

SEQ ID NO: 188 - DNA, 1733 bp, Helianthus annuus
tctcactccccatacacacagatctgcctgtagatctagcagcagcaatgccgtttctggattccttaacggcgatatcgctgttactgttcgttagggttttaaccgttcatgcttccgttcataattacgccggagttaagttcgccagaaaaggaaatgcgtatgtagttcatggaggaagtgaaggaatctattactcgcatccgaatctcaacggttctgatgcatcttctaacggcgatgcgtatattaagtttgaagagatcatatttagaaggccacaagaggcttcaaatttcagcacagggatgatatacgccattctttttgaggtagatgacagagaaacaataggcggttcagcctatggaggccaaagagccatctgctgcacagcagatctagcaaaattgggtgcgtgtaaagaaggcgaagttattcaccgcctgtcaacatcaaatcccgggtggcccgaaattttcggtgtctcatttgatgtcaatgatgaaacttccactatgcaaccaagatctgtacaaatcacaagaacagggatgtataatttgtacttcatgcattgtgaaccgaggctagctgatatggttgtagaaggaaaaaccatatggaaaaatccgaacggttatctcccgggtcgaatggcaccacttttgaacttctacgggttcatgtcacttgcgtttttagttctcggaatcttttggttctctcagtatgcgagattctggaaagaggttttacatttgcaaaactgtataaccttagttataacattgggtatgttagagatggcattgtggtattttgattatgcagaatttaacgaaagtggggtgcggccgacgggtattactatatgggcggtaacttttggcactataaagcgcactatttcgcggttaattattttaactgtttcaatggggtatggtgttgtaagaccaactttgggtggtcttacttcaaaagttgtcatgcttggaggaacattttttcttgcttctgaagtgcttgagttggtagaacatgttggtgctgttagtgatttttcgggaaaggcgattctgtttttatctctacctgtggcagtcttggatgcattttttgttttatggatatttacctcactttcttcaactttaaataagctacaggctaaaagaatgatggccaaattagatatatacaggaaattcacaaatgctttggctgtagctgttattgtatcagtcggctggatatgctatgagctttattttaagtcaactgatatatacaatgagcaatggcaaaacgcttggattatacctgccttctggcatgttctgtcattctctcttctttgtgtcatatgtgctctgtgggccccatctcaaaattcaatgcgatatgcgtattcggatgacggaagtgaagagtttgacaaggatgatacattgactctcataaaaccatcccccgttcctatttccgcaaaggatgtaggtgatgtaagatctgaagatgatgttgatttggaagaagataaaacagagtaatttatcagtcttttgtatgcttatccacttgaaatctgttttgttatattttatagaatttagactaagtacgttattagatgtatatttacaaggaggatttaaacaatttgaaatcagaagttgaggtctcttgtgtaaccagccttttatttttttgttcgtatattataa

SEQ ID NO: 189 - DNA, 1191 bp, Helianthus annuus
tcacccatacaatgcatcctctttataataaagttaaaaacacactacacaaaaccctcccttcaaaaccttttctgggaataatgtgtctcctcctcctccccttcatcatcttcctccacctccttccggccaccatcccttccgcagcaccaccgctccacccgggttactacgccaattcttgcccaaatgccgaactcatcgtccgaaacgtcatgaaaaaggccatgatccgagaaccccgaagcggagcttccgtcatgcgatttcaattccatgattgtttcgttaacggatgtgatggatcgatgttgttggatgatactccaacgatgctcggagagaagctatctttgtcgaacatagattcgttgcgatcgtacgaggttgtcgatgaaatcaaggaagcacttgagacggcctgcccccggactgtttcttgtgcggatatcattatcatggcctctagggatgccgtcgctctgagtggaggtccggattgggaagtgaagctgggaagaaaagatagcctaaccgcaagtcaagaggatgccgatgccataatgcctagtccgcgagcgaacgcaaccaccctcatcgatctctttgccaagtttgacctctcggtcaaagatttagtagccctttcgggctcacactcgattggtaacgggcgttgtttctccattgtgtttaggctctacaatcaatcaggcacaggccgcccagacccctccatcgagccaaagtttagacaaaagttagacaaactttgcccacttggtggtgatgggaatgtcacaggcgatttggactttacgcctcgcatcttcgacaatcaatatttcaaagatttggtaaatggaagagggtttttgaattctgatgaaacattgtacacttattggaaaacaagagagtatgttaaaaggtatagtgaggatcaagatgagttctttagggactttgttgaggggatgattaagatgggcgacttgcaatcggggcggccgggggagattcggaagaattgtagggtggtcaacggtggtccaccgatggacttggtgatggatggatataaagataggaggatattgagttattagagttgagttgacacattatgtatttatcatgaatacggataatgtagcatatggtgtcaactcaactctaataactcaa

SEQ ID NO: 190 - DNA, 1746 bp, Helianthus annuus
catacatgtttttgtgtctttcatccatcatttcctcttaaagcttatctctcttcgtctgttcatccattcactcatttcatgaccatcaatttgtaaacaaaagcatcaaattatcacgttttcatcatatctggggttcacaattctcgccatgccatgcgttcttctgctactgattttcggtgtttagagcaactttgggctggaattatgtgaaatgagccaaatgcgtgtgtttgtgaaggggttataaagttaggatatgggtaatttgttgctccttgattgattgattgttgttgatgaaatttagggtttttcgttgttggaatttctagtacattgtttagggtttaatctgcattgtttacggttttgtttgctttgaaggtgttccttggaaaagttgctctttaattgtccgttagtttacaaagaaagaaagaaagattccacaagttacaacggtctgcgattctgaagctttttttgctgaaaggcttattttggatcccatctcgaggatctgattttatcacatttatgcatcatcgatggggcttccatttcgaagtctctcgatgctgcttcttcttgtactgatttggtggtcaacaagtgaagctcaaacacacagggctcttgatgctattctccaggactatgcttatcgtgcatttcatcgacccagaactggccgcccctatgatggggtcccccctgcaaatttgtccggaattcagatatccgcattgaggcttcgaagtggtagcttgtttactcgaggtgttcgacagtataagcagttctcaatcccagttggggtcattggaaatccttatgtggagaggctggttctggtgtatcaaaaccttggcaattggtccacaaggtattaccctttgcctcctggatacatgtatctagcacctgtattgggtcttcttgcttatgatgcatcaaacttatcggctacaaacctggaagaactggatattcatgcctctgaagatcccatctcaatagagtttactcaagtgcaaccagtgcgtgatgcacagtgcgtgcggttcgatctagatgggcgtacaaacttcacaaaggtggtgtctggcaacaagtgtctgacttacgaacaagggcatttctctattgtagttgaatccacagccccatcgcctgcaccagtgacgcaaccaccaccacatcaaggcggtggggggaagggttggatcattggtgggtctgtactcggtggggttgcattgttggtgttgttggcattgctgatcctgtgggtgtggagatttaataagaggaagaaagtgcataaaatggagaaggctgcagatgctggtgaagcactgcatatgaccgcagttgggaacacgaaagcaccagcggctacaaccactagaacacagccaagtctggaaactgaatatgttccatgaacttcatattctaaggttggttggttggttcattctttggtaaagttgcgggtgtcctgtgtgtgtgaattattcaatctcacaaaagctgttcatagtttgatgatttgttgtgtgcattctaggtgtttagtcaagagtgattctatttatggtaatttttcagtgaataaactttcattacaatatttgaatcttttgtagcaatcaggtgtttttgtatattcttgatcttgaaggccaagttgtaacgattaaaagaatttagactgcttttgatttgtgcatt

SEQ ID NO: 191 - DNA, 1112 bp, Solanum lycopersicum
gttttcaaaaaaatttcaccatgagaaccagtaatcacttaataggtttactaaacttcttcactttcttagcatcaatcccaattttaagcggtggaatctggttaagcagcagagcaaacaacacagattgcttaaaattccttcaatggccattaataataattggggtttcaataatggttgtttctttagctggatttgctggttcttgctacagaaacacttttttaatgtacatttatctatgggctatgttcttcatcattgctgcattaattggatttgtgattttcgcttatgctgttactgataaaggttcgggtcgacccgttatgaatcgggcttattccgaatattatttacaagattattccggttggttggaacaaagagtttcgagtcaaaactactgggtaaagataagttcgtgtataagggattcgcgaagttgtggtaagatgagaaggatttacaatggagctccggagagtgttgagatgttttatcttaggaaacttagtcctattgagtctggttgctgcaagcctcctacagaatgtggctacgtttatcagaacgagacggtttgggttcccggaggaggactagttggagctgatccagattgtgttaaatggagcaatgatcaagaacagctctgttacaattgtgactcttgcaaagctggtgtacttgctagccttaaaaagagttggagaaaagtgtctgttatcaacatagtcatattgatcctccttgttatcatgtatatggttgccatcgcggcatttaggcacaacaaacggatcgataacgatgagccttatggagaaacaaggatggagaaggctcaacctagcaggatacacttctaaaagagtcacaacagagtaaagcttgaaatgtatttttatgtttaattttggtaagttttagtagtctttgtttatatctcaagaaaacacagattgtaaatcttgtattcattgtggtgtattttcatttaattaaattctaaaactatctaagtttggttttgatgttgttttgttccctttagtgtagcaagcttgctatgagagttgagtaattaaaatagatctgttaag

SEQ ID NO: 192 - DNA, 1533 bp, Solanum lycopersicum
gaaaggagtaggcccaatgttgaaccacggagcaacaaccatcttcgttataattaggaagagcttctctcaaattaattaaagataaaaatggaggccactcgcagttgctctcaggctcacctccctttacaatccatctctttccctcctcaattctacaaaaagttccaattcacgaaatcgaagccttccaactctcatccacgcttggtgattgcaaaggccttggggaccggcgataatggtgactttgaacattttacagctacacctaacaagatttttatggaagaggcaattggtgctgaatacggagaaggtttcgagacatttagacccaatggactgctcaaagttgatgtggattttttaaatgatagactgcaagagggtttcctgcgaagaatccgttatgcgatgaagcctgatgaagcttatggcctgattttctcttgggataatgtggtggcagattctcgagctctgatgttggatgcctggaatcaacttgcctctgaagaaggattagagcttcctgaagatgatagtgtgcagcggctgttactttatgcaactgctgaccatattctgcataaggcgctggcaggggagaagaatgaagctgatcaagatagattgaagacgagactttcccatctctatcaggacaagcttctcaaaatttcagagccaattgaagggttaaaagaatggctggatgctgtatcaactgctcgtatcccttgcgctgttgtgtcaagttttgatcgcagaaatatggttgaagccttagagcgcatgggactcatgaagtacttccaggcaattgtgacggaggaggacggaatggagtctatagcacatagatttctttctgcagctgtgaagctggacaggaagccatcaaagtgtgtggtatttgaagacgatcctaggggcataactgctgctcacaactgtacaatgatggctgtggcacttattggtgctcacccagcgtacgatttagggcaagctgacctagctgtaggtagcttcagtgagctttctgtgataaatctcaggagattatatgcacataaaggctccaactttatggacctagagaagcaaatagcggaaaaagcaccgcgcagaaggaagctcacaattgacaccattttctgaaccagtttggtacaacagtctaccacctccttttcctacttgtaaatgcccttttagtgttagaatctgtaggtcttgccgtcctttgccttctttcattcttgagataaatagagctggcagaagatgatttcccttggggtaatctgaaactcaggtgtccttttcttgtcttcttttctctctctcttttggggtttctgcttgttcgtgttatcaagccgttattcaaactgatatctaccagcactggtggtggaattatgatccatgtcgcaactaaatagttgcttttaggtgcatgcaatattgtaacttttgccaattatatataatatatgaaaagattgaacttatcttctt

SEQ ID NO: 193 - DNA, 1284 bp, Solanum lycopersicum
gaatttctagactctgctgtttgtgagaatatgcagagaggaagaggggacaatttcaacagtccatttggagggataatgtcaagtatatttggatttggaggaagagacccattcgatgatccattcttctctcgcccttttccaaacttgtctcggacctccatcttacatccaacaactcctcatgatgatgaatctaataggccagtcattcaagagattgatacggaggatgatgatgaagatgcaccgctagaaccagatgaggagagcggggacgtgaatggctgtaacaaggaaagagatagggcttatgctaacagaaatccacttgttgaacatcctgaagacctaacggatgaccatagcaagagcagcaagatcataagcaaagatgtgactcgtggaatggaagacatgaaattggaaggaacacagtctaagcctcagagcatgagctatagaagagttacatatggtggaataaacgggacatattacactgccacgaccacacggagagctggaaatgatggaagggtgttagaggagagcaagcaagcagatagcacaacgggtcaagcaacacatagaatttccagaggaattcaggataaggggcactcgttgacaaggaaacttgcctcagatggtaaggtggatacaatgcagactttgcataatctagaagaagatgaattagctggctttgaacagacatggaatggcaatgctaataacgaaatccctggatggaatagtggatttgatttccacgcaaatgcaggaacaagcagtaattggctgacgaactgggaagctggattccgagatccatttagtggtgcgagaccaagtgacaacagtgctcagagtgctcagcgaaggacgcaaagtggaagaccaaagaaggttgttcggattaatatagagtgaatgtacgcgttcaccggattgatatcgagctatggaatggtgaatttcctaggtagaagactactatatttgatggtttagggtcttggtgagaggtaataaaagcagttgtaggtctataaagaagggattgttgtatctgggttcggttgtaatattaatgctttatccagagctgtatttgtatttgttcgactttacatcatacaattgattaaatagtactctttcaagctatatagaagaaaaaaacaagtatatttagtgaaagtatccgttatgggatgtcaaaagaacaagagtaaagggtcgaaaacataatttaagagtatttcaattttgtga

SEQ ID NO: 194 - DNA, 2316 bp, Solanum lycopersicum
cttcaaacctaaaaatagctcaataacacatcaacatctccaactacacgacagcccaccatttcgatggcaatttctcctcaaaataaccattatttaggatgactctcaactaatcttattgatcttttttggccttccctttcccccttttttcgcaaatcttcaaacgaccctttcgatattttaccgcttttcttttttgcaaaattttgaattactcatctggtattttggctttttgatcacaatttggaaacacccatttgataaagtttggttcttttaggaaataattcaactatacggttaaaagtttgctgaatccatggccggcatcgctaccgccggcgacaccagcaccagtaccagcagcaacctagcgccgacgaggagtttgagcaagaaggaaaatcaggggcttctgttgggcaggtatgagattgggaaattactaggacatggtacttttgctaaggtgtaccatgctagaaatgtgaagacgaatgagagcgtagcgattaaggtgattgataaagagaagatcttgaaagtgggtcttattgatcacataaaacgtgagatctcaattctcaagagagttaggcatccaaatatagttgaattatacgaagttatggctaccaaagccaaaatcttctttgtcatggagtatgtcaaaggcggtgagctcttcaataaggttgccaaaggcaggcttaaggaagaagttgctcggaaatatttccagcagttaatttctgctgtcgctttttgtcatgcccggggtgtttaccatagggacctaaagccagaaaatatactgttagatgaagatgggaatgtcaaagtttctgattttggtcttagtgccatttcagagcagataaagcaagatgggctcttccatactttctgtggtaccccggcttatgtggcgccggaggtgttaggaagaaagggttatgatgcagccaaagttgacatttggtcatgtggggtgatactctttgtgctaatggcagggtatttgccatttcatgatcagaatattatggctatgtacaagaagatttataggggtgaatttagatgtcccaggtggttttcacctgaattaactcggtttctaaagcgccttcttgatattaatcccgaaaccaggattactgttcaggagattatgaataataggtggttcaagaagggttttaaacatgttaaattttatattgaggatgataagttgtgtagtataaatgatgatgagtatggtgggattgattattcgtctgatagatcagagtctgagtctgaaatagagatcagaaggaggtcagctagtttacctaggccagctagcttgaatgcatttgatattatttcattttcccgtggctttgatttgtccggtttgtttgaggagggaggagatggggcaaggtttgtatctggggctcctgtgcccaagatcataaataagttggaggaaattgctaaagttgtgagctttgcagtaaggaagaaggattgtaaagtgagtatggaggggtctaaggaaggtgcaaaggggccgttgacagttgcagctgagatatttgagttgacaccatcgttgagagttgttgaagtgaagaagaaaggaggagatagcttggagtatgaggagttttacaacagggaattgaagccaggattacagaatttagcacatgaagttggataccctgttaattcatcgtatttgccatcagatactgaataaagagagagaaggggaaagggtaactgcggacatcttagggaccagttggaggcttcttgcactcaaacggagatctcctgaataccaaaaagaaggaacacatgccaagctagactgatggagcttcatgctagtgaaccttgacatgagttgatgttcgtaatcaagatttcaccacttcaattctagccagcgaggaacatggttcgtagtctaattgtatattagtagccccgtcaacaaggcccctccagtgcgggttagttgatgtagtagtacttactcagaaatttgaaaatggcacaaggaattgtcatagtccagttttaaaatatcaaaaataaaaataaaaattgcaataatgtatttggaccatagaaaaaagaattaagaataaatctggaccactgtgtagtgaatgattgaaatttgaaagctttgtttgttgtcgttagacgtgacactagctgttgctatcaaacttttgtcctcttaccaaaattctgaggcttgttggattaaaagaatctatatctggtcaattttatttt

SEQ ID NO: 195 - DNA, 1611 bp, Solanum lycopersicum
aaagaacaagaacctaccttcacttcacacaaagttgccaactttcttgatctttgacctcaaatcttgaaatgggtatcaagtttatcatgttttcattcattctaacctcacttttcctcattcttatctacatacccactcaattttcccactcacccatcaccatttttaagccaaaaagaagcttcataatctcaaataccacaactaacccttaccctgtaaaatttgcttacttgatctctgcttctaaaggagatgtagcaaagctaaaaagacttcttttttcactttaccatcctggtaatttttacttgattcacttagatttagatgcaccagaaaatgaacaccaagaaatttcaagatttgtaagtgaaaactctgtttttggagaaattaataatgtttgggttgttggaaagccaaatttagtgacatatagaggaccaactatgttagctacaacactacatgcaatggctatgcttttgaagattgctaaatgggattggtttattaatctaagtgcttctgattatcctttagttactcaagatgatctgatccatgccttctctgacttaccaagagatctaaattttgtacaacacactagccacatggggtggaagctgaataagagaggaaagccagttattatagatcctggtcttcattctctaaacaaatcagagatttggtgggttatcaagcaaagaagtcttccaactgctttcaagctttatacaggttcagcttggacaatattgtcgagatcatttgctgaatactgcataataggctgggaaaatcttcctcgaactctacttctctactacacgaattttgtgtcgtctccagagggttatttccaaacagtcatatgcaactctgaggaatacaggaacaccacagtgaaccatgatcttcactacattacatgggacatccctccgaaacaacatccaaggtccctcggtccgaaggattacaggagaatggttttaagcaacaggccatttgctcggaagttcaagaacaacaaccttgtacttaataaaattgatcgcgatcttctcagaagacgaaatggacagtacttctcagctggaggatggtgctccaatgacgatgatcgaggttgtttgaatctacaggttgagaagtatggcgttttaaagcctggaatgggtgccagaaggttgagaactttattgaagaaattggtatctgcaccacattttgctaagaggcagtgtagataagttggaaatgaaagtacttttgttggaaatagatgaaattaattgtggaagaggatgtaatcatccaaagtcaattcttgatagttgtcacagttcagtagtttgtctgagaaaaagaaaaatatagttcacaaatattattttaggtgtgtacatctatcctacgttctctagaccctactcgtgggattattctgcgaatgttgttgttgagtgtaggtcagaagtccagttttattggttcacacagtatgaaacataatgctatatgattgaagattagaagtgctgtatgatgactggttgaattatttctgtcatctgttgttttctactcaaa

SEQ ID NO: 196 - DNA, 792 bp, Solanum lycopersicum
atatttttaagaaaatgtttaaattgctgtttctgttggctatcttactgttgagcagcgatgccgctgttcaagatttctgcgtggcagacttaaaagcaccggaatcaccttctggctattcttgcaaaagtgttacaaatgtaacagttgacgatttcgtgttttctgggcttagtgctgctggaaacacagcaagcattataaaggccgcagttaccccagcatttgcggcccagtttccaggtcttaacgggcttgggctttctgcagcccgtttagatttggccccaagtggtgtcatcccatttcacactcaccctggtgcttctgaaattttacttgtagtgcaaggatcaattactgctggatttgtttcatcagcaaattctgtttatttaaaaacacttaaaaagggtgatctaatggtttttccacaaggattattacattttcaagtcagtgatgctggatatacttctgtcggttatgtattctttagcagctctaatcctggacttcagattactgattttgcattatttgctaatgatttgccaactaagttggttgcggcaacaacattccttgatgaagcaacaattaagaaacttaagggtgtgcttggaggtactaattaagcaacaattgcattctgttacctgttaatcctttaattctgtttttccttgttgccaaattgggtctgttgtattttttctctatggttgttttgtttctttaatgttctgtttgtttggaaatgaactaaacatttttttcccgagtatg

SEQ ID NO: 197 - DNA, 913 bp, Solanum lycopersicum
aacatcttctttcttctcttccgtgaaaatgaggtgtttcactcttctcttgtttttttcatctatagtagccgtggcattggcctctaatgttgaagaggccctgataagccaagtagtagaaattcaccgtctaaggccacaaactggttctgctggttatacagtcccacaattagactgtcttagctggcgcctcgccatcgagactaacaacctacaaaactggagatcagtgcctaaagaatgtacaaactatttaggtcactacatgatgggcaaacaatatcgccacgactgtgaatatgtagccaagcaggctattgagtacgccaaaagcctcaaacttagtggagatggaaaggacgtttgggtatttgatattgatgaaactactctctcaaattctccttattacgctagatctgacgttgcttttggggctaaaccgtacaacgctacaaagtttgatgcgtggatagctgagggaaaagcgccagccattccatcgatacttgaggtatacaatactgtgttgtctttgggaatcaagccaattttcattacagggacgaaacagaatttcaaacaagtaaggattgttaatctcaaggaagctggttataccaactgggcagcgctcatactaaagggagcaaatgatacgggatcagcagtgaaatttaaatcgagcaagagaacagcgttggtgaaggctggatatagaattattggtaatattggagatcaatggagtgatttgatcggagaaaatgttggagctcgtacttttaaagtccctgatcctatgtactacataggttgactctaaccaaattatatcgacttgcttcgatattttaattatgttcctattttaataaatcttaaaagacacacatctttatttttt

SEQ ID NO: 198 - DNA, 1244 bp, Solanum lycopersicum
gggtagaacaagtgtcaaacaagtagaagcttcaaaatctcatctgagcgtcacatgttcccataatcacgccaacaaattccaaccaaagaaatactcaaaaacaaaaaccccttttttccttttctctctgtacagatgaactcatttttgtgctaaatcaatgaagatttataggtcctcttgtacaagttctggtggctgaagttgcgtaatcggctgtggcttccatcatctagcaatggatttttcatttttcggtaatttcccgtggttcaaaccccattctgcaaatgatatggcatcaacagttgcatctactagcaccctaatgcaaacacctaaacaaaatgctcagttttggaaatggactgtgttttcatttcttccttgggctaaagtagccgagggtaatattcaaatgccaacaactgtcaacaagaaactgaaacgacgtccgtctcgtgaaggtgtagactctctagctcgaaagtcagccatacgcttcagaccatatgtttctaaagttccatggcatacaggtccacgagcttttctttctcaacttttccctcgatatggtcattactgtggaccaaactggtcaagtggaaaagatggagggtcaccaatttgggacagaagaccgattgattggttggatttttgctgctattgtcacgacatgggctacgattctcatgatcaggctgaacttctcaaagcagaccttgcattcctcgagtgcttggagaagccaaacatgagtacgcgaggagatcctcatgtagctctactttacaagactatgtgcacatcaggccttaggaacatattgataccttacagacaacaactcattaccttacaatctaagcaactgtgttttggatttggatggctcggcggtatcatggaacctgcaaaatgcttgaaagatcgtttcgtatggttacagaagtaggtatgtgaacaattcccgcgctttcgttatggtgcagaacaagacatttctggcaagtctatttccataatgtcttaagataagatagatgtatatatgatattggaaatgaatggaactgtagaactccattatggtataactagttgtgcagttattccactgtttgtatattattatcagtaaactttggatcaagtgtaaattatttgctattttatagtttacaatgtttggatccagtgtttttttttttgaaaaaattagacttgtgggcaaa

SEQ ID NO: 199 - DNA, 773 bp, Solanum lycopersicum
tttcctaaccttataactcggataaaaggaatagaggaacccaaaaataactatcccaaactcaaatcatgagcttcacattcatcaaaccctctattcctagtcctacatcggaattgctgcaccctttcagtaaatcacggctaaggcattgtccaacctcaccttttggaaataatgcaggcaggaggcaccagattgaaagaaatagggtgaaggcactcccagattggccattaatggcagtattagttgagcatatggaaggtcaaagagacctcataactcataaatctgtttggcatcttagtgatgaagccatgaagaatgtctatacattttacatcatgttcactgtttggggatgctgtttcttcggttctaccaaagatccttactatgattcagaacaatacagaggagatggaggtgatggtactggacattgggtctatgagaagcaagaagacatcgaagaagaagcgagagcagagctgtggcgtgatgaactgatagaggagattgaacaaaaggttgggagtcttcgagagcttgaagaagctgggaagaaggaacagttggtcaaatgatcatctttatatgtgctaagaacaaattttatgatgcttcccagttatgtatatacaatatatgatttccagttctatacaacatggctgttttgccttaattcagtgttatgttgcaaaactcagatttccccttcaaaatgttgtcttaatgaactgtcacaatgtcaacatttgcactgt

SEQ ID NO: 200 - DNA, 917 bp, Solanum lycopersicum
ttaaaatggataagaatcttgatacaaatttggtagaaaaataaaaggaaaaaagaatcttaaattactcagctccagccagcgttgaaaactttgattttcctttaaatacacacaaaaaaaagatcaacagatctgcagaattatcatttttcttctccatagaactaatcttccaaaagggtagtcgctgagagcttggaggtccaatggcgattggtatgaagcagatgtctatgataatagcaacccttggtgttttatcctttatatttggagttatagctgaaaacaagaagcctgcagctgggactgcaatatcaggaaaaggcgttgttatttgtaaatacaagtctgatcctactgttgccttgggctatttgtcttttgtttttcttgctgcatcttctgtggccggttttctgtctttgttttatccgtatcaaggaaagtcagttccacaagctgctttgctgagaaacactagtttcctcgtgttcttaaatattgcattgggcacaactggtttagcagcaacattgttgttgtggcctacaatcaccgagcaacttcatatcacacgcaacattcatcacaacttgcagaccgattgcccaactgccaagaccggtcttctaggtggaggtgccttcttgtctcttgattccgcgctcttctggttggtggctttgatgttggctgataacgctcgtgaggattatttccaagaaacggatatcaagggcgagccgaaagcaagttatgcagatgatgaaattatcaagaccagtgcttaagcctttctactctctctttgttatatgtgttgttgcaaaatgaactttcagcacaaactgtaaaaaaaacatgttttcctgcctttctaagtataataaaatatatggattgttttccgt

SEQ ID NO: 201 - DNA, 707 bp, Solanum lycopersicum
aaatcccctttctcattcaatcggatcaacagtttcaatctccatttttctcgttaatcaagagatcttcatcatggatggtgaaattaagaacatcaagaagtggaacatactgtatccagtttatataaattcaaaaaagacgatagcggaaggaagaagaatttgtgtgacgaaagcttgtgaaaaccctacttgtactgagattagtgattgctgcaacttcctcaaaattccttgtgcaattgagcttgataaggcatatccacgagatttcatgcagagaggaagagtgagagttttgctgaagcgggaagatggaactccttacaaccctgtcattccttcacggaaacagctgatgatcaatgtcgcagagttggttcgaagacatcctaataggactaagaagcaggagcctgcagcctcttctgcagctggttcttcaaagtctggcaagggaggtaaaaagaagagatagtttcagaaggcaacatttcaatttcttcaaactgtttagagatcatagatttatttatctcggaatattttagtccttttattttacttgatttgagaaatgtattgcaaagaagagaggagatctatgagttttcgaagaatgttgccatatttgtatcatcgattgagacatttttgttatttttacagcctaaacttagctcttgattgttaatatttgcttt

SEQ ID NO: 202 - DNA, 1421 bp, Solanum lycopersicum
atctttagtgaaaagtcaaaaccccaatattccttgaaaacccttaacggtgtcgtattttactcgtatcgagatatctagagtggagaggtttgagttgtaggagaggaggaggaagaaatgggaggaggagaagaagatcaacagaaattgaagaacacagcagcagcagcgtatgactacgagaatgatccgagatgggcagattattggtccaatatactcattcctcctcacatggcttctcgttctgatgtcgtcgaccatttcaagcgcaagttttatcaacgatacatagaccctggtctagtggttgagccaatgactaccagcagttcgtcccaaccagcaaaaccatcagctgctcaaccatcatcatcatcgtccacaccttctaataaccagccaagacagcgtaactctggtcaagctagtagaacttcaggcacgccaactactccaacttcaaatccgacatcacttcgctgggaccgaaatactatacaattttcagtgaatgcttgggtttttgttgttgcagttctctcaatatttccgcttacacctgcaaatctgtcgaacagagcatatcgactgtccttcttgggaactgcatgttcttcgctatattcattatactctgtatatgggaaaccgagggcttggaatttacaagcagtgcaagtttggttccagtcagttattgtgacgaaggatttcatctccttcatttactgtctcacatttgtcacttcccatctttacctgaaattttctttgattcctgttttatgccgatcacttgaacatgttggtaaatttcttcgacgtaacttcggcagatcttctttgtacaggaagtacttagaagaggcttgcgtatgggtcgagtcaaacgtaactactctcaacatactgtcttcacaggctgaaattggactgggatttcttctggttgtctctctattatcgtggcagcgtaatattatacaaacattcatgtattggcagatattgaagcttatgtatcatgctcctgctactgctggttaccatcagaatgtgtgggctaagatcggagggcttgtaaatccagttgttcaacgtgccccgttcttgaatactcctatttcaactattcagagatggtggttcaggtaggagacttgctgaaagatatacaagagttttaggggcatgaaatacttttttgggattatactttgtcctgaagggtgactataaaactagaattgtctagttaatattcctaataattgcctgtgggagttacttccatccaagtttccccctttttgggatgtgatttttcctttgtttaactgctttattttgtaaacctaaattctccaagaactctagttttactatctactaattacacttctattcctcttgca

SEQ ID NO: 203 - DNA, 1438 bp, Solanum lycopersicum
ctccctttaattctagtggcttgacctccatcatttccccctccccttctttctaccactaatctcttctccctcactatgtctttttcttacaggtctcaaatattgctagcggctaagtaaaactcagtggaaatgaaagacgattattagctagttaatactaatggataaagaagctgcaaatcatcatcaaaatcatgaaatttctaacaaagatgaattctcaccgaggattaagccgctgcaaaattaccatgttcccactggaaacagtgatcgactgaagagggatgaatggagtgaaggagcagtttcgtgtcttctcgaagcttatgaagctaaatggatactccgtaacagagcgaagctcaagggacaggattgggaggatgtggccaagcacgtgtcggcgcgtgtttattcaactaaatcccccaaaactcagacgcagtgtaagaacaaaatcgaatctatgaagaagaggtaccgatcggaatccgcaaccgccgccgatgcttcttcctggccgctctatcctcgccttgacctattgttacgtggaaataatgcatccgcggcttcctcttcgctaattccgccgccgccgcttccgcctaatactaattgtgtgattgatgccgtcgaaccaccaccacagcagccaatattactacctccacctccggctactcttcctcctcctcctccgctcccgccgtcgccggctttgccttttgggaatggtgatcagaattcgcatgggtctaatggtcttgacagaggaataaaggaagacatattaatggacgccaaattatcggacaacgcagcagcaccagatcagaaaaacgcaacagctacaaatagcagcagcacgccagcactgtacagcgacaacaagagcaagtcgaaattgagatcaaagaataagcgaaagagggccgtggaagggtgggagatcggagagagcatacgtttgctagctgaagtagtggtaaggtcagagcaagcacgaatggagacgatgagagacatcgagagaatgagagcagaagctgaggccaaaagaggagaaatggatctcaagagaacggagatcattgccaacactcagcttgagattgctaagctctttgctagtattaccaaaggatcagttgactcttcattgagaattggaagaagttcatcatgagctagaaaataataataatactctagctagctgtggaaatagaaattaccttgttatcatcttttaatttgatgatgatatccttcttgacccagccactacctaattatggagaacattttatttagattactaataattaacttctatttccattttcttgctgattgtatgttcaaggactttactgtatcacttctccctttatcaatcatatatgaaaaaaaaaaaaaaagagga

SEQ ID NO: 204 - DNA, 775 bp, Solanum lycopersicum
gtggggtttaaggaaggtttttccagccgaaaaaactcacagaagcaaaatgttggggagaagatttatctccttcttgcgtcgctctccatcagcttcgggaaaagtggtggccgaggaagggaaggcaaagacatgggggcgaaggatagtgtcagggaccttgatttgcttaactggaggcgttgctctaagtgctcttgatgatctctccatatatcatagctgcagcagcaaggccttggaaagagccagtaagaacaagccgattatagatgccattggcgagcccattgttagaggtccttggtacaatgcatcactagcagtagctcaccaaaggcaatctgtatcatgtacatttcctgtctctggaccccaaggcaccggaatttttcagctgaaggcagttcgtaatggagaggacaaatggtcatcatttttacgggcaagcgactgggagatactcattatggaagctctcgtccatgtcccggggaatgaagagaagcagcaaacttttcggattaaagtttcagattacctacctccaccagctagtaatgcatgcacggattgcatacctcaggaatcatcgggtaatgtggataagaaatgacctagattcgttcttccatggctccgaggagcttttttctttctccatattcacatcataagaagcatgtatttaggaccctttgaaattttccagttccaaggcaccaaatctatatatttccacattagatcgcgtaattggtgattcttttaa

SEQ ID NO: 205 - DNA, 1929 bp, Solanum lycopersicum
ccatttctagtggttcaatacgcgcttacaacaaaaacaaagctgaagaaaaggctaaagggagaacaatttgaagaaacagtggaaactagaagagatggctaacaatgcggcggcttgtgcagaaagggcaactagtgatatgctgattgggccagactgggctataaacattgagctttgtgatatcatcaacatgaatcctggacaagcaaaggatgctcttaagattatcaagaaacgcttggggagtaaaaatccaaaaatacagctccttacactattcgttcttgagactctgagcaaaaattgtggagagaatgtatttcagcaaattgtggagcgtgagattttacgagacatggtcaaaattgtgaagaagaagcctgatttaaatgtgagggagaagattttgattttgatagattcatggcaagaagctttgggagggccagggggacgatttccccagtattacgctgcatataatgagctgaaggctgcaggtgtagagtttccacctcgagaggaaaacagtgtacctttatttacaccaccacaaacccatccaatagtccacacgccttccgcttatgaggaggctgcagttgaggcctctcttgagtctgatccctctggactcagtgtcgcggagattcaaagtgccgaggggctatcagatgtcctcacggagatgcttggtgccttggatccaaagaaccctcagtccgtgaaggaggaggtgatagtcgatcttgttgaacagtgtcggtcttaccaaaagcgtgtgatgattcttgtgaacaacacagtagacgaggatctgctgtgtaaaggattggcactcaatgacaatctgcagcgagttcttcgtagacatgacgatattgccaaaggaacctcaacaattactgtaccacccagagaaactcctgttgcaccccttatgaatgtgaatcatgaggatgatgagtcagaagatgatttctctcacttatcacggagaacttcaagagatccatcacagggacaggggcggaagactattgatgtgaagagtgagccaatgcgaattactccaactcttcctcctccaccttcatcaaggagaccagtttttacggatgggaaaatggttgattatctcagcggtgacaggtttgaatctgaaagatcaatgggaacagaaggatcatcacctattgctgcttcaactaattcaaacaatgcgagttccatcccatggtcaagtcccaagccatcttcatctgcaccccctccagatgatttgctaaatccaactgctgatgaggacttcttgaaccccactgcatctatgtttactggaaaaaacaaccagaatgaatccaattcaaaagccaaatctgctgataacttgcctccagcaccttgggatgctcctcctcctaccgcaatccctccaccaccagccagatatgatcagagacagcagtactttgagaaacatgtttctggtggctcccctcccgcaagaactggatcgagttcctatgacagcatagttggacaaacaaagaatctctctattaattcttcttcaccatccaaaccagagaaacctgaggacgcactcttcaaagatcttgttgattttgcaaaagccaagtcttcctcatcttcaaaccaatccaatagatcattttaagtgatttcaatgaatatgaataatgtgtggtggggtgtatatctactttttcttcttgtagcaataaatattagagaggactgagttttatggattactggagctgcttcttctgctttattttctgttcggctttcagcctttaggtgagtgatagtgtagctgacatgacatttatatcttggatcatataagatggttaatatttctgtttttttgttttgtttcaactgctaatccaa

SEQ ID NO: 206 - DNA, 753 bp, Solanum lycopersicum
attatattattaaaagataacactacaaaatatgcaaaataaaacacacaaaagatatttgtactcattttcgatattcagaagcccggtaaactttcaataaaaattattattcagattccggcggcttcccggctgttcgccgaccaaaaaccagtaatagcaaaacccagctccggtcacatggacatgccaaaaggagacaaacttgttctaaggggtttaaagtttcatggataccatggggtgaagcaagaggaaaggaagcttggtcagaagttcctggtagatgttgatgcttggatggatcttcgatctgctggtgaatccgactgcttgtccgatactctaagttatactgatatatacagactagttaaagaggttatggaggggccacctaaaaatctgctagaatctgtggctcaactcattgcatcgacaaccctcaccaagtatccagaggtatctgctgttcgcgttcaagttggaaagcctcatgtggccgtccaagggcctgttgactacttgggtgtcgagatcattagatacagaagtcttgatgttcaaaactaggacagtaatatgctttgtattattagcaacttcaaatttctgctgtttgacaatcattttcaagccagtacaatttgatcaattgtcatgactcttgatgcttaattgacttacctttcctgttgcacacttctgcagtgacacaaacttcccaaaaataaaagggcagttcggtgc

SEQ ID NO: 207 - DNA, 2416 bp, Solanum lycopersicum
acaagagtacaagttttgattaggtgcaagtaacaaatcctggctagcctatataacaactttgttttagttctcacaaatataagtctcttgaagaacttatatgccctatataatttcaagctattttcttgagaaagtgagacaaatataagatatgaagagtcgtcttggagttccattcaaaggcatttcagaggatattcgaggacgagtatcttgctacaagcaggattggattgctggaattagatccgggatagggatattagctccaactacctacatattttttgcatctgctctaccagtgatagcttttggagaacaattgagcagagaaacagatgggagcctcagcactgtggaaactttagcttctacagcaatttgtggtatcattcactcgatactcgggggccaaccacttatgatactaggagttgcagaacctactattattatgtacagttacttgtacaagtttgctaaaggtagagaagatttaggacagaccctttacttggcttgggccggatgggtgtgtgtctggacagctctcatgttgtttcttctagcaatattcaatgcctgttctgtcataagtaaatttacaaggattgctggggaaacttttggaatgcttatcgctgtgcttttcattcaagaagcaattaagggattggtaagtgagttcagcatccctaaagctgaggacccaagttcggagaaatatcaatttcattggctttacatgaacggactacttggaatcatattcacctttggtcttctctacacagccttaaagagcaggaaagcaaggtcatggtggtacggcacaggctggatgagaagcttcatcgctgactatggagttcctttaatggttctcatgtggtcatctctgtcatttatcgtgccaagcaatgttccgtctggagttcctagaactctctatagtccccttccttgggaatctgcatctttatatcactggactgtaatgaaggacatggtgaaggttcctccagtatacatttttgctgccataataccagctgtgatgatagccggactctacttcttcgatcacagtgttgcttcgcagatggcacaacaaaaagagttcaatttaaagaatccttctgcttatcattatgatatcttactcttgggatttatgactttgctatgtggtttacttggattgcctccttcaaatggtgttctgccacagtccccaatgcatactaaaagtttggctattcttaagaaacagctgattcggaagaagatggttgaaagtgcaaaagagagtatcaggcaaaaagctagcaactctgaaatctatggcaacatgcaagctgtattcattgagatagatagttctcctattagtgcagtagctaaagagttggaacacttgaaagaggcaataatgaaatgtgaaagtgataatgcaaatgacgaaaagtctagtggtatatttgatcctgagaagtacattgatgcttacttgcccgttcgagtaaatgaacaaagagtcagcaatctattgcagtcactactggtagcagcatcagcgggtgctatgccagtgataaaaaagataccaacttcagttctttggggatatttcgcctacatggctattgacagccttccaggaaatcagctgtgggaaagaatgctgcttctattcatatcccctggcaggagatttaaggtccttgaaggggttcatgcatcttttgtggaatcagtaccattcagatgcattgcaatcttcacaatattccaatttgtgtacttacttgttgtctttggagttacttggattcctatagctggcattctcttccccttgccattttttctcctcataagcataagacaacatttgcttcccaaatttttacaccctcgtcatttacaagagcttgatgcagccgaatatgaggaaatagctggtgctccacaacgcgcacttagcttctctttcagggaaacggagataactcttcctagaactgaaggcgagatagaaatttgtgatgctgagattttggatgaacttacaacaagcagaggagagttcaaagtccggactattagctttagtgaggataagcgcccacaggttatttatccaactgcagacacagaatctgagtgaacaatatttacatggctctagagtgtattgaatcttagagttggtatttgtatgtatccatacatgtagaatgtataacactacaaattgtaggtctagttagtactctactatgatataagatatgtactttatacaagtattttacaattgtaagcaaacgtcgtgttgaaaatgtaaaaactgtttgaaacaagattgtttttattccaggattcgaacccgaaaccttaaaca

SEQ ID NO: 208 - DNA, 875 bp, Triticum aestivum
cctgcaacactcgctacaaaatgaagcttcaggtagccacagtcgcctccttcgtcctggtggccttggccgcggcggcccaggccgtgacgttcgacgcgtcgaacaaggcgtcgggcacctccggcggccggcggttcaaccaggccgtcggcctcccatactccaagaaggtcctctctgacgcctccgccttcatctggaaaaccttcaaccagcgcgccgtcggcgaccgcaagcctgtcgatgccgtcaccctcgtcgtcgaggacatcagcggcgtcgccttcaccagcgccaacggcatccacctcagcgcccagtacgtcggcggcatctccggcgacgtcaagaaggaggtgaccggcgtgctgtaccacgaggcgacgcacgtgtggcagtggaacgggcagggcagggcgaacggcgggctcatcgaggggatcgccgactacgtgcggctcaaggccgggttcgcgccggggcactgggtgaagccggggcagggcgaccggtgggatcaggggtacgacgtcacggcgaggttcctcgactactgcgactcgctcaagcccgggttcgtcgcgcagctcaacgccaagatgaagagtgggtacaccgacgacttcttcgcgcagattctcgggaagaacgtgcagcagctgtggcaggactacaaagccaagtttagaggctgaacgcaccataagttgatgggtccttcacggtgtgatggcataacgcactacttcgaataagacatgtgtgatggcataacacaccatatactgaaatgatcaacagaacatgtcccttacgctctgtagtgaaagataaataaacgatttcactaattcgaaatcgactttgagtta

SEQ ID NO: 209 - DNA, 1937 bp, Triticum aestivum
ggctcctagctcgctcctacccaagccagcccgagctgtaaagcaccacccaggtacacctacgcggcccggcgagatgaagctcccgctgtcggcggggtcgcccgacgcggcgcccgagctggccaagccgtcgctgccggcgacgtggctcatcctgcacgcgctcttctgcgccacctccatggccgtcggcttccgcttctcccgcctcgtcgtcttcctcctcttcctgcccacgccgcccatgaacccgtcggcgcacctcgtctccctcgtcaccccgcccgtcatgctcgccagctccaacaccaccgccaccatcactactacgacgaccaccaccaccaccgtcacgacgaccaccacgctggctgagagcgaggccggcgccaacgcgcaccaccaggtccaccacggtccggtcttcgtcggccgccacgccatccgcgtccgcaagtggccgcacccgaaccccggcgagctcctcaaggcccacagcatcctcgccgccgtccaggaagcacagcgccgcagccgcaaccgcatggccgacccgctcaggcccgtgattgccgtcaccccgaccaccacctccgcgctccaggcgccgtcgctcacgtccctggcgcacaccctccgcctcgtcgacgccccgctgcgctggatcgtcgtcgagcctggccaccgcaccgacgccgtcgccgccgtgctcgcccgctccggcctcgacttcctccacctcgtcgcctccgacggcccctccaccgcgcgcctgcgaatgcacgccctcagggagatacggaaggagaagatggacggcgtggtggtgttcgcggacgagaacggcatcctccggacggagctgttcgacgaggcgcagaaggtcaagtccgtgggcgccgtgcccgtgggcattctgggcgaggacgaaggcaccaaggagtccttcctgcaggcgccggcctgcgacgaggccgggaagctggtgggctaccacgtctcggaggagacgctgctgccggcggcgcggagcgacatgctgctgtccacccggctggagtgggccgggttcgtggtgaacgcgcgggtgctctgggagagcgcatcagagcgtcccgagtgggtgcgcgacctggacgccgtggacggcggcgcgcacctggacagcccgctggcgctggtcaccgacgccggccaggtggagccgctcgccagatgcgcccgggcggcgctggcgtggtcgctccggtcagacgctctgcatgaagtcaagttcccgcatgagtggaaatttgatgctcctctagtaagcgccgcttcgcgtcagcagagcagcgtagtaaatactgaagatggtcactagagcagcaaaaattttgtgggcaatagaaatcagggcaaaatcagactgctacggctcgtctgatttgtgtgagtctcctctgatgcatccttgtaccaagacatctcaactcttgagtaacataaggcagctcagctcatttgttgggaccctacagaaagtcacagaccatacatctgaatccatgttctgtatcatcctgtaaaaatagataaaaaaagtttaattatatgcaccattcatggcttctctaataggaagagttctcttaggcgcattgttttcgtgtaatataggtcagagctgatgggctcgccaaattggtctggggttaagacatttgtttgtgtaatggtgtgaaataataacgatccagctctcagttttctaatactccctttgtcctacaatgcaaggcgatgttgcaagttatgttgcttgcaaaaacgtcttatgttatgggatggaaggggtactatatacatttttttcttttatataaaagaggaggcaaacgatctgcctgcttttcattagttaaggagagtgaaacagagtatcatgagttaaa

SEQ ID NO: 210 - DNA, 2407 bp, Triticum aestivum
ccgcggccaggtcgtgtcagccgagaagatagccgcgacgagtgttttcctcagcggagagagggccaagaatggcggcgctggccgccgccgccgcttttgccggcctcctcctcgcccttgcgcccgtggtcggggccgataccgacgctgccggcgtttcggctcttgggaacctctacacctcctggaacagcccggcccagctcgtcggttggtcggcggccggcggcggcgacccctgcggcgccgcctggatgggcgtctcctgctcgggctccgccatcacctcaatcaacctttctggtatgggattgaatggcactcttggctacctactgcccagtctagtggcattgacaacgatggacttgagtaacaacagcttgcatgatgtaattccgtatcagctgccaccaaatcttatccatctgaatttggccagaaataatttttccggcaacatcccatactctatatccaacatcttatcacttggctacctcaatgtcagtcacaactctctgttccaggaaatcggcgaactatttgggggcctcaattcgctttctgtattggatttatctttcaacaacttgtcagggaatcttccagtttcttttgtctctttgtcaaatctttctagcctctatatgcaaaataatcaactatcgggcacagtcagtgtcctcagcaacctaagccttactacactaaatatagcaaacaacaacttcagtggcttgatacccggggaactcagctcgattccagacttgagcgctggagggaactcatttatcaatatgcctgcatctccaccacggattatcatgccaccgtctcagagtccggttgctcagccagatcgtcctcaagtaccgacaacttttccaaatggccctgaggatgatatccctatcgaagaaggtgacaagaagcaaggccggcaaacaggtctgcttgtagggttggctgttgggtcagtggctgctgcttcatgtatacttttcgcgctggtgttctgccttcacagtgtccataaaagaaaggatggtggtaccagtgaaccgaaagactttgtaggtgctcttgcagtaaacatagacagagattctaacaccaacatccatcaagactctcctgtcgcagcttcagtgctcccgcggcctattggcactcctgagagggcgtatggtgtaaatagttctccagcaaagaagataaaagttcccggtgcggcaacttcttatactgttgcttcgctccaagttgctacaaacagcttctgtcaagataccctactcggtgagggttcacttggtcgtgtttacagagctgatttccccaatggaaaggtgcttgcggtgaagaagatagacagtgcttccctttccttgtatgaagaggatcattttcttgaggttgtatcaaacatttctcggcttaggcacccgaacatcgtgtcgcttacgggctattgcgctgatcatggccaaaggcttcttgtatatgagcacatcggaaatggaacactacatgaaatgttgcacttctctgatgaggcgaacaagagcctttcttggaacgcccgtgtgaggattgcgctaggcaccgctcgagctttggagtacctgcatgaggtgtgcctgccccctgttgtacatagaaacctcaaatcatcaaatatcctgcttgatgaagagtgcagcccacatctgtctgactctgggcttgctgccttctcaccaaatcctgagagagaggtttcaactgaggtgcttggctcacttggatacagtgccccagaatttgccatgtcaggaacacatactgtaaagagtgacgtgtacagttttggagtagtgatgttagagctacttacgggccgtaagccgctagacagatccagggagaggtcagagcagtcccttgtcgggtgggcaaccccgcagcttcacgacatcgatgcgctcgccaagatggttgacccagcaatggaagggatgtaccctgcaaaatctctgtcccgtttcgccgacataatcgcgttgtctgtccagccggaaccggagttccgtccaccgatctccgaggtcgtccagcaacttgtgcgtctgatgcagagggctagcatgttaaggcggcaatcgggagacgacctagggtcttcgtaccgtgccccggagcacgaaggaggcgcgtgggacgcagtctgaggccaaacctcctgtcacctacaaaccagagctgtatcagaacatagtatcattttgtgagtattagtatgtgttcggtttttactccattttttgtctggtatttcaggagcttcagcttatctgtttgtaccaaatacactgggaattttgtgaacggcttgtatagatataggattctgttgtgg

SEQ ID NO: 211 - DNA, 601 bp, Triticum aestivum
gatcgatcccagctctagaggggagggagcaaccatggcgggggacggggaggacgaggtgccggcgatgggcggagacaagctgatcctgcgggggctgcagttccacggcttccacggcgtgaagcaggaggagaagaagctgggccagaagttcgtggtcgacgtggacgcctggatggacctcgccgccgccggggactccgacgacatcgcccacaccgtcagctacaccgacatctacaggatagccaagggcgtggtggaaggcccgtcgcggaacctcctggagtcggtggcgcagtcgatcgccggcaccacgctgctcgagttcccccagatctccggcgtccgggtgaaggtcgggaagccccacgtcgcggtgcagggcgtcgtggactacctcggggtggagatactgaggagtagacaagcatgagcacaagaaccgaacagaattaatctcagttgagccgatcgatctctgtgtcttatattatctatctatgtatgaacatatgttaatcgcgctcacgaaacaagaatcatgaacggaataatttctgaaatggggatcatgttcttgcctgcaaaaaaaaaa

SEQ ID NO: 212 - DNA, 1234 bp, Triticum aestivum
gctctgcccgtctccggcgaccgtgatctgctctgctctgctccggtggtctccgccgccacggaacttaatacacatctgccgcagaacccatgagcaggggcgccgcggcgagcggcagcctgcggacggccctctcgtactgcgtccagcaggtgcgcagctacgactaccacaactacctctgcctgctccacctgccgccggcaatgcgcaaggcggcgttcaccttccgggccttcaacgtcgagacggccaaggccatggacgtcgtgtccgacccccgcaagggcctcatgcgcctcctctggtggaaggacgtggtcgacaaggtctgcgccggcaagaaggtcgagcaccccgtcgcgctcgcgctctcctcggtgctctccgagcacaaggtcagcaagcactggctcaagcggtcgctggaggccaagatcaacgacgggaaccgggacgaggacgccatccctgagaacgtcccggagctggagaggtacgcggaggacacccagtcgaccatcctgtacatgacgctgcaggccggcgggatacagtccactgttgctgaccatgccgcctcgcacatcggcaaggcgagtgggctgctgctgctgctcaaggcgctgcctcaccacgtgagcaagcaagggaagataccgtacatcccggcgagtgtagccgaggagtgcgggctgcttgcgcgggaaggtggccggacagaggtcaggatgggcgacgcgctcccggatgcagttttcaaggttgcgtctgttgccgaagctcacctgcagaaggcgcgggagctggccacgtctgtgccagcagaggctgtccccgtgctcctcccagccgtgccggcccaggtccttctggactccctgcggcgccgcgaattcaacgtcttcgactcacgcttgtccagtggagtccatggcatatcccctctgtggtaccagctgaagctaaactggcacgcgtggcgaaacaagtactgaattcatccatgccgtgtgaaccgtgtttgttgaaagcgcggttcagcatgcgttttagcccagactaaacctggggtatccatttacgggaatgtaataagcttgatgatgaagaaaagctctgctacctgctccaactggctgtttctgagcaattttgatgtagcttcctttttcattggatacatgctttgttgagggttgtttgtttcgtttgtattcgagtatcgaca

SEQ ID NO: 213 - DNA, 3908 bp, Triticum aestivum
ggatctcctttcgacgaaaaccctatttcagttaggaagggccaaggggacgtaggaggcgggcaagacatggcggccgcggcggcctccgttggacacagcagcaaaggcggcggtgggcggatccatcggctggaggtggagaattttaagtcgtacaagggaacgcagaccatcggtcccttcttcgacttcacggccatcatcggtcccaatggcgccggcaagtccaatctcatggacgccatcagttttgtgctcggcgtccgctcagcacacctccgtggcgcccagctcaaggacctcatctacgccctcgacgaccgcgacaaggaggccaagggtcgcagggcctccgtacgcctcgtctacaacctcccaggcaccggcggcgagcttcacttcacccgcaccattaccggcgccggtggcagcgagtaccgtatcgatggccgactcgtcacgtgggacgactacaacgccaagctcagatccctcggcattctcgtcaaggcccgcaacttcctcgttttccagggtgacgtggaatccattgcctccaagaatcctaaggagctcactgcacttctggagcagattgccggctctgacgagctcaggagggagtacgacgaattggaggaacagaaaaccagtgccgaagagaaatctgcacttgtctatcaagagaaaaggaccatcgtcatggagaggaagcagaagaaggcgcagaaggaagaggcagagaagcatctgcgcttacagcaggacctgaaactgttaaaaacagagcatctcctatggcaactctacagcattgaaaaagacatggaagcaatagaagccgaacttgaggatgatagacgttctcttcagcaagcgcgcgaagataatcaatcctctgacaatggacttgctgcaaaaaggaaggagcaaagtgcatttctcaagaaaattaccttatgcgagaagagtatgtcgaagaaaaaggttgatattgacaaaaagcaacccgagcttcttagattgaaagagcaaatatctcggctcaaatccaaaatcaaaagctgcaacaaagagattgacaaaaagaaggatgataacaataaacatttggaagagatgaaaaggctgcagagtgctttggctgatgtcacaagtgctattgaggagttgaacgagcaaggccaagataaaggagtgaaactgcaattagccgatgaccaagtccaggaatatcatagaattaaggaagatgcaggaatgaggacagcaaagctgcgagatgagaaggaagtattagacaaagagctaaatgctgatattgaagccaaaaagaatttagaggagaatatgcaacagctgcgtagccgtgttgatgagatatcatcacaggagagtgaattgcagacaaagcttaataagattcttcattcaatccccaagcatgaagatgagcttacacgtttacgcgaggatcataacaagattgcaaaggaacgccaatcttcaggagctaagtatctgacattgaagcagaaggtggatgagatagatacacagttacgtgaactcaaagctgtgaagcatgaaagtgagcgggatgctcgattttcagaaactgttaagagtcttaagaggctattccctggagtccatggtcgcatgactgaactttgtcggccctcacaaaagaaatacaaccttgctgtcactgttgccatgggaaaattcatggatgcagtagtggttgaagatgaaagcacaggaaaggaatgcattaagtatttgaaggaacaacgtcttcctccacagacatttattcccttacaatcgatccgtgtgaagccaataaccgagaggttgcgtacccttggaggatctgcacagttgatctttgatgtgatacaatttgatcgagctttggagaaagcagttctgtatgctgttgggaatacacttgtctgtgacaaacttgatgaagctaaaactcttagttggagtggtgaaaggtacaaggtcgttactgtcgatgggatacttttgactaaatctggcacaatgactggtggagtaagcggtggaatggaagcaagatcaaataaatgggacgacagcagaatagaatctctgaagaagaagaaaagtaagctagaggctgaaatgtccgaacttggttcccccagggagttgcagagaaaggagcttgctgtatctgagaaaataactggactcgagaaaaagttacattactcgaatgtcgaacagaataatctcaaagagaagctacacaaattggcatctgagaaacgtaatattgagaaagaaattgatcatctggagccaggaaaggaggagttggaaagccgtcttgctaaaaacgaacgggaagtaagaaagcgggagaaaaaaataaatgagatagtcgacaggatctacaaggattttagcacgtcagttggtgtgaagaacattcgtgaatatgaagaaaagcaactgaaagatgctcaagcactgcaggagaggaagctaagtctgagcaatcaattatcgaaactgaaataccagctggaatatgaacaaaagagagatatgcatgctcctattgcaaagttaaacaacacacatgagaccctagagaaggagctgaagggcttgcaggagagagaaactcgtgctaaggctgatgctgaacatatttcaaatcagatggaagagctgaaggctgaggctgaagactggaagttgaagtcagatgaatgtgagacagcaattgaggaactaaagaaacagaatgatagtgttgctgctgcattggcaaagctggatcgccaagtgaagttaaaggagggacagatagttcaacttagatcacgccaacgtgagattcatgagaagtgcgaactggagcagttaaagcttcctacagttaatgatccaatggacactggatcatcctcacaggaacttgtccttgattacaaccagcttagtgaaatctacctgaaagaagtgcggctgtctgaccgtgacaaacttgaggcagagttcaaacaaaaaataggtacactaatggctgagattgaacgcactgctccaaacttaaaagcactggaccaatatgaagcacttcaaacgaaggaaaaagaggtgagcgagaagtttgaagcagctaggaaagaagagcgagaggtagctgacaagtataactctgtcaagcaaagaaggtatgagctgttcatggaagcctttgatcatatatctaaaggcatagacaaaatctataagcagttaacaaaaagtcacacgcatccactcggaggaacagcatatttaaatctagaaaatgaagatgagccatttcttcatggaatcaagtacacagctatgccacctacgaagcgctttagggatatggaacagttatccggtggggagaagactgttgctgcactggcattgctttttgccattcacagtttcaggccatcaccattcttcatactggatgaagtcgatgcagctctagataatttaaatgttgccaaggttgctgggtttattcgatcaaagtcatgcgaacgtgctggcgaagagcaagatggtgatggaggttgtgggtttcagagtattgtcatatcgctgaaggatagcttctacgacaaagctgaagcactggttggtgtttatcgggattcagaaagaagctgctccagaaccctcaccttcgaccttacgaagtataaagaagcatgaaatccactcctgttggagtcttcctacgtgttaatctgtgatggtgacaattatcgtcaactgattctgtatttcaacttgtgtatatgattagtggcatgtagttaatgtagaaacggcacaaaactacagtaccattagaagttatatgt

SEQ ID NO: 214 - DNA, 3060 bp, Oryza sativa
gtagaatatgactacaacacgtatactgagtaaaaggaaatacgccttctgaaccggttaacggaaaagaagcccgttcgcggttcgccccttccaaaccgacttccaatcgcgcaattcccaaatataaatctggcgaccccaacagagccgagctagggtttcgcctcccccgccccgcctcctcctcctccgcaccgcgcgaaccgacccgacccccacttcgccgccgccgccgcagccgcagccgcgatggggacggagcggaagcgcaaggtgagcctcttcgacgtggtcgacgagacctccgtctccgccaagctcggccgcgccgccaccaccaacggctcggccgccgccgccgcggccaacccgtccatcaatcggtggacggggaggccctactcggcgaggtacctcgagatcctcgagaagcgccgcacgctacccgtgtggcagcagaaggacgatttcctcgccgtcctccgcgacaaccagaccctcatcctcgtcggagaaaccggaagcggcaagaccactcagattccccaattcgtgctcgaggctgaaggcttgagcaaccgctcaatggttgcttgcacccagccgcggagggtggcagctatgtcagtttcccggcgtgttgcggaggagatggatgttactatcggggaggaagttggttacagcatccgttttgaggattgcagcagtcacaaaacagttctcaaatatttgacagatggtatgcttctgagagaagctatggcagacccacttttagagaggtacaaggtgattgttcttgatgaggcccatgagcggacattagcaacagatgttctgtttgggcttctgaaggaggttctaaagaacagacctgatttgaagcttgttgttatgagtgctacccttgaggctgagaaatttcagacctatttcagtggtgcaccgttgatgaaggtgcctgggagacttcatccggttgagatcttctatacacaagaaccagaaagggactacctggaagctgctatcaggacagttgttcagatacatatgtgtgaacctgctggagatatccttgttttccttactggagaggaggagattgaggatgcctgtcggaagataaataaggaaattaataacatgggggatcaggttggcccagttaaagttgtgcctttgtattctacgctgcctccagcaatgcagcagaagatttttgaacctgctccagccccatcaagagagggaggcccagctggaaggaaaattgttgtgtccacaaatattgctgagacatccctaaccatagatggtatagtgtatgtgatagacccagggttttccaaacagaaggtttacaatccaaggataagggtggagtcccttctggtgtcgccaatttcaaaggcaagtgcacatcagagagctggtcgtgctggaagaacgcaacctgggaagtgtttcaggttatatacagagaagagttttaacgatgatttacagccacagacatacccagaaattcttaggtcaaatctggcgaatacggttcttaccttgaagaagcttggaattgatgatttagtgcattttgactttatggatcctcctgcaccagaaactttgatgagggccttggaagttttgaactacttaggggcacttgatgatgatggaaacctcacgcctttaggtgaaacaatgagtgaatttcctctagatccccagatgtcaaagatgcttgtcatcagtccaaaatacaactgttcaaatgagatcctttcaatatctgccatgctgtcagtacccaattgctttctccggcctagggaggcacagaaggctgctgatgaagcgaaggctcgatttggccacattgacggggaccacctgacacttctgaatgtataccatgcatacaagcagaacaatgaagatccccagtggtgttatgagaacttcatcaatgccagagctctaaagtcagctgataatgtcagacaacagcttgttcgcatcatgaccagatttaacctcaagatgtgcagcacagacttcaatagtcgggagtactacgtcaatatcaggaaagccatgcttgcagggtacttcatgcaggttgctcacctggagcgaacaggacattacctgaccgtcaaagataaccaggttgtccatcttcacccctcgaactgtctagaccataagccggagtgggtcatctacaatgagtatgttttgaccaccagaaatttcatccgcacggtcatggatatccgtggtgattggctgattgatgtggctccacactattatgatcttagtaatttcccctcgtgcgaggcaaagcgcgtccttgagaggctgtacaacaagcgggagagggaaagagctgctaataggaactgaagttgatggcgttttccccttgcgctagccttccactcgagaagattcgggtatatcagcttgtcgtgccggcgccaacaatggatgcttcctcatcctatcgtatgatttggcttgatggatgctcgtcactacgtatgacatgccaaatgctgctctctagccgtacaatctaccagcaatggcctaggatcatatttttgtttcttttagaagttgtagcctgtgacgcaggatattatgtaccggtctcccatattttgatggttctggcacccttttatttcggcatatttgtttcgtgtttggttagtcttaaaagtgaaatgtgcatcattgctaccttagcccgactttctttcgatagtgtcaaatcaaaggaaattttactttaggtcgcattttattaccgatgtttcattttgaatcacctttaaactaatatttttacttgattgggttttcactttggaccaggtaattttatctttgttacactttgcagccaactacaacccggaacacagatttcaaaacgctgagtgtatgatagatacatatttcaaaacgctgagtgtatgatagatgagatcatgtattaatgatgtaggagatatattagttatagatgatttggag

SEQ ID NO: 215 - DNA, 1870 bp, Zea mays
atgaataatccacagaaaaccggcttgatctgatctggccatattgagcgtccccaccccaccacgttggtttgagccgttgaggcctcaacagggaggaactgccagccagacgagacgatcctacctgacagggcagccgaagaagcgccgcgccgtttcggttcggcgcgtgcgtggttcgtcttcccctgcactgcccgctcccccaaacttccccagcatttcgcattcggatttccccccctcgactccaccccgaaccccaaccgcctccgcagccctccgtcccatggcgtccccctccttcgccgctgcggccaccagccccgcctcctccccactaaccctagacgccatccccctcgcctcccgccccgcacccggagccgccgccgcccagcgcaagcggtcggtcttcctcctcaaccaccgtccgcacccggtctcccctacgcccccgctccaaccaaccgccgccgcgtccgctcagcacgcacgccgaaaaaagacctctcacccgccccggccgcggtggcagaccgtgctcagcatcgccgccaagaacgcggctctcctcgccgcgctgctctatctcggggacctcgcctggcgctggtcccacccgcccccgccctcgccgccgcccgaccgcgccgcgctcgagggctacgccgcccgcgtcgacgaggtggaggcctccctcacccgcaccttccggatgatccaggtgcaactcgaggccgtagatcgcaagatcgacggcgaggtcggcgccgccaggggcgaccttctcgctctgctggaggataagcggctcgcgctcgagcgccaactcacccggcttgacgcgagggccggtgagctcggcgacgcgctggccgggctcaagcggatggagttcctccggaaggacgagtttgagaagttctgggacgaggtgaaggggagccttggctcgagttcggagagcgaggttgatctggaccaggttcgtgccttagccagggagatcgtcatgagggagattgagaaacatgccgcagatgggatcggcagggttgactacgccgttgcctcaggcgggggaagggttgtccggcattcggaggcctatgtgcctaaacgtggtttcatggtttggatgtctggagttgacgtggggcctaagccagagaagatgcttcaaccgagctttggggaacctggacagtgctttgctttgcagggtagcaatgggtttgttgaggtcaagctcaagtcagggataattcctgaggcagtaacgcttgagcatgtgtccaaggatgtggcgtatgacaggtctacagctccaaaaggctgtcgggtgtatggatggtacgaggagacgcccggtgagacccaatctggtcatgctgcaaagatggctttggcagagttcgcctacgacttggagaagaacaatgtgcagacatttgacgtgacagccccagatgtaggcgtgatcaatatggtccggctggatttcacttcgaatcacggaagctcgcagctgacgtgcatctaccgcctccgggtccatggccatgaaccggtctctccaggatcctccgcaggttctcaggcctgatgagttgtggaaagccttgtgtttctatttgatacgtgattcacacttgacacaactgtaaatgtaacgatcgtttgctggtagcctggtgtcttcctagatcctagtccagtaacatgtggtaggtggctagtgtattctatgaacacatgggatttcagcattcagcagttgtttgttgcgtaattgtttgtttgaacctttgtcaaggattgtgtgctgttgtctttggttcaagcagaacttccattggtatcc

SEQ ID NO: 216 - DNA, 2128 bp, Oryza sativa
tccactgctctgatgctctctctctctctctcttcacgcttcccacgcgcgacacgaggttggagacgcgtcccgtgacgtcatcgtcgtccccgactccggcgagccccgcacccatggcggcggcggccgcgaggggcgccgccgcggcccgctccccgctcgtcctccaccgccacccccaccccgcgcaccaccgccgcctccgcctcctccccctggtggcgggcggcgggggaggctcgcccccgcgtgtggggaggaggatcagggccagccgggagaaggggcggcgggtcgggattagggttttcgcgaggtacagccaggcccaggacttctccactcgcctccaagatagagctggcgaattgcctaagttggttgaggaccttctacagacatcaattagcacagggccacgaggtgcttttaggtttgcccaagggatccaagctgtccttggggttggtggggagtggctaaatgacttctcaaagacagccaacacatcagcaggaataccagctcagatgcagctgggtttgctttctcctctttatcttagaaggctttttgagcgcatgggtgcaacttatatcaagctaggtcagttcgtagcttctgcaccaactttgtttcctgcagagtatgtcgaggaattccagaactgttttgaccgtgcaccacctgttccatatagtgagattgagtcaatattgcgtgaggagttgcaacagccgttggatagtgtatatgaatacattgatccagttccaatagcttctgcgtcaatagcacaggttcatggggcaaggttgaagagctctcagaaggatgtggttatcaaggtcctcaagcctggtattgaagacactttggtggctgacctgaattttatctatgttgttgcacgtattttggaatttctaaaccctgaactacagaggacatcactggtaggaattgtcaaggatataaaggaatctatgcttgaagaagttgatttcaggaaagaggctatgaatattgaggcttttcagaggtacatcgatgcaatgggatttgacaggcaggccaaagccccttttgtgtatcgccactgtagcacaaagcgtgtcctaactatggaaagattgtacggtgttccactcactgaccttgattctataaggtctcttgttcctgatcctgagctgactttagtcactgcacttaatgtctggtttggaagcttgatttcatgtgaatccttccatgcagatgtgcatgcaggaaatttatggttgctccgagatggacgtgttggatttcttgattttggaattgttggccggatatcgccaaggacctgggctgcaatggaggtctttttggcttcatttgcaactgacgattataatgctatggcatcagccctttctgaaatgggtgctacagggaatgatataaatgttaatgaatttgcaaaggacttggaaaaaatattctcatcaatacaggatttggatactgaagtcatagttgcaacagcaagaactcctgatgctacagcagtatcggctaatgttgtcgttgacgagagacagatgaatgcattgtttcttgatctggtgagggtcagcgagtcgtatggattgaaatttcctcgcgaattcgctcttctgatgaagcagcttctgtattttgatcgctacacaagattgttggctcccagcatgaacatgctgcgagatgagagggttaacattagctcccgccaacaggccagaagagtagatcgtttccagtgaccgatgcttgtgatacactgacaagtagtacgtaacaagctcgtgtaagtgtaacctactaactgtatatattttcaccagatcaacataggaatgaaccgcagtgcagcggccaaggaaaatttggacgagtataactggacattttcatagtagcaagtcgctctgtaaaaggtgtacgttaagatggaagtaaaatgtagagaaaatagaactgccggggccgctgggctgactccacatcatttttctgaattctttctttactgctctcctcacaagccggcgctgcgtaaagaaggccagtttggaaaacatgattattttgaccgatt

SEQ ID NO: 217 - DNA, 667 bp, Sorghum bicolor
gatctagttgctgtggctttgtgcgtgactgctgaatgggcatgcagcataaaggcagccccccaaaaaaaaagctgagacgggacgacaccgagagaatcagtgactcatattcccaaatcccaaaaggccaaaaaccatacgcccaacgcaaaagctaaagagagggaggggcgtccaggttcaatgcatgtacacacgatcctctgcagtgtgacctgtcgctacaatgcaggtcatctctttcaaaccccacacgagatgtttcttcaaagccaccaggtccaaatcccagcagctctgagctagggaaaaacgactttggtgccatggagagaggggtatttgcagtacaagtacctttggatccaagagctagcatcactcgtaaattaagcagctaatagctgaagatgcatcgaggactgttcttcttcctcaagccgtagcctgtgggaggagaagccacaggcctcgcatggagttcccccactcacttcttggtcccctgttgttcgttccctcaggtagagaggatcttgttttttgtgctgatttcttcctcgtgtaagctcatgcgtggggcgatggatttgtctctgatcgtcctcatgcctcttgtatcgtgatttggatcaattaatgcaaataaatcatcgatgagaaa

SEQ ID NO: 218 - DNA, 1052 bp, Sorghum bicolor
aaagggcagcgcagctcagctagcagcagctcaaaccttttcttcttccccggcccgtctctctcgttcgccctccagagtccaggcattctggcctctcgagtagctagctcgagcggtgcatgctttcgcatttgtagctagccagcctagctactaccttgcggcggcgacatgggcaagaggttgatgagggcgtgcgcggcgagaggcccacgaggaggaggcgcctcccgcgcatgcctggtgctctcgtccagccgtcgccggctccgggagctcgttccggccgccgggcagtgatctctccgatccttgcctgcttcctgctcgtcggtgcagctagctgcctacggggatgcatggtcgggcgcgcgggacagatcgatcgatcgaccaagtgatggaggggatcgagtcgtcgtcgtcttcgcgcgcggcggtagtgatccaatccaagggctgcagaaaggagctaactggtggtgttcgtgtaggtctaattaactcgatcggcggcatacatgggaaagccaggcattttctcgcaagttcaagtaccttccgttagctttcctctccatgcattgcacggtgatggtcttgttttaatccaattaatcatctgttcgtttcctctcttagtctcttaattttgggattctttaggcatataatagtagtagtactactaagaagttgaaggagctaggttactgagaccaaaatagtggggtgtatgtatacatctgcattttcctcgaggtgcgattatacaacttgctgctaaaggtttcttcgtattctgtctccttttgtaagattctaagtaatgcatgcatatgttctagagaatccatcaccgatcgatcaaatgaacatttgttgacgtgtcatgttttatgctacgtaatcctacctgctaaaagtttgggaatgttgtatatatgtggctgtacatttgtacttccagtgtcttgttaccgatgtaaattaatggatccagttactggagactactttttttaaaaggtttgtactatcactaacca

SEQ ID NO: 219 - DNA, 2295 bp, Arabidopsis thaliana
catgtggctcttttgcatgttctgtcataaacacgtccatttcattcatcctcttcttcttcttctccttctatcctctgttttttgccctctctctttgtttagtggctgtggtcgtttgtatttggtgaaacataatttaaaaacaagtgcggctatctttaactctggccgacacatcggcggattcgactgtggtcggatcaagaagtgcttcctttttttccggcgtcgtttcttcttttatattcatcgatttggtgctctcgcaacttccaatagattacggctaatttctaaaatgaagatattaccatgctttggatttatccgtagaaagaaaaataaggggaattcaaaacctcagaaaacgcagagaatacttcagatcagacttgaagagccagtgaagcctttggagaatgatgagcctaacaacaaggacagtcctatcaagcacgagtcatatgacggcgaagatgaacgtgacgataaggattcaacgaaccgtgagttttctaaattccacgttcacgaacgagccgttgaatctgtgaaaagcaaggaggaagtcacagatacttctgaaaacggcgatgacaatgacgaggatgaaggaggtcacgtcagtgatcctggattaggcaaaactacggcttgggtgacgtctcctaagcttaaacgatcttgctccactctcagcaagtttaatggccggttccatggttctgatctccatgacctgaaagagaccgttccagttagtaatgaatcagtgaggtctcatagaagtgcagatagagtgatgctcaagaaacattcgtcgatgcagatacttccctctgggagccggcggctctggtggaagttgttcctatggagccataggaaccttcacaaacaccgtgtctcgctaaagtcacagcctttaaacaagaaccagcagtctggatacacctctgactttgctgagcacaaccaatccagccatgaagaagaatctacaaactattgcgctgatttcaccaaccagtcatcaaacttgtggcctcatcataatcagtgggtcgcgttctctgccgagtcctcgtcaatgaagcgagtggacgagtgggtaagaggactggatgtcgaaaccgtggttccagtgaacgaggataaggatgtcttggccatcttcccaacctctcctaatactgagagatcacccttaggaaatgtggttcagtccggaaacgtctcagaggctatagtgcacgcaaatagccttattcaatcgctgagcaaatcatcgagcgtggctcacatctcgagcatcggcttgaaagctatcccgagcatctcacattttaccagcctcaagtcgattgatctatcaaacaacttcatagttcaaattactcctgcatcgcttcctaagggcctccacgcgttgaacctttccaagaacaagatcagtgttatcgaaggactaagagatttgacacgcctaagagtactcgatctaagttacaaccgaatttctcgcattggacaaggtttatcaaactgtacactgatcaaagaactatacctagctgggaacaagatcagcaatgtagaaggcttacacagattgctgaaacttattgttcttgatcttagtttcaacaagatcgccaccaccaaagcaataggccagcttgtagccaactacaactctctcgttgctttgaacatcctcggaaacccgatccagaacaatgtaggcgaggaccagctacgcaagaccgtttccagccttctccctaagctagtttaccataacaagcagctcattaagccacaacgagccagggaagttctcaaagatagtgtagcgagagctgcgtttggtggtggagattctttgcaccacaggcgcaaaagaacatccaccaagagtgttgttggatcagcctcccctagcgttcaccaccgaggccacattgcaaaaggacgtggatccaaaaacagaagccaacgtcaactaagaaaaacttcagctgcagggacgccatcacattgaattgttctttttgtttgaatctcatgaattggccaatgcaaattgcaaagccatctccattctttgattttataattcagcatcttttctaacgcttatgtttccggttcggtttcaattctggtttactgtctttttactttttagttgatccggttctcggaaacatgtaaaaccgaataacactttccggtttaactcaattttggagatttttcatataatcaatttcaaaaagaatcgtaact

SEQ ID NO: 220 - DNA, 1106 bp, Hordeum vulgare
cggcacgaggggatttcggagtgaacatgcaagctgggtttttgctgtttggacctccaggctgtgggaaaactctaatagcaaaagcagttgcgcatgatgcaggggcaaattttattcacattaaggggcctgagctactgaacaagtatgttggggagagtgaatcagaagtaaggaaaatattcacccgtgcaaggattaactccccatgcatcctatttttcgacgagatagatgctctgacaacaaaaagagggaaagagggaggatgggttgttgaacgcctcctaaaccagttacttgttgaactcgatggtgcagatcagcgtcatggtgtttatgttattggagctacgaacagaattgatgttatagatgaggctgttctacggcctggtagatttgggaagaaacattttgtacctttacctggtgctgatgagcgggttgcgatattgaaagcacatactgaaaagaaaactctctcggaagatgttgatttggaaacaattgcacgtcgagaggagtgcaataatctcactggtgctgacctggcatcactggtgaacgaagcagccatggcagcgttggaagagaggtgcgaattcctggcgaaaggggactcgtcaatgagtactgacttgactaataagataaaactgcagcactttgagcatgctctatctaaagtaaagccctcagtatcagaacagcaaaggaaacacttcgacgcgctgtcaaagaaatattcagccaactgatccatcgccgtgcttacaaggaccatactgtagccttgtttctacttcccctgttccaaaataaatgtctcaaccttgtactagctctagtataaaattgtactaagcctctagacaattattttgggacggagggagtattatttttgctcataccatagcttggtgtagagattgcgtgtgctgaccctctacactaaagctatgcaattttggtagtgagggacttgttttcggtgtttggaaaatatgaactcgttatgcttgttgtacggcttttaccggtgctccgtccccttgtaatgttttgaattgagaaacacggagaaactttttgtggac

SEQ ID NO: 221 - DNA, 1002 bp, Hordeum vulgare
gaattcggcacgagggatggtgaagccttgagttggggagctgctggtggtggtagacttggacatggccataaatctagcttcctgggattcgctatgacctcaaatgaatatactccaaggttgatcaaaaaccttgatggcatcaagattaaaaggatagctgcgggaatgctgcactcagcttgcattgacgaaaaggtacttggaagatcaaatgatgcacctagaccaagtgttgttgaagagatacaattttcagaagaagttgcttgtggaggttatcatacttgcgctgtaacagatcgtggagatttgtattcttggggttcaaatgaaaatggctgccttggtcttggaggtacaggcatggttcgcttcccggaagttgtaagcagttcattatttaagcttcctgtatctaaggtatcctgtggttggaagcacacagctgtaatttcaggtgaagatatctacacgtggggctggggcggtgccaacggtacattcttcgaagagggccattcttctggtgggcaattagggcatggaaacgacgtcgactattgcgagccgatgatggtagaacttcacaagaatgcaagagctgtgcatgtatcatgtggcttcaatcacaccggtgcgatactcgagtacgcggaaaactgactgctgtgtcatctgcagcactgtaagtgcaaccaggcatgtttggtactactcagtcatacctgcacaaggaaaaagaataagctgacctcgaacgagtgcatctggatgaactcgtaaaacagaattacaggttagtctagctgtatagtcttctttcatacatcttcattgtgagcttgtatctatgatatttgatggcctgtaaagaagcggtgtttgacattgcccaggctgtgtgatgcgcatggccagttcaaaatgtaaacatgatttgaactaataaaataaatcatgtcttgtacagttacaaacctgcaatgtacatggatc

SEQ ID NO: 222 - DNA, 1854 bp, Hordeum vulgare
cggaacttaaattcattagcaaagataatgagaaatcggcgttgcgaaagaggggctctgactcttgcttcagcagaagtcaaattcgaaattgacagtgaaactcatgatccccttgacataggaatatatcaaattcgtgaggcaaaccaaatgattgaagagtttatgttggcagcaaatgtttctgttgctgagaagattttgcagcactaccccttgtgttcattgctacggcgtcatcctagcccaacaaaggagatgcttgagccattactccgtactgcctcctctgttggcctaagtctggacgtatcatcctcaaaagcattagctgaatcacttgataatgcgaagagagatgacccgtacttcaacaagcttatccggattttggcaactagatgcatgacacaagcagtttacttttgcagtggagatttgagcttgtctgagtattaccattatgggcttgcatctgctctgtacactcatttcacttctcctattcgcagatatgcagatgttgtggtgcataggttgctagctgctgctctagatattgcgaaacttccaccagtcttccaggatggtccacaactcacaggcatcgctgacaacttgaattataggcaccgaaatgcccaaatggcaagcagagcatcggttgagctccacactctcatatatttcaggacaaggcctgtggatactgaagctagaatagtaaagatcaaggcaaatggtttcatagtcttcgtaccgaagtttggcatagaaggtcccatctatcttacggcgaagggagacaaaggggctgactgggtagtagacgaggtgcaccagaaagtaaccaagcctggaacaaacataagctatgctgtgttgcagagtgttatgatccatatggaagtggtcgagcctcagcctcaccgcccaaagctacagctcaccctcatatgaacaacaaatgtacaaatgaattgtaacattagtgcattcaccctttttccgctacggcattgtaccagggtccattcttcaattcaacaaattttggtgattttatgatattgtcaaatcagcctggaattcctctttacagagctgtgtaaaaatctcgctttattgatgctaaaaatctatcatgccctgctgctttgcgttcaccagtcgctcatctctgggcactcttataatgtgcttgaaacacactgtaaaaatgtgatgatgcaaagttttctagctgaagagagcctcaggacacgagtgacatgaacaccgtcgaccagagtgttagcgccagggctgcaaccaggtgcgtccagaggaagacgatggagcactcctcctccccaacatcaaacagctgggctatagtcccgacgctcatggcagggggaaccgtggattgcagcaggagaacgtagcggtacaggggcgatcttggcaggaacccgagctcgctggcggccttcaccaccccgattccgcaggcggggaggatgacgaagcgtatcgcgatgatggacatgaccaccagtggcttctgcatcgtcctgcctctgccttttgtaaggtttccgccaagtatgaggacggtgcatggtatcgcggcgtctccaagtaactttgcggtgtcttggactactcggagagggccgtcttcctccgtgacgagtggtctcagcttgtcgattgcaccgacggtaaaccctatgagtgcggcaacactgggaggtgaccacagttcattcaatatctctaacagcaaatcctttgctcttcttaagcagcgcatggggctaccgtcaacgtcgttggaaggcaaggtacaataatggcctcgtgccg

SEQ ID NO: 223 - DNA, 668 bp, Hordeum vulgare
ctctctctctctctctctctctctctctctctctctctctctctctctctctctcccgccaaacacacacagacatacatgggatccttgggccctgccgtgagcgtgagcatggccaaggccagcggcggcacggcggccgtcggcggccagcagcagcagcagccggagcgcggcgcgttcagctgcggcttccggatgccgctgcactacccgcggtacaggaaggcggactacgaggcgatgccggagtggcgcgtcgactgcctgctccgggagtacggcctccccgtcgccggcgacgtcgaggacaagaggaggttcgccatgggcgccttcctctggcccggccagtactgatccaccatcttacatctcgccactcggagcagatcaggccggtcagcaagccagcgcctggcagaggctgatcagcaatggcagaagcaacatcacgtacatccatccccatgtatgaacaaaagagagcttgtgacgatattatattcttatatctatcattctaatagtaatctccaattctctccgtagagaatacatatgatgtttcttggagtatatgtaagcagtggaagaaggacttgtttctgatattcatacgtgtaatgtagtgcttcttaggtaccgtgcgaccttgatcgtttggc

SEQ ID NO: 224 - DNA, 1384 bp, Hordeum vulgare
cggcacgaggctctctctctctctctctctctctctctctctctctctctctctctctttggaactactcattgaggacggccttgaaagcatcgcaatgggttgcatatacacggaagctaaaaactatcctcgtgaaccagctgcccatgtggcaataaggactgttagacgttttctggagaaacagaaaggcaagatagctggtgttattttttgtattacatcatcatctgatacagagatatacaaaagattgcttccgctatatttccctcgggacaagcaagaggaagagactgcggtatcaaaacttccagctgatgtcggagatgagaatggtgaaactgtaatagatgaaaggaaaataagaataagacctttgcctgctggtgcagcagatagaacagtgcctgcagctcctcttgatcttcctgttgagtctggattggcatcaaggaatgcattcaaattggattcgtatttggacccttcatttatgtcattaattaaagacccagatgtgcggcgcaaggagcagtgggaaaaatcttctcaagctcaaaagggatttaattatgctaggttgcttggatatggtgatataggtttccctccattgtctgctgccgaggaatattcacttcattcacgataccttgcaaaagcaaattcccttaatctttcagagatcgctgagatgaaaataatctatcgtggtggagttgatagtgaagggcgcccagttatggttgttgttggtgcacactttcttcttcgctgcctggatcttgaacggtttgttctacatgtagtgaaggagtttgaacctttgattcagaagccgtatactattgtctatctccactcagcagcatcattacaaccgcaaccagatttaggatttatgaaacggatacaacaaatattaggtcggaaacaccagcggaaccttcatgggatttatatgctccacccaaccttggggttgagaacagctattctggggatgcagcttttaattgatggagaggtatggaagaaagttgtgtatgttgacaggctcgtgcaactgttcagatatgttccacgcgaacaattaactattccagattttgtctttcagcatgatttggaggtgaatggtggtaggggcatgattgtggacccaagaacaaaacatatctatcagagaccatctggttgattcatgtcatctatgcagtccaaagctcacacttgccttttcaagtctttgtataattactcctttgttgatatttctcttttccctttgtaactagtttaggagttctattcctttcattcgttcctcagccttcagggaaggggattattgtttgtatatgttaatttctacagc

SEQ ID NO: 225 - DNA, 875 bp, Hordeum vulgare
tttttacgagatggaggaacaacagcaacaaatgatagtgaaagagcaactaacggacggctcggatcacaccacagcgtccatcagttctgaaaatttgcagcaggatcaggagacgcatgtcgttacatgcgattctttgacagagaaccagctgctgctcatgagactgctggtaaaggatcggtacttgctcgaaaccgcaaagtcgatcgtcagagttgatgcccccgtcagtttcatggacgacgtcgccagcgcgccgaactggtcggacaagggcaacgaactcctctccgacgtggcccgggaggtgaccagaaggaaaggcaaacggagcgaggccatggaggaggtcagcgtggcgcgcgccaccaacccgaggctgcgatacctcgacgaccttgtcagagagctcgacggcgacgtcgagagcctggacatgtccaagtccaagagttctcggcatcacggcgacaatggcgcggccgagaacctgcgtaggatactcgagggtgacattcagaatgagcaccccgacgccaactcgacgtgggatttcgggtggaaccgcgtgtgggagctgccgttggagaaggccgacgtcgtcagggatctggagaagaacatactgggcggcatcatcaccgacgtggcgagggatctcatcggagtatcggtgcggcatggctgttgtccctgcgtggcttgagtggagcggtggaggtggagtgcggcagcaggagatgagacttttagaatggtcgagctcactgggttaggataattttttgatctgcaccacgtgtattcgctgtaagtaattgctgtgaggtttcagtgtataaagaaatgtttgtgtgctcgtgtatttt

SEQ ID NO: 226 - DNA, 872 bp, Hordeum vulgare
cagatggacatgcagccatcctcaagtgatgatgtgggaggtgttctaaaggcccttcaacgggccaagatgtccctcagggaaaagctgagcagggcaagtccacccaggcaagacatgttggcactaccagcacccgaggatcactacacagatgatgattcacaggccaatgatacagaattttcactttgcatgtcacaacgacttagccatgaaatattggcactgccagtatcaggagaatacctaagcaggatcagttggccaggcgatgatgcaaaaataccagttggccctgctggcttgttccggttgccaacagactcgtttccccaaaacgaggtgtgctccgctgatggctatggctcaaggttcagtttggcatcaagtcggcagaccgtcttttcaggaaaccctgctagtaatagcatgttaacttcatctcgtccgcagtatggttctggtttctcaccggatccgtattacgatcttcatagttcaatgttactgtcaatgcctacaacaaggaatgcttctttcatcccagaaattctaagatctagtgatgattcgagaaggggaatgtcttctggtgatgcaggcatgctgtcccagtatggtaatgcttatgattagtagctggagtgtagtagtaatgtatggttagaatcccaaaatagcttttgaggtagatgctatctgttgcgtcagttcttcgtgtgtcatgttgtattactatccaagaataaattttgtttgtaagcagtgtaggcttctgtcttatgccctcacgaggcaatacaaattggtactgataaggatgcgtgcaatgttttattgctatccaagaatagtaaagttgacatggc

SEQ ID NO: 227 - DNA, 540 bp, Hordeum vulgare
ctgggggttcatgcaggggcacatgtggcgccaggacgcctgcctcgtcaacgccgacggcaccatcaacgacgccggccagaggttcatcaacctgcggcaggagtggacgtcgcacgcgcgcgggaagatcgacagcgacggcaacttcaagttcagagggtaccacggctcgtacgtcgtgcagctcgccacggccacggggaagatgcacaaggccttcagcgtcgacaagggggacacacctctcgtgctggacatggacgtgtgacaacggttacctactacggctattatctccgagtatatatatatatatagttatactatatatactccttggtatactaactaatactctacacacatacaagcacacattgattaatttgatctaatggggtcggcaaagggattgtaccacatactacaacaactagtatagttttgcgtttctacgtttggtatatattgtactgttgagagattgtaatcaaggtactgtattggttaaaattaatggaaatgaatgaataaaat

SEQ ID NO: 228 - DNA, 2903 bp, Setaria italica
ccgcctctccggttctcccccatctgccgccaccgccgccgcctccttgcgccaccgccgcttcagatggccgagccgccggagcaggcgtcatcggaccccaccactccgccgcaggaagacaaccaaagcaccaagacaaatagcaagaagaatcgcggcacgaagaaatcgaagcgagccggcgcctcctcgctgtgctccagcaccatggttgaggacccgttcttcgtcctcgccggcggcaaggaaggagggttcctggagttggaggagattgacgaggcggacttcgggattgttgggggatacgtggaggaagtgggagcagatgaggggaaggctggcaaggatcgggggaagaagaagaagaagaggaagcggaagcgtgggggtgatgaccaggtcttgagtggcgatggcgattcttttttgaaacaatgcgatggcgattcagtagttgagaatgagcaggagggggagaaagagaagaagaatgcgaagggaaagagggacaggaagaagaggaaggtgaaggatagtgagaagagtggggagagcggcaaggacatagctgatgacgacaatgcagaagacgtgcaagataaaaatgagaacatggaacaagataaggatgatgatcttattttgggtgaggatgatgtttttgcatggcacgaacttaggcttcaccctctgcttgtcaaggcaatgcgcaggcttggattcaaagaaccaactcctatacaaaagtcgtcctttcctgctgcagctcaccaaggcaaggatgttattggtgcagccgagacaggttctggaaagacgcttgcctttggcctccctattttgcaacgtctccttgaggagcgagaaaaggcctcaagattacaccaggaagacgaaaaaatggaggaaagtgctggggaaagccctcttcgtgctcttattttgacacccaccagggagcttgcccaacaggtatgcgatcatctaaaagaagcagccaagttcttaggaattggcgtcattcctattgttggtggtatatccatggaaaagcaagaacggcttttgaaaaacaagcctgaaattgttgttggaactcccggaagattgtgggagctcatgtcgatgaacaatcaacacctagttgagctgcattcattgtcattcttcgtgttggatgaggctgatagaatgatcgaacgaggccatttccacgaattacaatctatcattgagatgctcccgctgactaatggttctgatgaacaagctgcaagaacaatgccaaactgtgagactgtgccaatcttgcaaataaagaagaggcaaacctttgttttctcagccacacttgcactttcatctaatttccggaagaagctgaagcgtggcttatctacttcaaaggcgtcgactgatgatgtaagctctattgaagccctgtcgaagaaggctggaatgaaaccaaatgcagaaatagttgatctgacaaaggcttcaatcttgcctgagaaacttgaagaatcttttattgagtgcagtgaagaggataaggatgcctatctgtattatatactgagtgttcatgggcaaggtcgagcaataattttttgtacatcaatcgctgcattacgccacatttcctccatattgcgcattcttggtattaatgccttgacaaaccatgctcaaatgcaacaaagggctcgcatgaaggccgtggatcgtttccgtggaagtgagaattccattttggtcgcaactgatggatttgcaaggggtatggattttgatgatgtgcgaacagttatccattaccagttgccacattcaactgatgtttatatccacagaagtggaaggacagcacgcaaatcattggctggctgcagcattgcattaatctcttctgctgacaagtcgaagttttactctctttgtaagtcattgtcaaaggagaacctccagcaatttcctatagatcatgcttacatgcctgcagtaatgaataggctctcgcttgctcggcagattgacaagattacacgcaaaaattcacaggaaaatgctaacaaatcctggcttcagaggaatgctgaatccatgggattgatattggagaccagtgacagtgaagaagaacgtgtaaagggccacaagcaacgaaaggcaacttctgcacatctccaaaagcttcaacaggaattgagtgatcttttgcaacgcccgttgcagcctaatactttttcacgacgctatttggctggggctggaatttcaccattacttcagaagcaactagaagagttggccaagagaaaagtaagcaacaatagaagcaagactgagaataaagggtctcgatttgttgttattgggcaggatcgtgtcgaacccttacaagcacttcagaattctgggcaagaggtctgtgtcaacttagacaaacaaagagaaaagcgaagacttgctcagaactggaagcaaaagaagcatgaagaaaagaaacgttcgcgggagcagaagagaaaggagaaaagaaaagctaaagcgatggactaaataacaggtgaaagatgggcctgtttgcgggaaggttaccttgcccaactgctccattcgtggaattccttcagagcctgcacgaattccttttaggaatgcactcaccaatgttttagccacatacatttggtgtgcggtgtgccaagttagcactaggccttaagcaagattgagtaggtgggttaatatgctgttttgcggcacaggataatgaagttagcacgggcaccgcgagatgatctctgtaacatgtggatgttatatcacatttcgtattcaaagctgctacaaatttatacatctttcgccatatcttttccctggtggtattt

SEQ ID NO: 229 - DNA, 1681 bp, Setaria italica
gccccgcgcggcctgcctctcgatccgccgccgggcggctgaggtcaccgctcgcgccggcgcggctcttatcagcgccgcggggaccgggaccggggtggggcgggagccgggcgcgaggccgcatcgtcgccgccgccgtggcggtggccgggtccgggctcgggctgtggctgaagccgccctcgctcgccgactccggcgagaccgaggccggcggccagatctcggtcgccggcgccggcgccggcgccgcggaggcgaggggggagaagggtcggttcctgttcgcagactcattccgcagaagggtgttctttaactacgagaagaggatacggcttctcagcccacctgaaaagatctttgagtactttgcgtctgtgaggaaaccagaaggggaagtttgcatgttgcctgctgacttgatgagggcagtagtccctgttttccctccatcagagtcaactgtagtccgcgaagggcgattaaggggggaacggagccctggagagttgcattgtgctccatcgaaattcttcatgttgttcgacacaaatggcgatggcctcatctcctttgccgagtacatcttttttgtgacattgctcagcattcctgagtcaaatttcagtgtggctttcaaaatgtttgacgtcgaccacagtggggtgatcgacagagaagaatttaagaaaataatgtcactgatgcggtcttttaatagacaaggagcaacccataaggatggcttacgtattggacttaaagttggccagcctgtggaaaatggtggtgtggttgagttcttctttggtaatgatgggaatgaacctctacactatgataagttttcaaaatttttgaaggaattgcatgacgagattattcgtcttgagttcagtcattacgatgtcaagtcatcgaacacaataccagcaaaggattttgcattgtccatggttgcttctgctgacatgaatcacataaacatgctgcttgatagagttgatgatttggtcaatgatcctgatctgaaggacatgcgcatctcctttgaggagtttaaggcatttgctgatttgcgccgaagattggagccactgtcgatggccatcttcgcatatgggaaagtgaacgggttgttgacaaagcaggatctaaaacacgcggctcaacacgtttgcggggtcgacttaactgatagagtggtggacatcattttccatgtgttcgacacaaatcaggatgggaacctgagctcggaagagttcttaagagcgttacaaagacgagaaactgatattcgtcaaccaacaataccaggtcctttagggttcttgtcttgctggttcggtggtaggaagtcttcttcacttcgacagatggtgttctgattgggtccccctatgatccttgatgtaaatgtcatgtgcctttgattgtcatctcgtggtgcagaagatagccaccaagtagcggactgcagctgaccgtggaaccgattttgctgtaaatatcgccgggtggccgaagcttgcctagcagctgtaactgtaaatagtgtcttttcttttgtgtagtcctaggacggagagagtacgttggttattctcacctcatgtaaattaaaccccatatgacgaccttaaacatttgaaacattgtcaactgtgttcca

SEQ ID NO: 230 - DNA, 1262 bp, Setaria italica
cgtactcgaaggcagcgcggcaggagcagcagccagcagtacaccactagcgcagcagcggttggccaccacccgacccgacgccggaggaggaggcggcggcgcggcgatggcggggaagcgcaacggctacgacgacgacaacgtcaaccccttcgcgggaggaagtgttccaccagccaccaattctcggctctcacctctatcgcatgaaccggctgatttctacaatgtagacattcctcttgattcaacaaaggatctgaagaaaaaggagaaagagctccaggctatggaggctgagctaaacaaaagagaaagggaattgaaaaggaaggaagaggcagcatcccgagctggcattgtgatagaagagaagaattggcctccccttttccctctcatccaccataacatttccaatgagatacctatccatttacaaaggacgcagtaccttgcattttcgtcatttttgggattgataggatgcctcttttttaatgtcatagcaactacaacagcatggattaaaggggaaggtgttatcatctggttgcttgccattatctacttcatatctggtgcacctggggcttatgtgttatggtatcgccctctttataatgcaatgagaactgagagtgctttgaagtttgggtggttttttctgttttacatgattcatatcatcttctgtgtgtgggcagctgtggctcctccgtttcctttcaaaggaaaatccttggctggaattttgccagcaattgatgtcataagcaagagtgctattgttgggatattttactttgttggatttggcttgttctgccttgaatcacttctgagcatcgctgtcattcagcaagtatacatgtacttccgtggaagtggaaaagccgcagagatgaaacgtgaggcggcacgtggtgctctaagttctgctttctgatgaacatacggctctgattacagccagttgatggatagaaggaaaccagatgtgtcatttgaggcatgggatcttgtacatcgcggcagtacgcgtatttcgatcttggaaagcgtacagctgatccgctttttgtccttctgtagactgtaagatacgaacattcctcgtattaatgcgtcagggtgtcgttggtttccatttcttgccacggtttagatgtggttgataggcataacggtggattgttggtggaatagtaggatatgatgtatttgtatacgcttgatgtgagtgaaatcgcttggtt

SEQ ID NO: 231 - DNA, 1256 bp, Zea mays
ctaaccacgattcgggggcaagcgaacggacacgatggtggccttgaccgcggggatttccgtagccaccggcgtcgtgttcagccccgccggccgccggcgaggccgcggacacgccgcctttcgctgctcgtcgtcctctgccggagagaggcaggctctcttcagccgcatcgcccccgtctacgatcatctgaacgacgtgctcagcctgggacagcaccggacgtggaagcgcatatgcgtctcttggtcgagagcgaagatgggggatcgagttcttgatctctgctgcgggagcggggatttggcgttcctgctgtctcagaaggtcggcttagatggagaggtgatggctgtcgatttttcaagtcagcaactacagactgctgctgggcgtcaggagcaacggtggaagctgtgttacaagaacatcaaatggatcgagggtgatgcacttgatttaccattcacagactgctacttcgatgctgtaacagttggctacggattgcgcaatgtggttgataaaccgaaagcgatgcaagaaatatatagggtcctgaaaccaggatcaagagcctctattcttgattttaacaagagctcgtcacttttcacagcatcattacagagttgggcgatagacaatgttgtggttcctttagctagtggctatggactaactgaagaatacaagtacttgaaaagctccatatcacagtatctaacaggagaagagttggagaaactggccaaagaagctgggttctgtgcagcgaagcactacgagcttggtggagggcttatggggaatctagtagcgactagatgagtagaatgtagaacggaaaatcgagttgcatggttcctctgcatcattttagctgattgtacgctcttcttctatgtattggcctcagatgaggtcaatgacaagtgttgattccagaggggcctggacgtcttgattatcactgtcttctgtttgaacctgcgcttctgtagagcatcgacgttgtgattacgatcaagatggaccgagacgctgacgcatgcttctgcagattacaccggcatgctgttctacagcgcgggagcattcaaaggttcttattaattatgcgttgcaatgtctgagagcatgtgggaatttcagcttttcactgtgcgttgcccattttgcccagaactgacatccagcttttcaccgcgttgctcatttgctctgaactgaatcctttttccccctcagt

SEQ ID NO: 232 - DNA, 1374 bp, Zea mays
aggcgaagaggcagtggtagacatgccaaggtcatcagccggggcgtcatgcacagcagttgaccattctgagcagagcagaaaggatgatgaatatgagaggctggttacaagagctcaacatgcaacatctgatgttggcacgacaattttatctgagcaaccaaagtcaagatctttcatttggtggatgaaagttctgcttggctgcttccttcttatattagtgggctatgtcttcgtgaaatggggggtcccctttgtctttgagaaggttctcttgccaatcatgcaatgggaagccagtgcttttgggcgtccagtattagctattgttctcgttgcatctttggctctctttccagttattctagttccttctggaccttctatgtggttagcaggaatgatctttggatatggttggggtttcttgattataatggccgggagtactattggcatggtggttccatattggattggttcattgttccgtgaacgtctgcatgtatggctgacaaagtggcctcagcagatagcactaataaaactcgcgggtgaaggaaattggttccagcagtttcgggttgtcgcgcttttcagaatctcaccattcccatatacaatttttaattatgccgtgactgtgacagaaattaagttcaacccttatctatgtggttctgttgctggaatggtacctgaggccttcatttatatctacagtgggcgtttaatacgtacattggctgacatgaagtacggcaactataaaatgacaccagtggaaatagcatacaacgccatttccttcgtcatcgctatcgccctcacggtcgccttcacggtgtacgcgaagagagctctgggtgacataaaaagtccggacgatggcatcggtaaagacgaagaagatcacggcccaaatggctcaggggtgcgtatgaatcgtcgtcaggagcgtgccgacgcacgttacatagaactagatgatatgtgatggtgtgttggcccggatcttgcttggaaggaggcaccagtaggtcattaggtgcacggctacggtaggtagctagctatagtttacaagaggaggctaaaataatccacacccagctgacgtggtttgcgtgattcgtttcgtgtgctttgcctactgcactgccatactgtctgaatctgaaggtgcagggctactcactactgagttactgaccgagcgatgctgctctcaacgatgtttctgtgaccatcagcgtatcaatcagtccttgatctgaagcctacactggagcttcatgttgaagcatacattggacttgagtagtacatttgtatataacgtaactgctaatagagttagcatatgat

SEQ ID NO: 233 - DNA, 2479 bp, Zea mays
cgggggagggggactggaggtgaaaggcggctgctttcgctgtctccccaccacccgcgcacagtggcggcgctgacggtggcaggaaaggaaagtggcgatcacaccaaactcacatacagatggagatggcagagaccttgcatgtattgcccgatgatggcaatggaagtgctgcagttcagactgagccttattgccatgaagacgccattgaggacatggaatctttcttggatgaagtaaacgacagggttcatgtttcaggaattgtgactggtgctatcatcaaggggatcctaagtgatgtgcggcaagaagctgctagccaaattgctctcaaggatgcagagatatcatcactgaaccagaagctgcagcagccagtaaatggcagcttgagtttatctgagggacgggataaaagacatgatgagttttatagtctccgccagcagcttgactccatttccaagtcactgttgaattctgaatgggggctatcgggatcacagcataactttgaagattcagaaaatgccagcaagcagcaggacaaagaaaattcctctagaaatggtgtagcaaagaccattcatcctggagactctaaagaagaagtttttggtgatccgaaactcttggatcacatggataaggttgctttgatagcccatttcaataaatcaatgaatgagatgaaaaggcagcatgattcagttctgtaccagaggacggaagagatattcaaactgaagcgtgaaatcctgaagaaggatggatcaaacccttttcatttacgaaataacaaagaacttgagcaaacaaggaagaaaattgaggaagtcatctcaaagttggatgtgctcctcctggagaataaaagagcctctgtccgtatcaagtcaaatgcaattcctggtcaacaagataagaacaatgtattaggttctgaaatcgagcaactagaaagcggtgcaagtaataatgaagactaccattgctctattccaactcactcatcacattttgcatccagagaggcagatcatgaactgaatattgtaaggcctcaatttgacgttgaagatgccagaattgcagccacctttagagaagaaatagaaaggattatcataaaagagttcattagtgaaataaacatagaattgcatggttatgagattgagggtggtatgaagcaggaagtttgctcaataattcacaatgaggctattgctagagcaatgtcaaacattgattctttgttgttgaagtacgaggagaaaaagggtcatgctgaagaggaatctctacataagcaaaagattgaaaaactgaaactaattgtggattccttcactgaagtattgagtgaaaaggagaaatttgtatcacagattggattggaagcgatgcagactcgcgtggagtcaatgtgttgtgaacttgatttgttaagggacaaagtggcaaagcaagattcctacctatctgaaaagaacagggaatttgatgccattatgtgcaggttggagcaagctcagcagcatgttcaacacaatgatgttaccttggttgagctgaatgatagacttagaaccatttcaaactctctaaaagacctagagaaacagaatcaagctctacattatgccatggaagaaaaagagaagatgctaacatctgctgtttccaaagacaatgatatgagagaattcatggaaaatcttgttaaatctatcaaagattttgaaattgtcatgatgaatcagcaggctgttgttgcaaataaagtcgatcatcatgaatcaaggttctgtttattaaaagaacaatgtaaacaccttgcaaaagaaggcaatcttttaagaaagaaggccttacgatacaaagagatatctgagacaagagactctaatcttcagaaagctgaacttgaggtggatttgcttggtgatgaggttgaggccttaacggatcttcttgcaaaaatctatactgcacttgatcactattctccagtactgcaacactacaccggcgttatggagaccttgagcatgattaagaagcacattagcatggcgaagtaaaatgcttctggtcggcttgacactgtagaattgtaggtttgacagcaggcttccagtggtttgacataagtttgtagaattgtagatggcagcaagcttttgtttccgactcaaggactaggtgattacccccttttgcaggcagagtagtggtcttggtagcttttgagcactctgtaaatgacccaacccaaccgtagctattagttcttgtgcttggcttttgatgctatggcctatgggctttgccacctgctatgctgggttgcaaaggtgaactcttgtaacattggtagccgagaggatgttagagaagctgagttttcatgtggatctttattttttcctggcacaatggtagataaatctacactatagcctgg

SEQ ID NO: 234 - DNA, 1182 bp, Zea mays
gccacagcgctagcggcatagccggcgacagaaacaaccgatgccactcctcgccgtctgtccccgccgcgttccgccgctttcgctcgcgcgccgccaccgccgcagcttgtatcgggcccggtccctcgcgctcaaatgcgaggtctcctctcctccgctacttctgacccggaggatgtccgccgctggctcgctgcttgtcgctgtcgtccccgtccccgcgccgtcgccgcaactccccgtcgcctccgcgtcggagttggagacggagacggcggaaggagagagcggagcttctgaggggttagcattggagcgttacaccgaccaggagcagggcttcaccctcctcaagccggcctcctggcccaaggtggagaaggcgggcgcgacggcgctgtttcagcaggagggaaaagggagcaacaatattggggttgtcgtcaaccctgtccggctcaattcgctggcggagttcgggacgccgcagttcgttgcggacagacttctgcaagcagagaagaaaaaggaaagtaccaagtctgccgaggtgatttcagtgggagagaggtcaggtcatggtggcttgacagtgtatgagatcgagtacatgctggacagcacaaggggagggatgaagcggatcttctcgtgtgcgtttgtcgcttcaaggaagctctatctgctcaacatagcatattcagacacccaggagaagcccttggacagggagacaagaaccgttctggaaaaagttctccattcttttgattctgtataggtgatatttttttatagccgaggtatggcaccttttcttattttcggaatttctttcacttgaaaatacagtcgcaagtaattgtttgtttgtaaaatgagtgctgaccaaaatagctgcagtgtccatgtgtccaatactgttgcacttgcacctttatcagtgatttcaggttataagtaatttcagttcagataatgagcttcatcttctacagattggtagtatttgtgtcaccaggcagtaaaatgttgtgacctttgattcctagcctggcattactgcatctgtaatatcctggacaaagcgtggggtggtggcagtgttattccttgaaaaatctgtaacgcctattgaactccctaaagtttatctgaattccaggatcacttcattta

SEQ ID NO: 235 - DNA, 1026 bp, Zea mays
ttaactctgatatccatattttgcagcatgctgcgttcatggcaggggaacttgggttcgacatggtggataaagttatcaaagcccttgacgacgctggttaccatgaccaaactgcccagaaagttatggtccagtcaaccgacagttcggttctggagaagttcaaggagcaaacgaagtacgaccttgtgtacatggtcaacaaaaaggtcggggacgctgcgtcgtcctcgcttgtggacattaaaaggttcgctagcgccgtgtccgttgataccggctccgtcttccctgagacccactacttcacagtgtacgaaaccaaccttgtccagacactgcagacggctggcctctcggtctacgtctacactcttatgaacgagtttctgtctcagccatacgacttcttctcggatgctacagcgcagatcaatgcctatgttaagggtgctctggtggatgggctaatcacagatttccctgctacggctcgaaggtacaaggtgaacagctgcatgaacatggggaacagcacaccgaatttcatggcccctgctcgtccgggtgatctcatgcaaagcatcagcaagagcgcgcagccaccagctttggctcccgttccacccttgactggttccgacgtggcggagccgcctttacctcctgcgagatcgaacagcagcacagctccgacgcaatcactcgcgagcaggacgcgtgcttgcgctgctcacatcccagccctggcctcactggcaatgctttgcgcctggctttccctggtatgagcttgcagtgcaggccgccctagctccgtcgctcgactgctcgagctggaccgccgatccactcatcggatgttcttctccacccatagcagtagctcatttgttcagtgaatttgcatctacgggcttgtgcggaatgcgtacgacacttctgtgtgagctatcactattcactactgacgtttcagtacatatatgttggattggatgggtaatatattgcctacttctc

SEQ ID NO: 236 - DNA, 1189 bp, Oryza sativa
gtacggccggaagctatctaaggactgcagctatgggcaatttgttctgctgtgttcaagttgatcagtctacagtggccattagagaacagttcgggaagtttgatgctgtgcttgagccaggatgtcactgcctgccttggtttgctgggaagcgtatagctggccatctcacactcaggttgcagcaactggatgtgcgctgtgaaaccaagacaaaggacaatgtgtttgtcaatgttgtggcatcgatccagtacagagctttggctggcaaggcaaatgatgctttctacaagctgagcaacacaagatctcagatccaagcttatgtcttcgatgtgatcagggcaagtgttccgaagctgaacctggacgacgcatttgagcagaagaacgacatagcaaaggcagtggaggatgagctggagaaggctatgtctgcttacgggtttgagattgttcagacgctcatcgttgacattgagccagacgagcacgtgaagcgagcgatgaatgaaatcaatgcagctgcgaggctgagggtggctgcaaacgagaaggcagaggcagagaagatcgtgcagataaagagggcggagggagaagcggaagcaaagtacctgtcggggctgggtatcgcgaggcagcgtcaggcgatcgtggatgggttgagggacagcgtgctggggttctcagtgaacgtgccgggcaccacggccaaggacgtgatggacatggtgctcatcacccagtacttcgacaccatgaaggagatcggcgcctcctcaaaggcctcctccgtcttcatcccccatggccccggcgccgtccgcgacatcgccacgcagatccgcgacggccttcttcagggccaggctaccaccacctcccattagcatccatgtgggacaccagctgtgggattgctaagctgctgtttctcttgatttgtcctgtgtgattagatatgtcttgtaatttcttcatgctagctgtccgaccgacgtgtgtgcgcgcgcgggcaacattttcattttagttgtgaatgatatcctatcgtgtatgtatgtgtggaactatgccttgtgaaaactttgtgaaatttcagcgtcaaacatgtaaatgtgcatgtaatccggttctctgtattgtattacttgtatgatatgccgtctcgagttgtgca

SEQ ID NO: 237 - DNA, 1476 bp, Oryza sativa
gaagtggatgagaggaggcgatgagaatggccgcgccgcagcaagtgcatgtgcgtgccgccccgctcgcgcgcgcgctccgaactcgcgtcgccgccgccgccgcgtctgcgagctctcccgaacgcgcgctcctcggcctctccgaaccggatctccggcagctcgccgtcgacctcggccagcaaagttacagggggaagcagcttcacgacctcctctacaagtccagggccaagcaaatccaagaatttagccacgtaccaaaggtgttccgtgaggccttggtcggcgctggctggaaggttggccgctcgccagtgcaccatgctgtgacggcctccgatggcactaccaagatacttctcaagttggaggataacagattgatcgaaacagtagggatccctgtcgatgatgacaaaggcccgtcaagactcactgcctgcgtttcatcacaggttggctgccccttgcgttgctcattttgtgccactggcaagggagggtttgcaagaaaccttcatgcacatgagattgttgagcaggttttggccatagaggagacgttccaacacagggtgacaaatgtagtgttcatggggatgggtgagcctatgttgaacctgaaatcagttttagaggcacatcgatgcttgaacaaggaactaaaaattgggcaaaggatgataacaatctccacagtaggtgttcccagcactataaaaaagttagcatctcacaagcttcagtcaacacttgcagtcagcctgcacgccccaaatcagaaactacgggaaacaattgttccaagtgcaaagtcatatcccttggaggcactaatggatgactgcaagaattacttcctcgaaactggacgaagggtatccttcgagtacactctgctagctgggattaatgacgcaaaggagcatgctgaagaacttgcagagctactgcatacatgtggcggtggttatcatgtgaacctaattccttataatccgattcaaggttctgaatacaagaggccctacagaaaagtggttcaagcgtttgttgatgcgctagaagctcggaagataaccgtaagcgttcgacaaacccgtgggcttgatgctaatgccgcttgcggacaactaaggaatgagttccagaagaatccactgcttgaatcatcaccttcatcagagcccaacctcgtaccagcttgatgagaagactgagttcatgatggccatgcacaatgattgcagattatcagtccatcacactgaaagctgatattgtactcgtagttgttttcggcatttcctgatgtatttgaattttcaagagttgttataagtagatatatatttagtgccacatacgggtgctatagaatcattatgcacattgcttaggtatgtaatctgcctgacgttgtgaaaaatggctcttcctgaatatcaccagatgcgaaaatttccacac

SEQ ID NO: 238 - DNA, 3724 bp, Oryza sativa
ccccgacgcaacactccttcacctaccgcggctaccgagccaccggccaacccctccccctccctccaaaacccgcacgcgcggatcccgtcgcgagagccgaaatcacacgtcgccaccgcagcagcagccgcggcgcgccacgcggccgcggcggaccccgcccgcccgccacgtcccccgcgccgccgaccactccggcacgtagtaggccgtgagacatccaccatatcttccccgcctcggcgcgcgcgtactcctacgtctacgtgcgtgagccccccacacaccctcgctcgccgcgccgccgtctctagttttttttttctaaaaaaaaaaaagcctcggccgccgcagccgcccctgcccatcgatcgcggcttgtctcttccccttccctctgcctggcgtggagtactactgcgctactagagagtttgctggtggaggaggaggacgaggaggaggaggctgggtggtggcggccgccgcgatggacataacggaggtgacggtggtgcaccacgcggcgctggtgctgctcgcgctctgggccgccgtgtcggccgggtgggcgcacccggcgatcttcctcgccgcgctcctctatctgttcgcggtgaatgaacgatacacaatgaggctgcgaaagcgaatacaacatgaggaaaggaaatgtgcaaaccaaagaaggcttctctctgatgcagagactgtcaggtggttgaattatgctgttgagaagatctggccggtttgcatggaacgggttgcatctgagcagttccttttgcccatattcccatggttcctggaaaagttcaaaccatggacagcgaggaaagcagtgatccaagacctttacttgggcaggaacccaccaatgtttacagatattagggttgtcaggcaatcaactgatgatgaccatctggttttagagataggaatgaacttcctatctgcagatgatatgaatgcaacaatggctgtgcaacttaggaagagattaggatttggcatcacagcaaacatgcatataactgggatgcatgttgaagggaaggtcctagttggggtgcgatttctccgacagtggccatatattggtcgcgtaagagtgtgctttgttgagcctccatacttccagatgacagtcaaaccattatttggtcatgggcttgatgtaactgaacttccaggaatttctggatggcttgacaggatgttggatgtcgcctttggacagacccttgttgagcctaatatgctagttattgacttggaaaagtttgcatcggaatcaacagatagctggtttagtgttgatgagaagccacctattgcacatgccaaggtagagatcttggaaggtgctgatatgaaaccctctgatccaaatggattagctgatccatacgtgaaaggccatcttggaccctatcgtttccagacaaagatccacaagaaaacactcaatccaaaatggatggaggagttcaaaataccagtaacctcatgggcagctctcaatcttctctctcttcaagttcgagataaggatcccatctttgacgacacactcggtgactgttccataagcatcaacaaattgagaggtggacaaaggcacgacatatggattgctctgaagaatataaagacagggcggattcatatagcagtaacagtacttgaagatgaaaatgaaaaggttccaaacgatgacgatgagcagtgtggaacacccaaggggggtaaagcaagcacaccaaggtctagcttttcgtccaggaccaacaatgaaagtgaatcatcagaggagtttcgaaagatatctgctgaatatgagccagtagacattgaaggactggaaaaggttgatgtttgggtccatcggccaggcagtgatgtcgcagtcacttgggagcctcggaaaggacgtgcgaggtgtcaggattccagaatcctacgagagaatgatgtctactgtgacagccctaagtcgtgccaatcagaatctcagagaagtgactccagtactgaagaaccagccaatggcaaatcacgccatcatctccacaaggtcaaaaagggtttggggaaactagctggtgcgatgttcaagagcccaaagaaagagagtgatgatgaagcctcgccatgtgtgacgcctcacccaaatataaaaccacttggagaaaaaagggtgtcagtaagatacgtcgtcgatgaagatccttctgaaaacttgccagatgaccagcattccagtcctgagagaggcgagtcggaaagtccgaccaagaggcatttgaggaagaaggctgtgcacatggtgaaacatgcggggaacaaaacagctcataatctgaagaacatgttcagcaggaaaggcagtgacaagagcaaagaaggccaagatgaccagaaagacgatcctgatactatagtagtagaaccttcaaaagttaagaaagacaatcctgatgcaagtgaggtagacatagacccttcacaagttgagaacgacatccccgattcaacggcaattgaccctttgaaggttgattctaatgtggccaacaacattgtggttgatgcactagagtatgcatctgaatctgatgcgaaggacaaaccacagtgaaatgtgttctgctatttttggcggtcctcgtgctgttgggactgttcatgtaggcaggatactaggtagcaaaatagtctgatagcctcctgacagcaagcgaaggttgacagtatagtccgtttggttggttgagtcctccatcttacctgacgaccgatgtttttcttgtattatagatgctcaaggaacaatacctctgtacatgtcgtatgcagactgtctaagctgtttgcttcttggacatggaaagcaggtggccggttggctttggcaaggtgttggataggagagaacggacaaggagaaccaaaaaaaaaaaaaagagattgaaccaagcctattatgtgaccatgcaaaagtagggaacatgcccatccccatccatatactcctttgataatacaaaagtaggagtactagttttgtatagaataatagaattagcctacttgctttagatgtagtctttcagcgtacagtatgtcagtactacagttacatccctaaagttgcgtactttgggaacaatacatcaaaataccaaagtatgggacatccctaaagttctgtttttttttcaacattccgtgcataaaatgaaccatcaagtacatatgtttacttaaacaccatgggaatggggaagattaacttgccacctgatcaatattttcagaaatacctctcatctctggttaattgcattctggttcaggcaatcgagagtgggtgtcctaatccactccactcgcctcccagtcatgagggcgatgcggtcagcgtcaatccacccggaggcggtgcaagccgtcgaggccgccacgtctggtgccggaggaggtggagcggcgccgatggcagggcagatcccgtggcagatctagatgtgaccatggatagcagtgaccaaggatgggcaaagccacgacaaaatccaatggctgcagtagcgtcggtgacttcccgtgcggcggtagtggatgttcctgatgtgttcaatattgtagtgttcttggatgtacttggtggtcttggacaccgattaatactgatgaaatttggtaagtgaag

SEQ ID NO: 239 - DNA, 947 bp, Oryza sativa
ggccccgaagagaggcgcgaaggcgccggtgccggcgaggaagaaggcggcggcggcggcggtgaacccgctgttcgagaagcggccgaagcagttcgggatcggcggcgcgctcccgccgaggaaggacttgcaccgcttcgtcagatggcccaaggcggtgcggatccagcgccagcgccgcgtcctcaagcagcgcctcaaggttccacccgcgctcaaccagttcacccgcaccctcgacaagaacctcggctgccagaaggaaaggcttttgaaaagagcgcaagcagaggctgaagggaagactgttgaagccaagaaaccaattgttgtgaagtatggtcttgaccatgtgacctatttgattgaacagagcaaggcacagcttgtggtcattgctcatgatgtcgaccccattgaactcgtcgtttggctcccagccttgtgcaggaagatggaaatcccttattgcattgtgaagggaaaggctcgtcttggatcgattgtgcacaagaagacagcatctgtcctttgtctgacgactgtgaagaatgaagacaagttggagttcagcaaaatcttggaggccattaagtcaaacttcaacgacaagttcgatgaggtcaggaagaagtggggtggtggtatcatgggctcaaagtcacaagccaagaccaaagccagggaaaagcttctagccaaggaagctgcccagaggatgacctaaagaactagcctgaaattttgcgttgtggttgttactaggaacacattgtgatcttataacttcggtctgcaatgtagtatgcttatagttattatgtggatgtggaccttgagtgtactttaaattaaaattaatacctattcctgttgcaactattatgtggagtttacagcagaattagaaatgaattcactattggtgttgggtgtgggctaaa

SEQ ID NO: 240 - DNA, 1133 bp, Sorghum bicolor
ctcgtctgaatcagtcagcaagctcatcagctaacccagcttggatgccgatgcttctcctagctgagcttcgggcccgggcattgctggtggccggtcggcggtggctagccgcgtcagggtttgtttttgtacacaccacatcacatgaactcagctgccagccaaaggcctgtattgcatgctgcggatccggccactgctggacccaatgggccgtcccgtgcttttgtttcccctcccggtgccaaggcttgttctttcaatttcaagcatccgtggtattatcaagccaagccatgtgagagtgctgcagataaggttctggattgacagccaatcataggctccactccacttgaaccaagaacaagctatacgtacgtacgagcaagagcaatccaagcatccgttgcgtctgcactgcagaggccgtagctcgctaggaggatcagcgatgccttcccctacgccgcctccgatgtccacgccgcacaagtcctgctcgtcgccgtcgccgccaccgccaaagctgcagcgtgctccggacatccggcacaggcctatctgtagagcaggcggcggagcctgcaggctgccgatcaccaggagagctcacgccgcatccctcctcctcctcggcctcgcgccggcgccggcgccggtcagggcggaggaggatgggagcggcggcgaggagggcgtcctcggcgccatcaagtccatcttcgaccccaacgagaagaccaaggccggcaagacgctgcccaaggcgtacctcaaggcggccagggaggtggtgcgcacgctccgcgagtcgctggaggaggacgacggcggggacatggccaggttccggcggaacgccgacgccgccaaggagtctatcagggagttcctgggcggatggagaggccagcagaccgtcgccgccgaggagtcgtacgtcgcgttggagaaggcgatcaggtcactggcggagttctactccaaggcagggccattcgcgccgcttccacaggacgtcaagaacaagatcctcgatgatctcagcgccgcagacgcctgcctgtagattttgcttctccaggggcattgtattgcatgcacatctcaaccatgatgatttcgtt

SEQ ID NO: 241 - DNA, 2237 bp, Sorghum bicolor
ggctccaactgaacggagcgagtagcccccaaaactactcgccggcgcgggcgcggaggcggaggcggaggcgactgcgagctcggcggaggcgatggacggggaggaggaaagggaggaaggggaggtgggggagtacaagctgcagagggtggtggggaagggctcgttcgccgaggtgcaccgcgcggcgcaccgccgcacaggcgcgcgcgtggcggtcaaggcgatcgaccgccgccgcgtcgacaagcgcgtccacgacggcatcctgcaggagagggagatcctcaggagcatcgaccaccccaacatcctccgcctcctcgacaccatcgacacgaagaagatgatgtccctggtgcgggagtactgcgacggaggcgacctcgatgggtttttgcacaagcacgcccggctgccggaggccatacccaaggacttgatgcggcagcttgcggaagggctgaaggtgctgagggggaggaacatcgtgcaccgggacctcaaaccacagaaccttctcctatcaaccaatggtgatgccatcgtattgaaaattggtgacttcgggtttgccaggtcactggtgcatgaaaatttagctgccacaatgtgtgggtctccatattatatggcaccagaaatttggcaagggaaagactatgatgcaaagtcggacttgtggagtgttggcgtcattctttttcagctagtcacagggaagctgccattcaccgggagtaatgcttttcagctgcaccaaaatatcctggctgccgatgatcttaacttcccttcagaaattgaagctgatttatgtgctgattgcattgatttgtgcagaagactcctgcaacgtgatccaagtgggaaatgcgatgaatcctgtcaggctatagagttaaggaataactgccagacaatcacctctcctgttgtcctaaaaacaaagtctgaaagcattgaatcaaaaaattcgaaagtttttgattcatgggaatggattgaacgagaatatgtgcttgttccggtaaactgtacttctatggaaatgtcttcactcaacatcaacaagtccacaaaggatgatacagatataagaactgccagctatgataggcccgctgccaaagggtctgctcaaaatcaaatcagagacttaactgatacagctactggtatacaaagccatggatgtgctcctgtgctcatttcccaggagtcagccactgtggactgtagacgagggaagctacctgattatattacaaggtttcattctctgaatcaatatgtgcttgttcttacggaacttgctcgggaaaagctttctaaaggcctgtacttggaggcgctatcaattgaacttgtattattagctatctggaaagaggcacttgatgcatgtagcttactcatggatgcatcagatggtgaaaatttctctaaatcttctcaagaacattcccttcctatgagtggccactcacctctgaatgtagtgcgagggttggatttcactaggacggcttctgttttttcctgggttgaaagtgggttcatgaaggcatatgatcgtgcagagaagatatcgcatgtattgcggaagagtgacgataataccgagatgccagatgcaatggatgtcgtattccaaactgctttggaatatgggaagactggagctgcaaatgaagttttgggacaccaaagcagatccacagcgctatactcaaagtctatcatcttgctcacatttttagtacaggaagcacctatgttgccactaaatccaccgctttccctttcgccgtcagatcagcaacgcatccataggtacatagctaacttgaagagccatctctgctgtgctcaggttgcagggcaacagcagagatcagtttataactgaacatggttgctcaaggattgaaaagattaatttatctgcatctggtgaggttttcttgtgctctggtgcagcgttagtccagcattttatttttttttgggttctataaggaggtggggtgttcaattctttggtgtcatgaacctttgtaaaattgtagttgccgaacaccatgatccttccccctcttttgtatatagataacacctacaagctctatatggtcgtcccttaccatgcatatgttgcaatgactctgaacttgtatatatttgtgactttgtaagtgccttgtgcaaacctgtaaatagaaactggttcg

SEQ ID NO: 242 - DNA, 1969 bp, Sorghum bicolor
cccatcctctcacggatggcttcggcggccgcgaggggcgccgcggcgcgctcccctctcctcgtccaccaccaccaccaccgccgccgcggcctccccctggtgcatcccggcggcggcgggggaggctccctccgggtgggcgggcccgggattgagcctcgacgggaggggcggaggcgggcccgggtcggggttagggttttcgctcgctactcccaggcccaggatttctccacacgcctccaagatagagttggcgagttgcctaaattagtcgaggaccttctccagacgtcgattagtacagggcctcgaggtgctttcaggatggcacaagggatccaagctgtgcttggggttggcggggagtggctgaatgacctctcaaagacagccaacacagcagcaggaattccatctcagatgcagcttggtttactttctccagtttaccttagaagactttttgagcgcatgggtgcaacttatatcaagttaggtcagtttgtagcatctgcaccaactttgtttcctgcagaatatgttgaggaattccagaagtgctttgaccaagcaccagccgtcccatatgatgtgattgaatcaatattacgtgaggagctgcagcggccattggatagtgtatatgaatacattgatccggtgccaatagcctctgcctccatagcacaggttcatggggctaggttgaagagctctcagaaggatgtggtgattaaagttctaaagcctggtattgaggatactttggttgctgacctgaattttatctatgttgttgcacgtgttttggagttcttgaaccctgaactacagaggacatcactggtaggcattgtcaaggacataaaggaatcaatgcttgaagaagttgactttagaaaagaggctgcaaatattcaggcatttcagggatacctagatgcaatggggtttgacaggcaggcaaaagccccatttgtgtatcaacactgtagtacaaaacgtgtgttgactatggaaagattgtatggagttccgcttactgatcttgattctataagatctcttgttcctgatcctgagttgactttagtcactgcccttaatgtctggtttggaagcttgatttcatgtgaatccttccatgcggatgtgcatgctggaaacctatggttgctccgtgatgggcgaattggttttattgatttcgggattgttggtcgaatatctccaaggacttgggcagctatggaggtctttttggcttcttttgcaactgaggattatgatgctatggcctccgccctttctgaaatgggtgctacagggaatgatataaatatcaatgaatttgcaaaggacctgcagaagatattctcatcaatacaggacttggatactgaaatcatagttgcaacagcaaggacccctgatgctacagcagtatctgctaatgttgtccttgatgagagacagatgaatgctctatttcttgatctggttagggtaagcgagtcttatgggctgaaatttcctcgagagtttgctcttctcatgaagcagcttctgtattttgatcgctacacaagactgttggctcccagcatgaacatgctgcgagacgagcggatcaacatctccaccaatcggcaactgagaagaactgatagattttagtgacaccattttattagtcaccagacatactagaggagttgtgatgggcgataatagcaaagctcatgtgacccaatactgtatatagttttgccagaccagcatagaaatgaaccacactagaaattgtactcttattcgtattctggaattcggcgttatatatgtcgtactagctataggcaacatgtaaaaactgtatgtaaactgtcaagtaaattttagtagacaaatcaagttaagatgcagctgtactatactacaactgtcagcacaaaaagtgatg

SEQ ID NO: 243 - DNA, 1696 bp, Sorghum bicolor
cgccacaccgagccaatggagcccgcgctgcgcgagctgtgggcggagtcccgggacctgctgggcctcccttcctcttctctggacgccgccgccgccgccgccgtgccgcgcgtcgacctgcccccgacaccgctcgcgttcctccgcgaccacgtttccccgggccgcccgctcctcgtctccgccgcggccacccgccactggcccgctgtgtcgctctggcccaccgcctcctacctcaccgacgcactccgctccaccgccgtctccctccacctcacccccgacggccgcgccgacgcgcttgcctcgcacccgcggcgccccggcggccccggaccctcgaggtgctttgcatccgcgcacgtccgccgcgtcgacttccctaccgcggtccggctcatcagggcatccgacccggccgccggcctggtagcgtacgcgcagcagcaggacgactgcctccgcggggagtacgcggcggtcgccggtgacgtggatgcgcacgtgccctgggccagcgaggcgctcggctgcctccccgaggccgtcaacctctggatcggcaacgcccactccgtcacctccttccacaaggaccactacgacaacatttacgtcgttgtctccggcgagaagcacttcctcctgctgcccccgaccgagcaccaccgcctctacgtccgcgagtaccccgccgcccgctatgttgccgcagagcaggactccgaaggggagcatcagttgaggcttaagctggagatggaagagcccgagaggatcgtgccgtggagcagcgtcgacccgtgcccggcgtcgccggaggagatggccgtgcaggcgtcgtcgtttccgctctacttcgacgggccggctccgatgcggtgcacggtccgggccggcgagatgctctacctgccaagcatgtggtttcaccatgtcagccagagcccagggtcgaacgggctcaccattgccgtgaactactggtacgacatgcagtttgacataaagtatgcctacttcaacttcttgaggtcgctggatatcgatggttgttcatcgggcaaagctggtgcgttggaaggtgatctagaggagaagaaagattgagatggcgggcagtcactctgattactcctgtttcttgcggccattgtcttacagagtaacagatcttcaagcattagaagatgttgctggacaccaattaatcggccatgtatatttgtacaacatttgcaggtgccaattgacatatcaggctcaatatggttgcaactagaacatttgatttggtggtgcattggcaaattttggctgcattcacaaaagagaacatgaattttgaattgtgtccatgtgttcctgatcctctctgttcctagtgatgattcttcgtatcctgcattatattcactggagggatggattgtctttgtagaaatcagaaggtcaagaccagctaaagaactgtgcagggtggataaagaacatcatgggtgagacgctccctttacaggttggatcaagtatgcctaattcataaggttgaaaaccaagatgaagctatgtcgacgggagtttccggcgtggaagaagtgggaaagagggcagagtttctcttttgtccatgtgttgatggtcagactacgttgttgttgttgtgagagtcagcacccaaatcaatctg

SEQ ID NO: 244 - DNA, 843 bp, Sorghum bicolor
cacacaaggcgagctctatagccaggagcccaggacgccggaccgggaccgccgccgcgaaccgccgtccgactcgctccgcacctccggtcctccaaaccggcgctcctaccctcgctgcaatggagtcgaggaagccggcgccctctcctctcgtcgacaactacgtggtacccggtgacgtcgtcctggacctctccgagatgaacaaccagaccattaagctcggcgcaggcctgcgtcaggagtgtgacaccatccaggctaccagtgctgggaagctgcggctgttgaaacccaacaagtattggattgagaactcccagaagaggtatataccttctgtagaagatacagttcttggtattgtggttgacaccaaaccagataactttttggtagacataaagggtcctaatttggcctttctaccggtgcttgcatttgaaggtggcacaaggagaaacataccaaagtttgagattggtacgttaatatatgctcgagtggtgaaagcaaatagtatcatgaatcccgagctctcatgcatggatgcttctgggaaagctgctgaatttggtcagctgaaagatggttatatgtttgacacatcaactggcatgtcacgaatgttgttaagttcgccaacatgtccagttctggaggcccttgggaaaaaactgtcatttgagattgctgttggactcaatggtcgagtctgggtgaatgctcctgcagcaagtactgtcattcttgtatcaaatgcaattatgaggtcagaatctttgagtggcataaaacaaagagctatggtagaaaatctcttggagagattgtcatgat

SEQ ID NO: 245 - DNA, 1171 bp, Sorghum bicolor
gtgcgtcgaccatggccgccgcggcgcacgaggtctccgccgtgatctttgatctcgacggcaccctccttgacacagagagggcgacaagggacgtcctcaacgaattcctggcggcgtacgggaaggtccctgatgcgcagaaagaggagaagaggctgggccagatgtatctggagtccaccactggaatcatcagagattacgggctgccgctcacggtcgaggagtactccaaggcgatgcatccgctctacctgagaaggtggcaaaaggcgaaaccgcttccaggagtgaagaggcttgtcaagcatcttcacaagaacggagtgccactcgcaattgcttctaactccgttaggagaaatattgatcacaaacttccgaaactagaagattggggagagtgtttttctgttattcttggtggagatcaagtccctaatgggaaaccttcccctgacatatttttggaggctgcaaagaggcttggtgtaaatccatcgtcgtgcttggtcatagaagattctgttgttggcgtcaagggtgccaaggcttctggggcaaaggcggttgcagtaccatcacttcaaagtcagaggaaacactattatattgctgatgtcatcatctattcacttttggactttgatcctgagctatgggctcttcctccatttgaagatcgcattcaaggtgtactgccgattgatcccttactttcaaatgccaggataggtgataaaattgtaaacaatcttcattgggtaatttcagatgactgtacctacgagtgtattcctgaccaaatatcaggaatttatttgggttgggccgagtccaaagtgcatggactctccaaggttatcataggtactgggtgggacttctcacagcagactgtcgaaagagtgatgcaagtagattttcttgattcctctggcaggattgaaacagagcctgtgaagctgcttgtaattggctacatccggaagctccaaagtgcggatgatatattgcaagctttaagtataaccgacgaagacaggagcattgcaagggaagcattggacctcccaactttctctgaatatgctaatgaccttcatcttgcctaagtcgggccttatcattgcaatctctcacctcactgcctcacgtttgtatttgt

SEQ ID NO: 246 - DNA, 1750 bp, Sorghum bicolor
ttttaaggttagttagtttatgattagacgaaaataatgaactaaacaaggcctagttcataaaaatacatgacgacacatcaatcatcatcatcaccaaataatgaccgaggagcctcacacagtcacacatccggcattccctgtttccgttgctgtgtcgcactcgcacgcctcgtgctcgtgctccctccgccttccttcccttccaccgtttgctctgcgtggccgcgtctccccagatcgcaattcgcaagaaacgaaccccgcccgcaacccaccctctcaccgcggcatttcctcgaacgccccgcgcgtgccgcgcccctcgccgcccatgggctccctcccggtgccagcctcggcggaatgcgccccgcaggggcgcgccacggtgtcggcgtcggacctggcgccgctcttctccgcgcagcgccggcacctggaccacttcttcgacagcctcgacatgtcgcaggcggcggcgttcgcgcaggcgctgatcgacgcgccgggcgccgtcttcttcacgggcgtcggcaagtcgggcatcgtggcgtgcaagatcgcgcagacgctggcgtcgctgggcttcgcgagggcggggttcctggcccccgtcgacgcgctccacggcgacatcggcgcgctcttccccggggacgtcctcgtgctcatctccaagtccggagcctccgacgagctgctcgcgctcgcgccctgcgcgcgcgccaagggcgcctacctcatctcgctcacctccgcggcctcgggggctgaatgcccgctcgccgcggcctgcgacctcaacgtccacctgccgctgcagggagaggtgtgccccttcggcctcgcgcccgtcacctccaccgccatccagatggtgtttggggacaccgtcatcgccgccatcatggaggcaaggcgactctccagggaccagtacgcctccaaccatcccgctggcaagatcggcaagaccctcatcttcaaggttaaggatgttatgaagaaacagaatgaacttcctctgtgcaaggagggagatatgataatggagcaactcactgagctcaccagtaaaggttgtggttgtttgcttgtggttgatgaagagcatcatttgattgggaccttcactgatggtgatctccggcggacattgaaggcaagcgggccagctatcttcagtctcacagttggagagatgtgcaacaggaatccaagaacaataactgcggaggcaatggcagttgaagccatggagaagatggagtcacctccttcacctgtacagttcttgcctgttatcaacgataacaacatcgtgtgtgggatcatcacattgcatggattggtctctgccggattgtagacttttgtgcatcatcgacttctgctggattgtaagcttatgtgccagcttaccgggttctaaacttctagttgcagttgcagatatccttgctgcccaggaggcattttattgctagagtatttatgtgaagcctagactctttagtgtacccttatgtatagtggtggataagaggaatatggtacactgctgttttgcagttggctgttaaataatgcttgtgttttgtacataacttatttaaaatgtcgattatcttggtttctcttaacgcatctgtgtgtgttgcagactgagctcacgcactttgtttggcttaaacatgttcaaatataacgtccatcttttctagatgacagattgtgtcgtgct

SEQ ID NO: 247 - DNA, 4159 bp, Sorghum bicolor
ggttccgatggagacctcggaggcggcggccgcgcatccgcagaaggatagcgtgaaggtggccgtcaacataaggccgctcatcacggctgagctgcaggagggctgcacggattgcgtcaccgtcacgcccggcgaaccgcaggttcaaattgggccccatgtcttcacctttgaccacgtctatggcagctcgggtccttcatcatcattaatatttgagcaatgcgtgcacccgttgattgatgcattgttcagcggatacaacgccactgtcctagcatatggccagactggttctggcaagacatacacaatgggtactgactacagttgtgaaggcaactctggagggataattcctcaagttatggatacaatatttagaaaagttgatacctcaaaggatggctccgagtttttaattagagtgtcttttattgagatattcaaggaagatgtttttgatttgcttgatgcaaatcaagctgctgcaagacctgatgcaggttctatggcaaaagcatcagcacctggcagagtgccgattcaaattcgagagactgcaactggaggcataacccttgctggtgtcacagaggctgaggtgaagtcaaaagaagaaatggcatcatatttgacacgtgggtcctcgtcacgtgcaacagcaagcacaaacatgaataggcagtcgagtcgctctcatgccatctttacaatatgcgtcgaacaaaagagaatatctggtacatctgacaagtcagccagcagtgattatgacataatatcatcgaagtttcaccttgttgatcttgctggttctgaaagggctaaacgtactggagcagatggacttaggcttaaagaagggatacacataaataaaggccttctagctcttggcaatgttataagtgcactaggcgatgaaaagaaaaggaaagaaggagcatttgtaccataccgggatagcaaattaacccgtcttttacaggattctctaggaggaaatagcaaaactgtcatgattgcatgcattagccctgctgatataaatgcagaagaaaccataaatacactcaaatatgccaatcgcgcacggaacattcaaaacaaagcagtggtaaaccgtgatccagctacagcagagatgcaaaaattgaggagccagctggagcagctgcaaactgagcttttgttttcccgcagtgggagtgcagcgttagaagaacttcagttgctgcagaaaaaggtctctcttcttgagctaaagaattctgagcttaacaatgaactcaaggaaagggaattgtcatgtgagcagttggcagagcgggcacgggctgctcagttggaaagggatcagttgatgctgaagattgaatccgcgaggaatggaaaatcatgggatgatattgaaaatgctgataatgaccaagacatggacctcttgaagggctacatatcgaaagtacagcagttggagagtgaactgatgcggcaaaacttctccaatgcttgcagacatggcttaaatgatcaacttgccatggagcgggacattttactaaatgaattgggttctggatgtgaagtaggaacacctgatgcttcaagtgaagttgatgaagaagaaaaggagagagaacattcatccatgcaagaccaacttgacaaagagctgcaggaactagataaacgtcttcagcaaaaggaggaagagatgaaacaatttgccaagagtgatacttctgttctcaagcaacattatgaaaagaagttaaatgagttggagcaagaaaagaaagctcttcagaaagaaatagagaatcttcgccatgctttaaccaatatatcttcttctacggatgacaatgctcaaaaactgaaagaaaactatcttcagaagctgaatgcacttgaatcccaggtccatgagctcaagaaaaagcaggaagctcaacaacagcttctaaggcagaaacagaaaagtgacgaggcagcaaaacgtttacaagaagatattcatcgtataaaatctcagaaggttcaacttcaacaaaagatcaagcaagaatctgaacaatttaggtcttggaaggctgcccgtgaaaaggaagtacttcagctcaagaaggaagggagacgaaatgaatatgagatgcacaagctcttggccttaaatcagaggcagaaaatggtcctacagaggaaaactgaggaagcagcagctgctacaaaaagattgaaggagttactggaagcaaagaagtcatcacgtgaaacatatggaggtgcaaatggttctgggatgcaggccttaatacgagctattgatgatgaactggaagtcactgtaagagcacacgaattacgctcatattacgagcgacaaatgcaggagagagcagcaatatccaaggaaatagcaaagctgaaggaggaatcaaagcacaagatgagtgattgtcctcaagctatgtctcctagtgctagaagttctaggatatcagcattagagaacatgttatcctcatcatctagtgccatggtgtctatggcttctcaactgtcagaagcagaggagcgggagcgtgtattcaatggtaaaggtagatggtaccatgtcaggtccctcccagaggcaaagaacataatgaactaccttttccagtcagcatcatccgcaaggtgtcaagtactggataaagaggtgatttgtaatgaaaaagaacacaccattagtgaattgaaggaaaaggtggttgtgcttaatagtggaatgaggcagttagaaacacaactgatggatctaaggagccaaaatacacagcttttcactgcattgaataatgcaaagaaatctgctaggtcaaatggcactggatttgctcagcgtaagagcgttcgatcttcccagcattttggttgtagtaaggacaacttcatcaattgggtggacgatatggacatttcagatggtgagcactcagacgagttagagagtatgagtgatggatctgattcagactgggtacagtcgaacaggaaagcgaaaaaacatcagagaagagtgtctagcaattcaaatcataagctggattgtcaaaatacacaagacaatgcagaaccagagaagccctcagatgaaaagtgcattctgccaaaaaatcttccatcagacggctgttcatgctcaaaatcctcatcatgcaagaccaacaagtgcgagtgcagaggctcaggtgcacaatgtggtgcaggctgtggttgtaaggactccaaatgttctaacagggattcttcttctactaaagaaaaggccaatcagggagccatgcttcttcagaacgcgttttctgagaaggaagcccaagatgcaaagccaagaaagcctttggctaacattggtaataatgtggttaaccaaactgccgagacagagaagaagcccaggaaaaactggcgcaagtcgacagttcaactcgtcccagggcctctcctgccgtcggagccagagaccaccgaagctgctcctcgggacagagccgatattcctctcaagctaccgagagccatgtcctcagggactcctgcggagagcaaccctccccccctcacggaccgcaatgctgccaagccccaccaatccgtgagcacaggcaacaaggatagcaccggaactgccgccacgaggccaccgtctcagctgagaaaaaacgcagccaccgagaaggagaaccagttgcgataattcaattgctgagtatccgtgtcggggaagtcttttgtcttaacagcggtggaggctgcctcggcgtcctatggagaggcaggtagaccctggaagggctcgcgctctctcgggttcctgagggatgatgactgcgaaggcaatggcgtgttctgttgcaatgttgtgccttgtaccgttgtacgcgccgccttagctctgctttggctggaacgcaaccatcttgtagtgaacaaaacatggtggattaagttatatatcagtctcgttaatggtctccgttccttttgaacatacttaggaaatcaatctgccaatctgtatgcttagacaatagatactgactgctagagatgctattggttaaggcgtcatctgtgcaaccgtatcttatttcaccaattc

SEQ ID NO: 248 - DNA, 784 bp, Sorghum bicolor
accaccaccacccatcgccatggccaccaccacgctcttcctcctcctctgcgccgccgcggcactcgcatcagcggcagccgccgccgacgacaccgggttcacgaccttcaagctctacttccacgacatcgtggcggggacgtcgtccccaaccgcggtgcggatcgcgcaggcggcgtcgtccaacacctcctccacctccttcggcgccgtggtggccatcgacgaccctctcaccacggggcccacgcggtcgtccggcaccgagatcggccgcgcccagggcacctacacgttcgcggaccagaccacgttcggcctcctcatggtgatgaacttcgtgttcaccgccggcgaccacaacggcagcacgctctccatcctcggccggaacgaggtgctcaccgacgtccgcgagatgagcatcgtcggcggcagcggaaagttccgcatggccaagggctatgtccaggcgcacaccattgattccggcgccaccaccggggagaccgtcgtccagtacaccgtcaacgtcaagacgccctagctagcttagttggtttcttgctccggccggccgggggcctgctggtgctgccatggcttgttgtattgtgtgcgtctccggcagctttgtacacacctgcttttgccgttcttcggtgttagtacatgacatgacatgtggtagattgagatttcagatcgactcgatcttcatcactattgagcgggatttatttggatttgcagaactgaatttctagtactacgcttaaag

SEQ ID NO: 249 - DNA, 2114 bp, Sorghum bicolor
ctaggaattcatctcactacagaagtagtagaagtgattgacgagtggggcatggagcaacacctgctcaccaaattcctccgctacaaaacaaaagagaagcactagctgtctcgcactcgctcttcttcctccaaaccccaaaccctcgtcgctttccccacctgcggcggcggcggcggcggcacggccatggccttccggctccaggcacggccaggcttcagggaccgcagcatccagggcctagctcaccgcggaggcagggacccacaggagctggaagcgcttttcggccgcgtgctctcctacatccaccatgcgctccctaccccgcccgtctccgtcgacggtgacctctgcatcctcttcgacgccgacggtgggggtgtcgaccgcctcagccgcctccccgacaagctcctatgcgacatcgtctctcgcctccccatcaaggaagccgcgcgcacggcggtgctctcccgccgttggagccccatctggcgcgccgccccgctcgtcctcgtcgacactcacctcctcccggccggcgacgacgagatccccatcgacctcgaccacgcccactctgacgccgtggccgccgcggtctcccgcatcctggtcgcgcacccgggcccgttccgctgcgtccgcatcacctgctgctacatggaggaggaccgcgcccgggtcgaacgctggctcaagctcctcgcttccaagggcgtccaggagctcttcctcatcaaccgcccgtttccgctcaccatcgacaagcatctccccgccaccttcttcagcatgaccacgctcacccgcctctacctcggcttctggaggttcccggacacgaccaccctgccacggagcgccgccttcccctgcctccgcgagctcggcctctgcggcaccgtcatggacagccacgacatggacttcgtcctcgccaggagccccgtgctggagatcctcaacattgagggccacctgctgccaccgctgcgtctccgcatcatcagccgcagtctccggtgcgtgcagatcaacgggtccagagtggacagcatcacagtggtagacgcccagcgcctcgagcggatcctcctggggtatgggagaaatgaggattcgtgcttcaagatcaagattacacatgccccagctctgcgcatgtttggaaaaattgagctggcaaaggacgagctgcaggtcggcaacaccatcatcaaggctgggacaatggtgaacccaagtgtcatgttgtcagctgtcacgatcctggacctccatgtccgttttggggtccgcaatgattccaagatgctgcccacaatcctcagatgttttcccaacatcgagacgctgcatatccattccaagaaaactactgaatccactggcaggctcagcaacaagttctggaaggagtctggtgccatcaaatgcgtcatgtcgagcattaacatgctgcaagtccatgatttccgaggggagcggagtgagcttgccttcctcaagttctttattgagagtgcacagatgctgaatgtgcttgtggttgtgtatgccaatgggttcttcagttcaaggggtgaggccaattccaaagtgaaggctctgtttgctgggagaaaggccacacaaagctgtaaagtggtggtctgtgagagtaggttttctgaaggtggtagccgttgggacttcgaacaaggctctgatttctcttttgatgatcctttcggaatcatcgggtgtagttcctttggagttagtcagtggtttgtttaagtattcagatgcaggtattgttctgggtcgtttgagtttctttgcctttttccttaagaaccttaagccagtctcttactagcaattcaagaccatgagcctttgtcttgaggttgctagtaatatcatccacgcaaaagactagtgctacatgaataaatgctgctttctggatgtcatccctatcttctacttttgccaagtgtcttgtgatgttgatgagatgcatagatatctcttgttttccttactttgttccatataatatgtgtttaatttcttgcacaaactatatcgcctgaatgcctgattaagtatgcaag

SEQ ID NO: 250 - DNA, 871 bp, Sorghum bicolor
aaatcaaacatgatcagggcatcaggccaaccgtgcggtttgccagtatccgttcatcagcgtgagggctgagggagagttgccttttctctctcccgtcatcccgtctcctcttcttcgtgaactctcttttccagatcagaagaagctcggaccggcggcggcgggtgacgcaggatctgttctggtggcgacgtcgaacagcacgcggatggacggcggcggcggcggcgacctgcggagcgccatcaagaagtggaacgtcatctaccctgtctacctcaactccaagaagacggtcgccgagggccgccgcatcgccgccgccaaggcctgcccggaccccacctgcgtcgagatcgccgactgctgttcgcacctcaagatcccccacgccatcgagttggataaggcgtacccaagggatttcttccaggtggggagggtcagggtgcagctcaagaaagatgacggctcccccgtcaatcctgctattaaaacaaagaagcagctgatgatccaaatagcagagctagttcccaagcaccacggaaggacaaagaagcaggaggcagcaaccagttcttcagccggtggcagttcaaagaacacaaaaggcgggaaaaagaaaaagtgatggcagtatcattttgtgttttttttttccttctgttcgtcctcatactaagcgtctgtggaagttgtctttctgaggcctgaaaatcattgtgagttttggtgggattttggtccatttgaaaatttatgtacccatctttcatgttatcttcagattcagaagtccacctaacctgaggcagctgcttgatagaactttgactaatcctgcgtagattcttcatttcacaaa

SEQ ID NO: 251 - DNA, 1785 bp, Sorghum bicolor
caccttccgtcagagctcaagatcggccatggactcgccaccgcttagccccgctctgctcgcgctgtccctgctcctcctcctagcgctctacatcgctcgccggcgccgcggcggaggcaggaaccggaactacccgcccgtggcgggcaccgtgttccaccagctgctcaatttcggccggctgatggagtaccagacggagctcgcccagaggtaccgcaccttccgcatgctcaccccgacctgcaactacgtgtacaccgtcgagcccgccaacgtggagtacatgctcaagaccaacttcgccaactacggcaagggggtgatgacccacgacgtgctggaggacctcctcggcgacggcatcttcaacgtggacggcgccaagtggcggcaccagcggaaggtcgccagccacgagttctccacgcgagtgctgcgcgactacagcagcggcgtgttccgcgacacggccgcggagctcgcgggcatcgtggccatggccgctggcgccggggagaggctggatgtcgccgacctgctgttgcggtcgacgctggactccatgttcaaggtcgggttcggggtcaacctgggctcgctgtccggctgcagcgacgagggcgcggcggcgttcgccagggcgttcgacgacgccagcgagcaggtcctgtaccgcttcttcgacgtgtcctggaagctcaagaggctcctcaacatctcgtcggaggcggccatgaaggggtcgatccgcaccattgatggattcgtgtacggcgtcatcgacaggaagatcgagcagatgggcagagaccaacaggaattcgccaagaaagaggacatcttgtcgaggttcctgatggagcgggagagcgatcccggctgcttcgacaacaagtacctgcgggacatcatcctcaacttcgtgatcgccggccgcgacaccacggcggggacgctgtcgtggttcctctacatgctctgcaggaaccagcacatccaggacaaggtcgcgcgggaggtccgtgccgccaccacgggcgaccgcgacgtcggcgtccaggagttcgtcgcgttcttaaccgaggacgccatcagcagaatgcagtacctgcacgccgtgctgacggagacgcttcggctgtacccggctgtgcccatcgatgtgaagtattgcttttcggatgacacgttaccggacggctacgctgtcaagaaaggtgacatggtgaactaccagccgtaccaaatgggcaggatgaagttcctgtggggcgcggacgccgaggagttcaggccggagaggtggctcggcgacgacggcgtgttcgtccccgagagccccttcaagttcacggctttccaggcggggcctcgcgtctgcttgggaaaggagttcgcgtacaggcagatgaagatcttcgcggcggtgctgctctacctcttcagatttgagatgtgggaagccaatgctaccgtgggtttccggcccatgctcacgctcaaaatggatggcccgctgtatgttcgtgcaacgctccggcaatgaggtgggcggcggtgtatgcccccatcgttctagcagcagcactttgaaagtagaattgcgctatttccatctgatgccatcttggataacgtcgaggctcagaatgtactactgtgttattttcagagatgtaggaacaagttggtcagagcaaatatggtttgaccgggtaaattattgtactgccctaagtgcttactatacaatctaaataaacactctgattcagttat

SEQ ID NO: 252 - DNA, 1205 bp, Sorghum bicolor
ttggcgcctagtgcctactccactgtccactccgctccatcctcccttcctccttcccgatgcctccgactacgatgccttccacttccctcgccctccccaccgccgcccgcgccggcgctcgccgccatgccttcttcagcaaccgatcaccctcaagcgtccccatcgcgcggcggaggcgcgcgccccggttcgtcatggtctccgcctcggcgtctctggaggcactcatctttgattgcgacggcgtcatactggagtcagagaacctccatcgccaggcctacaacgacgcgttcgcgaactttggggtgcgctgcccgccggcctccgccgacccgctgtactgggacgaggctttctacgacgaactacagaaccgcatcggcggagggaagcccaagatgcggtggtactttggagaaaatgggtggccttcttcagagctctttgagacaccaccttcgactgacaccgacaaggagaagttggttgacataattcaggattggaaaacagagagatacaaagaaataataaaatctggaactgtgaagcctagacctggtgtgttgcggttgatggatgaagtaaagaatgcggagcgatttaatggtctggattgcttccttgctggtgatgatgttaaactaaagaagcctgatccaacaatatatataacagcatcagagaaattaggtgtcggaagcaagaactgccttgtggttgaggatagtgttattggattactagctgcaaaaggagcagggatgtcatgtataataacatatacaccttcaactgctagccaagatttcaaggatgcaattgctacctatcctgaccttagtaatgtcaggcttgaagacctcaagctattactccagaaaactcttgttactggataatacatgcgattattccctggatgttgaacatttggtgctggatgttgagcaataggtgaatccaagatatacatcttgttgaatagttggtgttatatgttggaagacatgattactcaaatggaagtgaagatccgccttgaatcattgcccccacaccaactcgcaataaaatccttccaagatgagctctagagaggttttttttttaagggaggagtgaatgcctatgaataagtttgtttcaaattaacctgaagtcagtttgtttcaaattaggctaaagttaataag

SEQ ID NO: 253 - DNA, 2507 bp, Sorghum bicolor
cttctccacccactgactgaccccaatggcgacgccggtcccggcggaggcggacgcgggggaggcgcgggagctcctctacgaggcgtacaacgagctgcaggcgctggcgtccgagctgggcggtgcggcggtggcgccggcggtcgtggtcgtcggccaccagacggacggcaagagcgcgctggtcgaggccctcatgggtttccagttcaaccacgtcggcggcggcaccaagacgcgccgccccgtcgcgctgcacctccgcttcaacccgcgctgcgacgagccccagtgccgcctgctctctgcaacaggggacgccgacgagcatgatgaagccggggttgccgcgcgccccatgccgctcgccgacatccaggcatatattgaagctgaaaacttgaggttggagaatgatccatgccaattttcagagaaggaaatcataattaaggtagaatacaagcattcccccaatctcaccattattgacactccaggcctcatccttccagctcctggccgtaaaaacagagttttgcagagccaggcttctgctgttgagaggcttgttcgtgctaaaatccagcataaagagaccatcatactgtgccttgaagactgtagtgattggagtaatgcaactacacggagagtagtaatgcaggtcgaccctgatctcgccaggactgttctagtctctacaaaactggacactaaaataccacaatttgctcgcccctctgatgttgaagtgtttcttcacccaccaacatgtgtgctagatgtttccttattgggagattctccctttttcacatcagtaccctctggtagagttggttcttgccatgaagctgtgttcagatcaaatgaagagtttaagaaggccatcttatcaagagagatggaagatattgcatctattgaagataagttaggaaggtcacttacaaccaaggagagagatagaattggagtgggtaatttaagattatatttggaagagttgctgcagaagaggtatgttgagagtgttccattaatcattccacttcttgagaagcaacatcgaaatacaacaagtaaattgcgtgaagtcagtcatgaactcagtgatatgaacgaagccaaactgaaggagaaagctcagctattccatgactcatttttgaccaagttatctttgctattgaaaggcatggtggtggcaccccctgataaatttggagaaactttagttaatgagaggattaatggaggaacatttacaggaagtgagaatttccagctcccgaacaagatgatgccaaatggtggaatgcgtctttatggtggtgcacaataccatcgggcaatggctgaatttcgtctggtagttggtagtatcaggtgccctccaataactagggaggaaattgtcaatgcttgtggtgttgaggatattcatgatgggacaaactactccaggactgcttgtgtaattgctgtggcaaaggcacgtgacacatttgagccattccttcatcagctgggttttaggcttttatacatactgaagaggctgatcccaatctgtgtttatctgctggagaaagatggtgagggctttagtagccatgaagtgcttgtaaggcgtgtccaggaagctttcaagaggtttgctgaatccactgagcaatcatgtcgtcaaaggtgtatggaagatctggagagtaccactcgttatgtcacttggtcccttcacaacaagaaccgtgctggattgagacacttcctcgattcatttgttgcaccggagcaactatcagtgaatacactgaacgagcagttttctggcttgaatgacaacaaacaggacagggcaaagggtgactcgaagtcaaaccattcagacacaaattcgtccagtgctgtgccagagacaagactagttgatctattggatagcacactctggaacagacgtctggtgccctcatctgaaagacttgtttatgcgctggttcaccagatttttcttggaatcaaagagcattttcttgtcaccactgaactgaagttcaattgctttctcctcatgccgattgttgacaaattaccagcacttctaagacaagaccttgaatcagcttttgaagaggaacttgatagcatctttgatgtcactcagctgcgccagtcacttgggcagaagaagcgagagctggagatcgaactgaagcggatcaagcgcttaaaggataagtttggggagataaacaagaagctcaattctcttcaggttaggcagtagccagtaggtcagcccaaaatttagcagtagcttggtagacagtctaggtagtgtttcaatgctgtaataaaatcattggtcatctagagttacttcttgttgtatccatttagttgtaaatatgaagtcttcctatatatgttttaatgtatgttgttgctcatggttttcgaagtcgtttttcttttccacggttcctaaatccgaa

SEQ ID NO: 254 - DNA, 3437 bp, Sorghum bicolor
caactcacaagcgacatcgcccgctctttcttctcgcgcgcgacggcgcgaccaaacaaactcctcactaaaccctagaagctcccggtcgccgccgccgccaccaccgcagacgccgccgccatggataccctcaagcgcaaggccccggacggccccgaagctgccgaccaggcctctcctctgaaagcaccgcgcgtcgtcgcccccacctcggagcctcccgctcccaccgccctcgcgaccgcggaaccagtcgcctgcgtgcacgacgtctcctaccccgagggctacgacgcgtctgcctctacgtcccgcgccattgccggcggcgctgacgcctctgagccagcaaggaagttccccttccagctcgaccccttccagtccgaggccatacgctgcgtcgacaatggcgaatccgtcatggtttcagctcatacgtctgccggaaagacagtggttgcgttgtatgcaatagcaatgtctttgcgcaaccaacagcgggtcatctacacgtctccaatcaaggcactgagcaaccaaaagtacagggagttcaaagaagagttctctgatgttggtctcatgacaggggatgtcacgattgagcctaatgcctcttgtctggtcatgactacagaaatttggcggagcatgcaatacaagggatctgaggtcatgagggaagttgcttggattatttttgatgaggtgcattacatgcgggatagagagagaggagtggtctgggaggagagtatagtgatggctcccaagaactcacgctttgtcttcctctcagcaactgtacctaatgccaaggagtttgctgattgggtagctaaggtacataagcaaccctgtcatatagtatacactgactatagacctacacctcttcagcactatgtatttccttctggaggggatggattataccttgtagtggatgagaagggcaagttcagagaggacagttttcagaaagcattgaatgcccttgtccctgctagcgacagtgccaagaagaaggagaatgggaagtggcagaaagttatcatggcagggaaatctagcgaggaaagcgacatattcaagatggtgaaaatgataattcagcgccaatatgatcctgtaatacttttcagctttagcaaaagggaatgcgaatttcttgctatgcagatggctaagatggacttgaatgaggatgacgagaaggcaaacatcgaaacaattttttggagtgctatggatatgctttctgatgatgacaaaaaacttcctcaggcaaaaacattcagtattggtctgaacatgcctgcaaagactgttgtgtttaccaatgtgcgaaaatttgatggagaccgattcagatggttgtcaagtggagagtacatccaaatgagtggccgtgctggtcgtcgaggtattgatcagcgtggtatctgtatactgatggtagatgagaaaatggaaccttcaactgccaaaatgatgctgaaaggaagtgctgatagtttgaacagtgcctttcatctgagctacaacatgctgttaaatcaaatgcgatctgaggatggggatccagaaaagctcctccggcattcattttatcaatttcaggctgatcgttctctccctgatcttgagaagcaaatcaaggaactggaatcagagagaaattcgatggtcattgaggaagaggagagcttgaaggattattatgatctcttacagcagcacaggagtttaaagaaggatgtccatgatattgtcctctctccaaaacatgttctgcctttcttgcaacctggaaggcttgtccgcattgaatatagtacagatgagccagccaacttttccattgatgaaaatgtcacatggggaattataataaactttgaaaaagtgaaatcccatggtgaagataggagacctgaggattctgattacacggttgatgtccttaccagatgttctgtaactaaggacaacaatggtaagaaaacaatgaaggttgttcctctgaaagcgcgtggagaaccagttgtagtttcattgccactttcacagattgatggactaagcagcatacggatgtacatacctaaggatcttttgcctgtagaagctcgagaaaacaccttgaggaaagttgaagaagtcctttcaaggtttgctaaagatggggtgcctctattggatccagaagaagatatgaaagtacaatcgaaatcatttcggaaagctaccagacgaatagaagctctggagagcttgtttgagaagcacgatatccgtaactctccacatatccagcaaaagctgaaagtctttcatgctaagcaagaactatcagccaaaataaagtccataaagaaaacaatgcgatcttccactgctttagctttcaaggatgaactcaaggcccggaaacgtgttcttcgcaggctgggatatgttacgagtgatgatgttgtggaagtgaagggcaaagtggcctgtgagataagttcagctgatgagcttacattgacggagcttatgtttagtggtgctctgaaggatgctacagtagagcagatggtggcactgctttcttgctttgtttggcaggagaagctccaggatgccccaaagccaagagaggagcttgatttgctcttctaccagctgcaggagacagcaagaagggttgctaaccttcagcttgaatgcaagatccaaattgatgtggaaagttttgtgaattctttccgacctgacataatggaagcggtgtattcatgggccagagggtcgaagttctaccaaatcatggagatgacccaagtgtttgaaggaagcttgatcagggccatcaggaggctggaggaggttctgcagcagctgattctggcatccaagtctattggggaaaccgagttagaagcaaaactcgaggaggcagtcaacaagatcaagagggacatagtgtttgcagcatctttgtacttgtaatgtctagatgggtcaggggctaggtcaaaagctcatagggaattaagcgctcttaatttgctgctgttgtcagagtgctgttggcatgatgaagctgcctgatttgctgttagcagtaatgtggcagtgaaattttgttagggttaaccatgcagggtctatttgaaggtcaagaatttttgtaggaagcaatacaattctggcagaaattcaacaaactcacagtaactgccttagcatgtacgataaatagctaattatttgttaggaatagtccagggatgcaaatctgtatgcagaattacaaatgtaccggattgcaatatatacgtatgtgtggagtataaacaagtgtaagatttagtgcttgtgttgtattattgtaagtgcaattcaaagtcggtcgatggagatgtccctggatggaaact

SEQ ID NO: 255 - DNA, 1190 bp, Helianthus annuus
tcacccatacaatgcatcctctttatataaagttaaaaacacactacacaaaaccctcccttcaaaaccttttctgggaataatgtgtctcctcctcctccccttcatcatcttcctccacctccttccggccaccatcccttccgcagcaccaccgctccacccgggttactacgccaattcttgcccaaatgccgaactcatcgtccgaaacgtcatgaaaaaggccatgatccgagaaccccgaagcggagcttccgtcatgcgatttcaattccatgattgtttcgttaacggatgtgatggatcgatgttgttggatgatactccaacgatgctcggagagaagctatctttgtcgaacatagattcgttgcgatcgtacgaggttgtcgatgaaatcaaggaagcacttgagacggcctgcccccggactgtttcttgtgcggatatcattatcatggcctctagggatgccgtcgctctgagtggaggtccggattgggaagtgaagctgggaagaaaagatagcctaaccgcaagtcaagaggatgccgatgccataatgcctagtccgcgagcgaacgcaaccaccctcatcgatctctttgccaagtttgacctctcggtcaaagatttagtagccctttcgggctcacactcgattggtaacgggcgttgtttctccattgtgtttaggctctacaatcaatcaggcacaggccgcccagacccctccatcgagccaaagtttagacaaaagttagacaaactttgcccacttggtggtgatgggaatgtcacaggcgatttggactttacgcctcgcatcttcgacaatcaatatttcaaagatttggtaaatggaagagggtttttgaattctgatgaaacattgtacacttattggaaaacaagagagtatgttaaaaggtatagtgaggatcaagatgagttctttagggactttgttgaggggatgattaagatgggcgacttgcaatcggggcggccgggggagattcggaagaattgtagggtggtcaacggtggtccaccgatggacttggtgatggatggatataaagataggaggatattgagttattagagttgagttgacacattatgtatttatcatgaatacggataatgtagcatatggtgtcaactcaactctaataactcaa

SEQ ID NO: 256 - DNA, 935 bp, Solanum lycopersicum
atcccagcaatatgataatctcaacatcttctttcttctcttccatgaaaatgaggtgtttcactcttctcttgtttttttcatctatagtagccgtggcattggcctctaatgttgaagaggccctgataagccaagtagtagaaattcaccgtctaaggccacaaactggttctgctggttatacagtcccacaattagactgtcttagctggcgcctcgccatcgagactaacaacctacaaaactggagatcagtgcctaaagaatgtacaaactatttaggtcactacatgatgggcaaacaatatcgccacgactgtgaatatgtagccaagcaggctattgagtacgccaaaagcctcaaacttagtggagatggaaaggacgtttgggtatttgatattgatgaaactactctctcaaattctccttattacgctagatctgacgttgcttttggggctaaaccgtacaacgctacaaagtttgatgcgtggatagctgagggaaaagcgccagccattccatcgatacttgaggtatacaatactgtgttgtctttgggaatcaagccaattttcattacagggacgaaacagaatttcaaacaagtaaggattgttaatctcaaggaagctggttataccaactgggcagcgctcatactaaagggagcaaatgatacgggatcagcagtgaaatttaaatcgagcaagagaacagcgttggtgaaggctggatatagaattattggtaatattggagatcaatggagtgatttgatcggagaaaatgttggagctcgtacttttaaagtccctgatcctatgtactacataggttgactctaaccaaattatatcgacttgcttcgatattttaattatgttcctattttaataaatcttaaaagacacacatctttatttttt

SEQ ID NO: 257 - DNA, 2021 bp, Solanum lycopersicum
atatgaagagtcgtcttggagttccattcaaaggcatttcagaggatattcgaggacgagtatcttgctacaagcaggattggattgctggaattagatccgggatagggatattagctccaactacctacatattttttgcatctgctctaccagtgatagcttttggagaacaattgagcagagaaacagatgggagcctcagcactgtggaaactttagcttctacagcaatttgtggtatcattcactcgatactcgggggccaaccacttatgatactaggagttgcagaacctactattattatgtacagttacttgtacaagtttgctaaaggtagagaagatttaggacagaccctttacttggcttgggccggatgggtgtgtgtctggacagctctcatgttgtttcttctagcaatattcaatgcctgttctgtcataagtaaatttacaaggattgctggggaaacttttggaatgcttatcgctgtgcttttcattcaagaagcaattaagggattggtaagtgagttcagcatccctaaagctgaggacccaagttcggagaaatatcaatttcattggctttacatgaacggactacttggaatcatattcacctttggtcttctctacacagccttaaagagcaggaaagcaaggtcatggtggtacggcacaggctggatgagaagcttcatcgctgactatggagttcctttaatggttctcatgtggtcatctctgtcatttatcgtgccaagcaatgttccgtctggagttcctagaactctctatagtccccttccttgggaatctgcatctttatatcactggactgtaatgaaggacatggtgaaggttcctccagtatacatttttgctgccataataccagctgtgatgatagccggactctacttcttcgatcacagtgttgcttcgcagatggcacaacaaaaagagttcaatttaaagaatccttctgcttatcattatgatatcttactcttgggatttatgactttgctatgtggtttacttggattgcctccttcaaatggtgttctgccacagtccccaatgcatactaaaagtttggctattcttaagaaacagctgattcggaagaagatggttgaaagtgcaaaagagagtatcaggcaaaaagctagcaactctgaaatctatggcaacatgcaagctgtattcattgagatagatagttctcctattagtgcagtagctaaagagttggaacacttgaaagaggcaataatgaaatgtgaaagtgataatgcaaatgacgaaaagtctagtggtatatttgatcctgagaagtacattgatgcttacttgcccgttcgagtaaatgaacaaagagtcagcaatctattgcagtcactactggtagcagcatcagcgggtgctatgccagtgataaaaaagataccaacttcagttctttggggatatttcgcctacatggctattgacagccttccaggaaatcagctgtgggaaagaatgctgcttctattcatatcccctggcaggagatttaaggtccttgaaggggttcatgcatcttttgtggaatcagtaccattcagatgcattgcaatcttcacaatattccaatttgtgtacttacttgttgtctttggagttacttggattcctatagctggcattctcttccccttgccattttttctcctcataagcataagacaacatttgcttcccaaatttttacaccctcgtcatttacaagagcttgatgcagccgaatatgaggaaatagctggtgctccacaacgcgcacttagcttctctttcagggaaacggagataactcttcctagaactgaaggcgagatagaaatttgtgatgctgagattttggatgaacttacaacaagcagaggagagttcaaagtccggactattagctttagtgaggataagcgcccacaggtacctcttgacaattcatttcacaattactag

SEQ ID NO: 258 - DNA, 1328 bp, Triticum aestivum
cacaattagaaccaggtgtggacaaaaaaccaggcgtggtaccggtccggaattccccggaaatttgtgaacccaggggttcgggaatggagcccgaggacccttaccatggactgaaggattaggaaacatccaccccaatgggttagcgaacagggcctgcagccctgcaacacccgctacaaaatgaagcttcaggtagccacagtcgcctccttcgtcctggtggccttggccgcggcggcccaggccgtgacgttcgacgcgtcgaacaaggcgtcgggcacctccggcggccggcggttcaaccaggccgtcggcctcccatactccaagaaggtcctctctgacgcctccgccttcatctggaaaaccttcaaccagcgcgccgtcggcgaccgcaagcctgtcgatgccgtcaccctcgtcgtcgaggacatcagcggcgtcgccttcaccagcgccaacggcatccacctcagcgcccagtacgtcggcggcatctccggcgacgtcaagaaggaggtgaccggcgtgctgtaccacgaggcgacgcacgtgtggcagtggaacgggcagggcagggcgaacggcgggctcatcgaggggatcgccgactacgtgcggctcaaggccgggttcgcgccggggcactgggtgaagccggggcagggcgaccggtgggatcaggggtacgacgtcacggcgaggttcctcgactactgcgactcgctcaagcccgggttcgtcgcgcagctcaacgccaagatgaagagtgggtacaccgacgacttcttcgcgcagattctcgggaagaacgtgcagcagctgtggcaggactacaaagccaagtttagaggctgaacgcaccataagttgatgggtccttcacggtgtgatggcataacgcactacttcgaataagacatgtgtgatggcataacacaccatatactgaaatgatcaacagaacatgtcccttacgctctgtagtgaaagataaataaacgatttcactaattcgaaatcgactttgagttacatgctactagtagtcttaagttggcgatacgtgagtgcgtttgtgtggtggtgtgagtgtgtgcgtgttgtaatcggttttctagaaaaaacaaaaggttgtttggacttgcaaagttttaaagctgtttgcgcacaacatgcttggatgggtggattcaaaaccgctctgcgtccacgattttttgtcctatatttgtagaactagacagtgaagacatgcagcatgttatggcccacaaactggatcaactctgactgtactagtgttggatacaaattcatcg

SEQ ID NO: 259 - DNA, 677 bp, Triticum aestivum
ccaggttccactccacccacccacctgcgccgccagctctaaaggaggcggcgtcggccggcgggcgagcgcacgcccaggcccaatcgatcgatcccagctctagaggggagggagcaaccatggcgggggacggggaggacgaggtgccggcgatgggcggagacaagctgatcctgcgggggctgcagttccacggcttccacggcgtgaagcaggaggagaagaagctgggccagaagttcgtggtcgacgtggacgcctggatggacctcgccgccgccggggactccgacgacatcgcccacaccgtcagctacaccgacatctacaggatagccaagggcgtggtggaaggcccgtcgcggaacctcctggagtcggtggcgcagtcgatcgccggcaccacgctgctcgagttcccccagatctccggcgtccgggtgaaggtcgggaagccccacgtcgcggtgcagggcgtcgtggactacctcggggtggagatactgaggaggcgcagagaggcatgagcacaagaaccggagtacctcatatgagaagcctgaacagagttgatctcagttgagcccatcgatccctgtgtcttatatctatcaatctatgtatgtatggacatgatgtttgtctgcgctcaataatttctgaattgggaatca

SEQ ID NO: 260 - DNA, 812 bp, Triticum aestivum
ggatctcctttcgacgaaaaccctatttcagttaggaagggccaaggggacgtaggaggcgggcaagacatggcggccgcggcggcctccgttggacacagcagcaaaggcggcggtgggcggatccatcggctggaggtggagaattttaagtcgtacaagggaacgcagaccatcggtcccttcttcgacttcacggccatcatcggtcccaatggcgccggcaagtccaatctcatggacgccatcagttttgtgctcggcgtccgctcagcacacctccgtggcgcccagctcaaggacctcatctacgccctcgacgaccgcgacaaggaggccaagggtcgcagggcctccgtacgcctcgtctacaacctcccaggcaccggcggcgagcttcacttcacccgcaccattaccggcgccggtggcagcgagtaccgtatcgatggccgactcgtcacgtgggacgactacaacgccaagctcagatccctcggcattctcgtcaaggcccgcaacttcctcgttttccagggtgacgtggaatccattgcctccaagaatcctaaggagctcactgcacttctggagcagattgccggctctgacgagctcaggagggagtacgacgaattggaggaacagaaaaccagtgccgaagagaaatctgcacttgtctatcaagagaaaaggaccatcgtcatggagaggaagcagaagaaggcgcagaaggaagaggcagagaagcatctgcgcttacagcaggacctgaaactgttaaaaacagagcatctcctatggcaactcta

SEQ ID NO: 261 - DNA, 888 bp, Sorghum bicolor
gatctagttgctgtggctttgtgcgtgactgctgaatgggcatgcagcataaaggcagccccccaaaaaaaaagctgagacgggacgacaccgagagaatcagtgactcatattcccaaatcccaaaaggccaaaaaccatacgcccaacgcaaaagctaaagagagggaggggcgtccaggttcaatgcatgtacacacgatcctctgcagtgtgacctgtcgctacaatgcaggtcatctctttcaaaccccacacgagatgtttcttcaaagccaccaggtccaaatcccagcagctctgagctagggaaaaacgactttggtgccatggagagaggggtatttgcagtacaagtacctttggatccaagagctagcatcactcgtaaattaagcagctaatagctgaagatgcatcgaggactgttcttcttcctcaagccgtagcctgtgggaggagaagccacaggcctcgcatggagttcccccactcacttcttggtcccctgttgttcgttccctcaggtagagaggatcttgttttttgtgctgatttcttcctcgtgtaagctcatgcgtggggcgatggatttgtctctgatcgtcctcatgcctcttgtatcgtgatttggatcaattaatgcaaataaatcatcgatgagaaaagatcgatccaagctgcatgtgtttcttgaagttctttcagtagctattcgatcggcatttcttgtgtactgtatatgcttgtgatgctgtgatcaatcgcctgtataaatgcaaatattgtgacttctacttctagtttagtgctcctacgtttttttcttgacgccggtatcgaaagataaacttggaccctacatgttgtcttgttttttaagtaaaa

SEQ ID NO: 262 - DNA, 759 bp, Sorghum bicolor
ggaggcgcctcccgcgcatgcctggtgctctcgtccagccgtcgccggctccgggagctcgttccggccgccgggcagtgatctctccgatccttgcctgcttcctgctcgtcggtgcagctagctgcctacggggatgcatggtcgggcgcgcgggacagatcgatcgatcgaccaagtgatggaggggatcgagtcgtcgtcgtcttcgcgcgcggcggtagtgatccaatccaagggctgcagaaaggagctaactggtggtgttcgtgtaggtctaattaactcgatcggcggcatacatgggaaagccaggcattttctcgcaagttcaagtaccttccgttagctttcctctccatgcattgcacggtgatggtcttgttttaatccaattaatcatctgttcgtttcctctcttagtctcttaattttgggattctttaggcatataatagtagtagtactactaagaagttgaaggagctaggttactgagaccaaaatagtggggtgtatgtatacatctgcattttcctcgaggtgcgattatacaacttgctgctaaaggtttcttcgtattctgtctccttttgtaagattctaagtaatgcatgcatatgttctagagaatccatcaccgatcgatcaaatgaacatttgttgacgtgtcatgttttatgctacgtaatcctacctgctaaaagtttgggaatgttgtatatatgtggctgtacatttgtacttccagtgtcttgt

SEQ ID NO: 263 - DNA, 2138 bp, Arabidopsis thaliana
acgaaaacaccattagatttaagtcacatgtggctcttttgcatgttctgtcataaacacgtccatttcattcatcctcttcttcttcttctccttctatcctctgttttttgccctctctctttgtttagtggctgtggtcgtttgtatttggtgaaacataatttaaaaacaagtgcggctatctttaactctggccgacacatcggcggattcgactgtggtcggatcaagaagtgcttcctttttttccggcgtcgtttcttcttttatattcatcgatttggtgctctcgcaacttccaatagattacggctaatttctaaaatgaagatattaccatgctttggatttatccgtagaaagaaaaataaggggaattcaaaacctcagaaaacgcagagaatacttcagatcagacttgaagagccagtgaagcctttggagaatgatgagcctaacaacaaggacagtcctatcaagcacgagtcatatgacggcgaagatgaacgtgacgataaggattcaacgaaccgtgagttttctaaattccacgttcacgaacgagccgttgaatctgtgaaaagcaaggaggaagtcacagatacttctgaaaacggcgatgacaatgacgaggatgaaggaggtcacgtcagtgatcctggattaggcaaaactacggcttgggtgacgtctcctaagcttaaacgatcttgctccactctcagcaagtttaatggccggttccatggttctgatctccatgacctgaaagagaccgttccagttagtaatgaatcagtgaggtctcatagaagtgcagatagagtgatgctcaagaaacattcgtcgatgcagatacttccctctgggagccggcggctctggtggaagttgttcctatggagccataggaaccttcacaaacaccgtgtctcgctaaagtcacagcctttaaacaagaaccagcagtctggatacacctctgactttgctgagcacaaccaatccagccatgaagaagaatctacaaactattgcgctgatttcaccaaccagtcatcaaacttgtggcctcatcataatcagtgggtcgcgttctctgccgagtcctcgtcaatgaagcgagtggacgagtgggtaagaggactggatgtcgaaaccgtggttccagtgaacgaggataaggatgtcttggccatcttcccaacctctcctaatactgagagatcacccttaggaaatgtggttcagtccggaaacgtctcagaggctatagtgcacgcaaatagccttattcaatcgctgagcaaatcatcgagcgtggctcacatctcgagcatcggcttgaaagctatcccgagcatctcacattttaccagcctcaagtcgattgatctatcaaacaacttcatagttcaaattactcctgcatcgcttcctaagggcctccacgcgttgaacctttccaagaacaagatcagtgttatcgaaggactaagagatttgacacgcctaagagtactcgatctaagttacaaccgaatttctcgcattggacaaggtttatcaaactgtacactgatcaaagaactatacctagctgggaacaagatcagcaatgtagaaggcttacacagattgctgaaacttattgttcttgatcttagtttcaacaagatcgccaccaccaaagcaataggccagcttgtagccaactacaactctctcgttgctttgaacatcctcggaaacccgatccagaacaatgtaggcgaggaccagctacgcaagaccgtttccagccttctccctaagctagtttaccataacaagcagctcattaagccacaacgagccagggaagttctcaaagatagtgtagcgagagctgcgtttggtggtggagattctttgcaccacaggcgcaaaagaacatccaccaagagtgttgttggatcagcctcccctagcgttcaccaccgaggccacattgcaaaaggacgtggatccaaaaacagaagccaacgtcaactaagaaaaacttcagctgcagggacgccatcacattgaattgttctttttgtttgaatctcatgaattggccaatgcaaattgcaaagccatctccattcttt

SEQ ID NO: 264 - DNA, 721 bp, Arabidopsis thaliana
aaattcgagaaagagtgatcgggaaaaataatcatcggcaatgggttggtataccagtttcttagtagtggtggcgtccttagccgtcggagttatattctcgccggagacattcggatcgttgacgaatggagagaattcggcgaagatttcgatattcctgaagctagctcatctactcagtttcgctacagcttggggagctgctctctgggctaccttcatcggaggaatcatcatgttcaagaatttaccgaggcatcagtttggtaatcttcagagcaagttgtttccagcttacttcactttggttggttcttgctgcgcaatttcactctctgcttttggttatttgcatccatggaagtcatcttctacggtcgagaaatatcagatagggtttctcctatccgcttttgctttcaatctcaccaatttgtttgtcttcactcccatgaccatcgatatgatgaaacaaaggcacaaagtagagagggaaaacaacattggagatgaagttggttggtccaagaacagagaaaaggcaaagagtatcccaaagctagctgctatgaacaagaagtttggaatgattcacgggttatcatcccttgctaacatcttttcatttggaagccttgctatgcattcttggtatctagctgggaagttgaatctctagtttcctcctcaatactcatcttgtcacaaaggtctgtag

SEQ ID NO: 265 - DNA, 932 bp, Arabidopsis thaliana
acaggatgctaagcttgagatattcattaccttatcttcttcttcaaacaagggaatcatcaactaagctcttcaccaaaaagcctaacaatgttgtggtttgtgcggcgagaggtccaagacctcggtctcctcgtgtatggaaaacaaggaagaggattggaactatctctaaagctgccaaaatgattgcttgtataaaaggattgtcgaatgttaaagaagaagtttatggagcgcttgattccttcattgcttgggaattagagttccctcttgttatagttaagaaggcattagttatacttgaagatgaaaaagaatggaagaagattattcaggtgacaaaatggatgctgagtaaaggccaaggaagaacaatgggaacttacttctcattactaaatgctttagcagaagataatcgccttgacgaagctgaggaattgtggaacaaattgttcatggaacatttagaaggaactcctagaaagttcttcaacaaaatgatctctatatattacaagagagatatgcaccaaaagctcttcgaggtctttgctgacatggaggagcttggagtgaaaccgaatgttgcgattgtgtctatggttggaaaagtgtttgtgaaactagagatgaaggataagtacgagaaactgatgaagaaatatcctccaccacagtgggagtttagatacatcaaaggaagacgtgttaaggtcaaggcaaagcagctgaatgagctaagcgaaggtgaaggtggtttaagcagcgacgaagataagattgacaatgagattgagagtgaagaagaagatggtgaggatctcagtgaagaggaagaagatgaaaaagaacttttgggtggaagtcaaggacagattacttctagagaacccagtcttgatcatttggactcttcatgatga

SEQ ID NO: 266 - DNA, 1058 bp, Arabidopsis thaliana
aaaggatcccttgagaagaaccacacacacccagagagagacagagattcatcgatatggcggtttcttgcaaccactctgcgattctcttctctccatcatccaccgctggttcctcctccgttacttcttcctcgtcgctcatcggctttcctcgtttccaaacgctgcgtttcaaatcaagaagcgtttattcgaaatctagagtttcttctcctgtctcggcattgcctttacgttctctagaagctctgattttcgattgcgacggcgtgattctcgaatccgagaatctacaccgtcaagcttacaacgatgctttctcgcatttcgatgttcgatgtcctccttcttcctctgagtctctcgattggagcctcgagttctacgataagtttcagaatctagtcggaggtgggaaaccgaaaatgcgttggtatttcaaagaaaatggatggccaacttccaccatttttgactctcctcctcagaatgacgatgatcgagccaagttaatcgatactcttcaggattggaaaactgagaggtataaagaaatcataaaatcaggaagtgtagaaccaagacctggtgtaataagactaatggatgaagcaaaagctgctgggaaaaaactagctgtttgttctgcagctacaaagagttcagtaatcttatgtctcgagaatctaatcgatatcgagcggttccaaggacttgattgcttccttgcaggggatgatgttaaggagaaaaaacccgatccttcgatatatattacagctgccgagaagctaggtgtttcagtgaaagactgtttggtcgtagaggacagtgtgattggcctgcaggctgctacaaaagcagggatgtcatgtgtgatcacgtacacttcttcaacctctgatcagaatttcaatgatgcgattgccgtataccctgatctcagcaatgtgaaattgaaggacttggaaactctgcttcaaacaatagtcactgcagcttaagacatttgtctcctattcatttctgactgttcttctgcatagggtaccttt

SEQ ID NO: 267 - DNA, 1381 bp, Hordeum vulgare
gattccccactcgctcatcagtcccggcccagctcgccgccatggccgccggcgacgagttccgcccgctggacgaggcctccctcgtggcctacatccgggcgaccccggcgctggccgccagcctcggcggccgcgtcgacgccctctccgtcaaggaggtcggcgacggcaacctcaacttcgtctacatcgtcacatccgacgccggctccgtcgtcgtcaagcaggcgctgccgtacatccggtgcgtgggggactcgtggccgatgacgagggagcgggcctacttcgaggcgtcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtccactacccgctcctcgcccaccacatggccgactacatggccaacaccctcttcttcacctccctcctctacaactccaccacccaccacaagaaacaagttgctcgctactgcgagaacgtggagatgtgcaggctcacggagcaggtcgtgttctcggacccatacatggtctccaaatacaatcgctggaactcgccgttcctcgacaaggacgccgaagcagttcgggaggatgatgggctcaagttggaaattgctgaactgaagtcgatgtttattgagagagcccaggctctgattcatggggatctccatactggttccatcatggtgaccccagattccactcaagtgatcgatccagagtttgccttctacgcgccgatgggttacgacattggggctttcttggggaacctgattctggcgtactttgcacaggatgggcatgctgatcaagcaaatgaccgtaaagcttataagcaatggatactgaagaccatcgaagaatcgtggaatttgttccagcagaaatttttgggactctggaataaacacaaagatgggaatggggaggcatacctgcctgccatatacaacaacccggagcttttgggcgttgtacagaagaagtacatgacagatttacttcatgatagtcttggatttggttcggccaaaatgatcaggagaattgttggaattgcccatgtggaggattttgactcaatcgaggatgccagcaagagagcatcatgtgagcgccgcgcgcttgattgtgccaaggcaatcctgaagggccgacgccagttcgagagcattgagcaagtgattgcgcacgtccgatcagtaactcatgactgagaaaaccagcccgcctgttcggggtttccggttgaggagaccttcctttggttgttatcaggattgagcactag

SEQ ID NO: 268 - DNA, 890 bp, Hordeum vulgare
ccggagaagaagcctagacctagaccctctcctcccctctccggcgacgcaggcaggcaggcagggtctcggatcggatctcgtcggcggagatgaggcccgtgttcgtggggaacctggactacgacacccgccactcggagctcgaccacctcttctaccgctacggcaggatccaacgcatcgacatgaagtcagggtttgcttttgtctactttgaggatgaacgtgatggtgatgatgccatacgggctctggatggttatccctttggcccagggagacgcagactttcagtggagtggtcacggggcgaccgtggaaccagacgtgatgaccgtgatggctatagtaaaccaccagtgaatactaagcccaccaagacactgtttgtaattaactttgacccaatcaacacaagagtcagtgatcttgaacggcattttggtccatttgggaggatttcaaatgttcggataaggaagaactttgcttttgtgcaatttgaaactcaggaagaagcctcaaaagcactagatgctactcatttgacgaagttactggacagggtgatttctgttgagtatgccttcagggatgatagtgaaccaggtgacaagtatgacaggccaagtagaggtggtggtggctatggaaggcaggatgacagttcatatcgccgttctgttagcccagtgtaccgaaggtcacgacctagtcctgactatggtcgtccagtgagtcctcagtatggtgcatatggcaggagcaggagtcctgtccgtgatcgctatcgaagccgatctcctgtccagcgctcaagatccccagctcccaacagaaggggttatgactaatcgagaatcatctcggttatggcagtgaggtag

SEQ ID NO: 269 - DNA, 1814 bp, Hordeum vulgare
cagatccaccctcgcctagtctcctccatggccgccgacgccgacacggcggccgccgcacgcgccctcctcctcctcgccgtctccgtcgcggcgctcctccgcgccggcgaggcctcggtgcacgagtacaccggcctcggcttcctcaacaagggcaatgccttcatcctccacgcaggcagcgagggcctctacgcccccgtctcccccgccaatgccaccgccgaggaggaggacgacgaggccgccgccgccgccgcccccgacgccttcatacggtttgacaagattacttttaggaggccagaggaggccaatgattctgtgaaagagactagttcatctaaggttcagatacttgtctttgaaatagaagatcgtgaaatgattggtggatcggcgtatggaggtcaaaaagcaatttgttgtacatcagatcttgcaaagttgggagcttgcgtcgaaggctctgtcatctaccgcccgtcgcaggtgaatcctggttggccacagttgtttgttgcttcttttgatggaagtgatctgattgcaacgctgccttcaaggaccattccagtaaagaaaactgggatgtacaatatgtactttatacactgtgacccggcacttgctggactggaaatcgacgggaaaaccatatggaaaaatcctactggctaccttccaggtcggatggcacctcttaagaacttttttggactgatgtcatttgctttcgtgatacttggtatctattggttttatcaatacatgaagttctggcgagaggttcttccacttcagaactgtattactcttgttattacattgggcatgcttgagatggcattgtggtattttgaatatgctgagttcaatgagactggagttcgggcaaaggccatcacattttgggctgtaacatttgggactattaaaagaacagtggctcgtcttattattctcattgtctcgatggggtatggagttgtgaggcctactttgggtggtctgacatcgaaagtggtcatgcttggaggaacattctttgtagctacagaaattcttgagctagtggaaaatctaggcactgtgaatgatctgtctggaaaagctcgtctatttttagtctatccagtggccatcttggatgcttcattcattgtttggatatttatttctctagccaagacccttagccaacttcaggcaagaaggttgatggccaaacttgacatttataggaaattcactattgcattggccattactgttctggtatctattggctggattggctatgagatctacttcaaatcgactgatgtgttcaatgagcggtggcagtatgcatggataattcctgctttctggcatgccctatcattctcacttctttgcgtcatttcctacctgtgggcaccttctcagagctcaatgagatttaccaatgatgcaagtgaaaaatttgatcgagaagacagcctatcattaataaggccaaggcccattgtttccaagaacgggtggagcgtaacttccgcaccagatgccaaagcaacgaacaacacgaacaccgtggcatcttttgacgaagacgacgaggaaaacaaaagggagtgacgcatctgccgaaggagagagcattccacccacataagatcccttgaattggatgtgctagaacagttttggtatttagcagaggacaggccgtgctaattctagtcgtttggatacggtccttggaggcgtttctttcatgttaaatccgttatccctccactaggtttattcacacagagcctgca

SEQ ID NO: 270 - DNA, 1532 bp, Hordeum vulgare
aaaggatccgaccactcgagagctccaacgcggaacggcgatgtggcgggcgaggcggtggccacggccgcgatggttctcgtccggcacggcggcggcgggggccgatccgggccatccggcgcggcgtcgggtggcggcgctgtgggggaacggggaccacgggcggctggggctgggggcgctggagtcgcggtggagcccaacggcgtgccccttcttcctcgcgcgccccgccgacccgcctgcctccctctcctgcggcggcgcccacaccctcttcctcaccgagggcgggcgcgtgtttgctacggggctgaacgactttgggcagctcgggataggctcctcgatgcctcatactctggaccctgttgaagtctctgggtttcacgagaaagttgtacaaatttcagctggcaaccatcattcttgtgcagtaacagcggatggtgagctcttcgtttggggcaaaaattcgagtggccagcttggccttggcaaaagtgcaggaaaagtagtctctaccccaagaaaggttgactacttggctgatgttagagtgaaaatgactgctttgggatcagagcactcaattgttgttacagaggatggtgaagccttgagttggggagctgctggtggtggtagacttggacatggccataaatctagcttcctgggattcgctatgacctcaaatgaatatactccaaggttgatcaaaaaccttgatggcatcaagattaaaaggatagctgcgggaatgctgcactcagcttgcattgacgaaaaaggtactgtgttcatctttgggcagaagactgagaaggtacttggaagatcaaatgatgcacctagaccaagtgttgttgaagagatacaattttcagaagaagttgcttgtggaggttatcatacttgcgctgtaacagatcgtggagatttgtattcttggggttcaaatgaaaatggctgccttggtcttggaggtacaggcatggttcgcttcccggaagttgtaagcagttcattatttaagcttcctgtatctaaggtatcctgtggttggaagcacacagctgtaatttcaggtgaagatatctacacgtggggctggggcggtgccaacggtacattcttcgaagagggccattcttctggtgggcaattagggcatggaaacgacgtcgactattgcgagccgatgatggtagaacttcacaagaatgcaagagctgtgcatgtatcatgtggcttcaatcacaccggtgcgatactcgagtacgcggaaaactgactgctgtgtcatctgcagcactgtaagtgcaaccaggcatgtttggtactactcagtcatacctgcacaaggaaaaagaataagctgacctcgaacgagtgcatctggatgaactcgtaaaacagaattacaggttagtctagctgtatagtcttctttcatacatcttcattgtgagcttgtatctatgatatttgatggcctgtaaagaagcggtgtttgaggtaccttt

SEQ ID NO: 271 - DNA, 1341 bp, Hordeum vulgare
ccctgcaccaaatacctgacccgattcctttcccccctcccccccaccatgagtgacgcacccggcgcaccagcctcagctatgggcagtggcagggagctcgccaacccaccgtcggacggcatctccaacctccgcttctccaaccacagcgaccacctcctcgtttcctcctgggacaagacggtccggctatatgacgccgaggcgaacgtgctcaaaggggagttcgcgcaccccgggcctgtgctggactgctgcttccacgacgactcctccgggtttagcgctggcgccgaccacaccgtgcggagattagcatttacttcgtcaaaggaggatgttctcgggcgtcatgatgctccagttcgttgtgtggagtactcttatgctgcaggacaagtcatcactggcagctgggataagacaattaaatgctgggatcccagaggagttagcggaccagagcggacacttgttgggacatatgctcaaccagagcgtgtatattctatgtcactggtgggaaataggttggttgtggcaacagcaggaagacatgtcagtatttatgatttgcgcaatatgtctcaacctgagcaaaaaagggaatcctctttgaaatatcaaacacgctgtgttcgatgtttccccaacggaacagggtatgctctaagttctgtggagggacgagtgtctatggagttctttgacctttctgagtcggcacaatctaaaaagtatgctttcaagtgtcaccggaaatctgagtctggcagggacactgtttatcctgtcaatgccattgcattccatccaatatacggcacatttgccactggaggccatgatggatttgtgaacgtgtgggatggcacgaacaagaagagattgtatcagtactcaaagtacgcgtcaagcattgcctctctgtcgttcagtaaggatgggcatctgcttgctgtggcatcaagctatggctacgaagagggagagaaaccccacgagcctgatgcaatatttatccgtggggtgaatgaagtggaggttaagccgaagcccaaggcattggccgcgccgcagtagtaccgcaaccatttggcaagaaggtagtcaaacgtatcaggtgtgttgtctgggagaagacattatgcggagagcaaatgcgaggcgtttctttatctggttaactttgtagtgtcaattgcactagttgacggaatcccttctctatgttggagtcaaatggcagtatccatatctgaccatttctgtgtgttgtttggcatatattaatgtctagaaatagttgcttgggagtggtcatattccagctcgttt

SEQ ID NO: 272 - DNA, 985 bp, Hordeum vulgare
gagaagcggtgacgatagagcacggggggcagcacagctcgggagcaatggagagggcgacgccggtgcggagcccgcacacctcgacggccgacctgctcacgtggtcggccacgggcgccggcgccccctccgcctcgccggccgccccgtcccgccccagtctcaagccggctggggggatcacgccggccatgttcggcgcgccggtgagcgagcacgacgccgaggatctgagcaacagtgaaaggagactgatgtccggttcaaagatgaaggaaatgactgggagtgggatatttgctgaaaagagtgagaatagtgattcagagtcttcaaatcctgcaaacagaacttctgtgaggatgtatcagcaaactgtaactggagtaagtcagatctcatttagcgcagatggaagcgtttctccaaagaagccatcctcactgcctgaggtggctaagcagcgagagcttagtggcacattcgagactgatgctgaagctaaaattaataagcagctttctgaagccaagaacaaggagctcagcggaagcaatatctttggtccacctcctgagacccctgcaaggccactagctgctcgtaatatggagctacaaggaaacgtagattttgcacttccacaacgaagaagcgtgcacacatcagtgaaagtatccaatcctgctggaggtccaagcaacatcacgttcagtgaggatcctgtaacgaagacagcaaagaaaattcacaaccagaagttccaagagctgacaggcaataacatctttaacgaggatgctcctcctggctcagctgacaagtctctgagctcagcaaagcttaaggagatgagcggcaatgacatattctccgatggaaaggcgtcttcgcgagactacctcggcggtgtccggaagccccctggtggcgagagcagcattgcactcatctaattatggtagactgctctagtcgggac

SEQ ID NO: 273 - DNA, 2819 bp, Hordeum vulgare
tcgccaagatgctgcagagcaagtcgttcgtcaagaagacgaagcagggccgcgtcgtcaaggtggtccgggagcactacctccgcgacgacatcccctgcggcgccttctcctgcccctcctgcgacgcggccgcccgccgcctcaacgccgacgccgccgccatcctcgtcgtcgacaccaacgtcgtgctccaccagatcgatttgttggagaatccggcgattgaggatgtcgtggtgctgtcggtggtgctggacgaagtgaagaacaagaacctctccgtgtacaacaggctcaagacgctgtgcaccaacacggctcggaggttcttcgtgttcaccaacgagcaccacagggatacttatgtcaaggagatggttggagagagtccaaatgatcgtaatgatagagcaatccgtgttgctgctcgttggtaccagagtcaccttggtgacagtgccaaagtgttgctggtcacaaatgatagagataacaaacggaaagctactgaagaaggcctaaatgcagagacagttgagtcatatgtacgatcgcttgcgcagcctggtttgctcgatttggtggttgtcccaagtagcggagatgttgccatggaagatgtagaagatcttagaccatccaaaaggaaaatagtttacaatgagcataaacctatgtcagaaattacatctggtctgcgctgtggaatttatcatcaagggaagcttcgagttaatcgttacaatccatttgaagcatatgtcggaagtgagagcattggtgatgagattattatccgtgggcgttcaaatatgaacaggtccttcgatggagatatagttgctgtagaactgttgccacaggatcagtggcacgattcaaagtcatttattgctgatgatgatgaagatgataatgaagaggatgtcaggttggttccaaatagcgctgatgatgctccacgaaacaccacttccacgcaatcaacagctggatcatcagctgcttctgtccccagtcgtccagttggacgtgttgttggtatcatcaagaggaattggaactcgtattgtggatcattggagccaatgcccatgcctgctggtagcgggggtgttgctcatgctctttttgtgtcgaaagatcgaagaattcctaagattcggatccaaactagacaacttggtaatcttttaaataaaaggattatcgttgcagttgattcatgggatgtcatgtctcgatacccatcaggacactatgtgcggactataggagatattggcgataaagaaacagaaacagaggttgtcctaatagagaatgatattaacacaagacctttctctacacaagtccttgcttgtttgccacctttgccttggacattgtcacctgaggatgtggctaatcctaataggcaagatttgcggcatgtgagagtctttagtgtggatccacctggttgtagggacattgatgatgcactacattgcacaccgcttccaaatgggaattttgaagttggagtacatattgctgatgtcactaattttgtccatcctggtacccctcttgacgaggaggcctctcaaagggcaacttctgtttatcttgttggacaacgaattgacatgctaccaaagcctctaactgaagatgtttgttctcttcgtgctgatgttgagaggctggcgttctccgtcatttgggaaatgacacctgatgctgatatcatatcctcaagatacacaaagagtgttattaagtcttgtgctgcaatgtcttatgtggaagcccaagcaagaatggatgacagccgtttggttgatccactgactgtagacttgcggaacttaaattcattagcaaagataatgagaaatcggcgttgcgaaagaggggctctgactcttgcttcagcagaagtcaaattcgaaattgacagtgaaactcatgatccccttgacataggaatatatcaaattcgtgaggcaaaccaaatgattgaagagtttatgttggcagcaaatgtttctgttgctgagaagattttgcagcactaccccttgtgttcattgctacggcgtcatcctagcccaacaaaggagatgcttgagccattactccgtactgcctcctctgttggcctaagtctggacgtatcatcctcaaaagcattagctgaatcacttgataatgcgaagagagatgacccgtacttcaacaagcttatccggattttggcaactagatgcatgacacaagcagtatacttttgcagtggagatttgagcttgtctgagtattaccattatgggcttgcatctgctctgtacactcatttcacttctcctattcgcagatatgcagatgttgtggtgcataggttgctagctgctgctctagatattgcgaaacttccaccagtcttccaggatggtccacaactcacaggcatcgctgacaacttgaattataggcaccgaaatgcccaaatggcaagcagagcatcggttgagctccacactctcatatatttcaggacaaggcctgtggatactgaagctagaatagtaaagatcaaggcaaatggtttcatagtcttcgtaccgaagtttggcatagaaggccccatctatcttacggcgaagggagacaaaggggctgactgggtagtagacgaggtgcaccagaaagtaaccaagcctggaacaaacataagctatgctgtgttgcagagtgttatgatccatatggaagtggtcgagcctcagcctcaccgcccaaagctacagctcaccctcatatgatga

SEQ ID NO: 274 - DNA, 682 bp, Hordeum vulgare
gtgagatcgcgagattgtagcttgatcgatcgaggcagggaagatcggaagaggatcgacgatgcagtcgccgtcgcactaccagtcctcctactacgccgtgctcggcgtccacccaggcgcgtccgccgccgagatacgcgccgcttaccaccgcctcgccatgaggtggcacccggataagatcgcgaatggccgtgtggatccggcgatcgcggaggaagccaagggaaggttccagaagatacacgaggcataccaggtgttgtcggatgagaagcggagggcgctctacgacgccgggatgtacgaccccctcgacgacgaccaacaagaggtcgagggcttccatgatttccttcaggagatgctctcgctcatggcgaccgttggtacagaggagcccgtgtattccctgggcgaactccaatcgatgcttgacgggatgatgcaggatttcacctccccccaaccgccaccaccaagcagcttcttcaccagcaccagttcatcgacgcggttcggcgcacccagtggcggagcgcagcagcagcgtcgatcctcctcccgcgtacggcctcaggggttcggcggctcggcatgcttcagccagacggctttctccggctgctaagcacttgcgcgatctgcatcgcagttcatacgtccgtgggtgtattag

SEQ ID NO: 275 - DNA, 1241 bp, Hordeum vulgare
ctgtttggactctggagacgagggcgcgcgcataacttgcctcgccattgcggctgctctgctcagcccggctgcttccttggatctgctagctcgcccgcgccggcctccggggcgcgctcccccgctccaaatctcgtccttgttttggaggtcctcctgtgcggatgaggagggaatcctgacttttgctgggctccggcggttctcttcctggatccttgcggcggaggcgtgccgggatgggtttcttgatctgcgcctgcctcctccagctgctcttcttgggctcctctccggtggcggcgcagtcgccgtcgccggcgagggccctggacgcaatgctgcaggagtacgcgtaccgggccttcgtccggccgcacaccggcattgtctacaacggcaccgtgccttcggacctcgccggcgtcgcggtgtccgggctccgcctgcgcagcggcagcctgcggaggaaaggcttctccaactacttcaacttcaggatcccccctggcgtcatcgtgcagccgtacgtcgagagggtggtgctagtgtaccacagcctgggcgacctctcggagaagtactacccgctccccggctacacctatctctcgcccattctcgggctgctcgtctacgacgctgccaacttgtcagcagtgggtttgtccgagctgagcatcgtcgcgtcagggagccccatttctgtgaatttcagcaatgtcagggcggtgccgccaggcagtccagcgccgcagtgtgtgtggttcgatttggatggcgtgccacagttccgggccttggaggcaaacaacgtgtgtgcaacgtatcgccgagggcacttctccatagtggtgaactccagtgaggttgctcctgctccaggtccttcaggcgcaattgccccgccaataccgactgatggtggtcgtgataagggtagttcggacgcatggaagattgccgtcggcgttgttgggggtgtcattgcattggggctgttggctttgcttctggtatgtttcctcagatataaaaaggaaaagaagatggaggttatggaacgaaatgcagaggtcggggagactttgcgcatggcgcaggttgggcggacgcaagcgcctgtagcgttcggaacgcgaacaaaacctgtgattgagagtgagtatgttgcctagttgatttttggtgttttgcagaattcaggcaacagcagcaatgctctaagatgatgccct

SEQ ID NO: 276 - DNA, 1040 bp, Hordeum vulgare
gcgagatggtggtgaagagcgcaggaggaggaggaggcggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgcaaggtccacttagactacatagaagcaggtgcaaacattataattactgcatcgtatcaggctaccattcaagggttcgaggccaagggattttcaaaagaacaaggtgaaaatttgctaacaaagagtgttgagattgcacatgaagcacgtgagatgtttctgaaggaacatccagatcaatccaccgccttgcgtcctattctggttgccgcttccatcggaagttatggggcttatcttgctgatggctctgagtacagtggggattatggtgaagccggaacacttgagttcctgaaagattttcatcggcgaagacttcaggttcttgcagaagcacggcctgatttgattgcttttgaaacaatccccaataaattggaagctcaggcttatgttgaacttcttgacgaatgcaacataaatatcccttcatggttttccttcaactcaaaagatggagttaatgttgtgagtggggactcattaatcgaatgtgctaatattgctaatgcatgtgcaaaggttggtgcagttggtataaactgcacgcctccaagatttattcatagcctgatactctccattcggaaggtcacagacaagccaattctgatatatcccaacagtggagaaagatatgatgccgagaaaaaggagtgggtggaatccactggtgtgtcagacggcgatttcgtttcttatgtaggcgagtggtgcaaagatggggctgcccttatcgggggctgctgcaggacaactccaaacaccatcagagcaataagtagatctcttaaccaatactaccctgcggcttagtag

SEQ ID NO: 277 - DNA, 769 bp, Hordeum vulgare
ctacaaccaactgagacgaacgactgccgtcgtcctgctcgcaagttgtaaccaccgcgaacctcatcttcgccggagacaggaactgatggcggcagctgccatgagctacgtgcatgcggacgtggagaacctcaaggcgacggagctgaggctcggcctgccgggcgtcgaggagaccgccaaggtgccgtcgccgccgtccacgcccagggccggcagcaagcgcgcgctcgccggggagcaccgcgaggaggagcccaagaccgcgcccccggccgccaaggcgcaggtcgttgggtggccgccggtgaggtcctacaggaagagctgcttccagcaggcgagcagcaagaccaagccggccgcgccggcacccgtggcggtgaagcaggaggaggccgccgttaccgcggcgccgcccgccgccgcagccgcgggaggctcgctgtacgtgaaggtgagcatggacggtgcaccctacctgaggaagatcgacctcaagatgtacaagggctaccgcgagctcagagaggccctggaggccatgttcctcggcttctccggcgacgcaggcagcgtgaacccgtcggacttcgccgtcacctacgaggacaaggacggcgacctcatgctcgtcggcgacgtgcccttcgagatgttcatgagcacttgcaagaggctgaggatcatgaagggatccgaggcaagaggcctaggatcatcaaaggagtgaaacggaatcgatctatgaagaacacgcgacatg

SEQ ID NO: 278 - DNA, 928 bp, Hordeum vulgare
atctctgaactcaggcatcctccacacctgcaaaaccaaaggatttaagtgaagaagcaggcagagatatcgccggaggcacgcacgcgcgatggccaccatctcttcttgcagccgcctgtgcggcggcggcagcaccgccttccaccgtcgacgcagccggcctgcgcgggccaccgtcgtcacctgccggagattctcggccgtcgtccgcgcggccgcctctgccaccgcagcggcgcccgcgtccaccgtgcctcaaaccaaggagtgcaagcttccgacgtgggcggagttcgagctggggaagtcgccggtgtactggaagaccaccaacggtcttcctccagccccgggagagggcctgaagatattctacaacccagggacgaccaagctgacacccaacgagcagttcggcatcgccttcaacgggggctttaaccagcccatcatgtgcggcggcgagccgaggcagatgacgctgcaagagagggggaaagcctgcccccccatctacaccatcaggatacgggtgccgcagcatgccatgacactggttttctccttcaccaacggaagcgaatgggacggggcttacaccctcaaattcaaggtccccaaaccatggctcaacaagcctctgagcttcttcaacgaggggctggctgacgagctcaacatggagggcgcctgcgacagggccatctttccggatgaaaacatcgtcatcacgagctgcgatatcggcggcttctacgaggagggaggagaccggtgcaagctggacatcgtgaccgggtgcatggaccggacctcgcacatgttcgacccactggccaccatcgacgacggctcctgcccgctggactctgattcggaggagtgaccggaccagcgccaagatgacatgagcagcagcttctag

SEQ ID NO: 279 - DNA, 776 bp, Hordeum vulgare
cagccatgtcttccgtcttcagcggcgacgagaccgcccccttcttcggcttcctcggcgccgcggcggccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccatacttcctcttcgacggctacgcccacctctcctccggcctcgcctgcggcctcgccggcctcgccgccggcatggccatcggcatcgtcggcgacgccggcgtcagggccaacgcacagcagcccaagctgttcgtcggaatgatcctcatcctcatctttgccgaagcccttgccctgtacggcctcatcgtcggcatcatcctctcctcgcgcgccggccaatcccgcgccgactagaacaaagcgcttgcaagcaaggagcacacggtccaccattgtattatgtttcaaagggtttatttcttcctagagacttgtttggcattacgctgtggttccttcttttgtgttcatgctcctcggcggaggaacataatgtgggtgggatcatagggatttccacgccctccatctgtaattttattctatccggcaacgcaaagctacctgtatctactcgtacttagcacctgctgtatttattatttggaataataatcggcgatgagc

SEQ ID NO: 280 - DNA, 1149 bp, Hordeum vulgare
aaggaaggaagagctgaattggttatccggcgagtcatccagggagctaggccaaggatatatacgtacatggaggcgccggcggccagaggaggaggagcggtggcgtccgtggtggtggtggtggtggtgatggcgatggcggcggcgacggcgcgggcgcagctgcaggtcgggtactacgacacgctgtgcccggcggcggagatcatcgtgcagcaggaggtcagcaagggggtgtccggcagccccggcaccgccgccggcctcctccggctccacttccacgactgcttcgtcaggggttgcgacgggtcggtgctggtggactcgacggcggggaaccaggcggagaaggacgcgccgcccaactcgagcctgcgggggttcgaggtgatcgacgcggccaagacgcggctggagcaggcctgctacggcgtcgtctcctgcgccgacgtgctcgccttcgccgccagagacgccctcgccctggttggcggcaactcgtaccaggtgccggcgggccgacgagacggcaacgtctcggtggccggggagaccaacgggaacctgccgccgccgaccgccaacgtgaaccagctcaaccagatcttcggctccaaaggcctcacccaggcccagatggtcgcgctctcaggggcgcacacggtggggatggcgcagtgcagctccttcagcagccggctctactcgtacgggaccagcggcgggaaggaccccagcatggacccgacctacctggccacgctcagcacgcagtgcccgcagtccggagccagccagcccgtcgccatggaccccgtcacccccaacaccttcgacaccaactactacgccaacgtcgccgccaaccgcggcctgctcgcctccgaccaggcgctgctcgccgacaacagcaccgccgcccaggtcctcggctacaccaccaaccccggcaccttccagaccgacttcgccaacgccatggtcgccatgggcgccatcggcgtgctcaccggcaacaccggcaccatcaggacaaactgcagggtcgtcggctgatcgatcgagcgtgtgattgaactgaattgtactatggagtagataggtatagtgtactgtaaactgtttggtcgatctgtactcgct

SEQ ID NO: 281 - DNA, 668 bp, Hordeum vulgare
cattacccagacctcgcatctagctagttccatccaccatggccagcagcaagacgttgctcctcgccctatgcgcggcagctgcagctgcgacgctgagcccggcctccgcggcggacgacatgaccaagttcaaggtgtacttccacgacgtcctagcggggaagagcccgacggcgatccggattgcgcaggcggcatccaccaacagctcctccaccttcttcggcgcggtggtggccatagacgacccgctcaccaccagccccgccgtcacgggatccgccaaatccaaggacgaggtgggccgcgcgcaggggacctacacgttcgccgaccaggccaccttcgggctcctcatgaacatgaacttcgtgttcaccgccggggagtacaagggcagcagcctgaccatctacggccgcaacgaggtgctttcggcggtgagggagatgagcatcctcgggggcacgggcaagttccgcatggctcgcggctacgtccaggcgagcaccgtggactccggcgccaactccggcgagaccgtcgtcgagtacaccgtatacgtcaaggcggctgcggcttagcggctgctgtcgggcggaaaatattgtcatattttgcttggaataaatggacttttgcagatttgttgcgtttgttattag

SEQ ID NO: 282 - DNA, 1964 bp, Hordeum vulgare
cacccagtagattgtgaattgcaatagacgaaacgcacattgcccacaatggctctaacgctcttacgagggatcagaacgcaaaccttatttggagcaaatgcaggcctgttctgtaccactcgacgtcatccgctagcccacttcacaactagggtggagagtgtgcagaccagtgagcccaaatcagtgcgcaaatcaattcaacaagccaccaaggaggcagcggagcacaagacacaaggttttgaagcggtgatcggcattgagacccatgtccagctctcgaccatcacaaaggcgttttgctcctgcccatacgactatggatcccagccaaacagcactgtttgccccacctgcatgggccaccccgggacattgccggttctgaacgcaaaggttgttgaatgtgctgtcaagctaggcctcgctctcaactgtgagatttccatgacatccaagtttgatcgaaagcagtacttctatccagaccttcccaagggataccagatttcgcagtttgacattccgattgctgagaagggttaccttgatttggatattccaatggagtttggtggtggtcacaggcgatttggggtcacgcgggttcacatggaagaagatgctggcaagctgcttcactctgaatcagggagtttttctcaggttgacctaaatagagccggcgtccctttgctagagattgtctcagagccagatatgaggacaggcatagaggctgctgagtatggtgctgagatacaaagggttgttagatacctgggagtgggcaatggcaacatgcaggaaggttccctccgctgtgatgtgaatgtatctgtccggcctattggacaatcagaattcggtacaaaggttgaaataaagaatatgaactcattttctgaaataagtagggcaatagattatgagatatcccgacagattcttcttcacaaagaaagccaggctgacaaaattgtacaagaaacccgtctatgggatgaatcttctcagaaaacttttacaatgcggaaaaaggagggacttgccgactacagatattttcctgagcctgatcttcctgaagttgttctgactagtgagtacattgatgaaattcgtaattcaatgccggagcttccagaggcaaagcgtaggcgttatgagaacatggggctcagcatgcaagatgttattttccttgctaatgacgatattgttgctcatttcttcgattctacacttgagcgtggtgctgatgcaaagctggctgctaattggatcatgggtgacattacggcttatctgaagaatgaaaagctctctattgatgaaattaaattaacacctcttgagctttctgaactgattgcattcataaagaatggtactatcagtgggaagattggcaaggagattcttgttgagctcattactaaaggcggaactgtcaagtcggtgatagaggagaaagatttggttcagatagcagatccagcagcaattgaggccatggtagataaagtactcgccgagaatccaaagcaacttgagcagtatcgggctgggaaaaccaagttgcagggatttttcgctgggcaggtgatgaaagcatcgaaaggtaaagcaagtcctgttttattgaacaaaatcctcggggagaagttgaagggtaattaaaattgccgaggtgtttcggcacagagagaatatcttgcccttgatgagtgaaccatcagattacaactaaagtgaaaccccgtagcagaatcacattcttttgtaaaaacacttacttggagtttggagtgttgattacctttcgctctcttttcactacagagtggattttggaaaagcaatccagttcacatgacacaaagatgaaggatatgcatggtatgtgtttgagctgataatagactggaatggtgtggtgtgcagatgaatcagtt

SEQ ID NO: 283 - DNA, 1342 bp, Hordeum vulgare
gtagagagaatccctcctcctcctccctcgccgccgcggcattcccccgagcaccctccgcgcgttgcgcgagcgcggcagccatgggctcgctcccggtgctctccctgccggaatgcgcggcgcctccgcaggagggggcgcgggcgacggtagcggcgccggacctggctgcgctcttccgcgcgcagcggcgccacctcgaccacttcttcgaccggctcgacatgccgcaggcggcggcgttcgcgcaggcgctgctggacgcgcccggggccgtcttcttcacgggcgtcggcaagtccggcatcgtggcgcgcaagctggcgcagacgctcgcctccctcggcttcgcgcgcgccgggttcctctcccccgtcgacgcgctccacggcgacatcggctccctcttccccggggacgtcctcgtgctgctctccaagtccggggcatccgacgagctgctcgcgctcgtgccatgcgcgcgcgccaagggcgcgcgcctcatctccctcacctccgcggcatccggcgcagactgcccgctcgccgccgcatgcgacctcaacgtgcacctcccgctgcagggggaggtctgccccttcggcctcgcgcccgtcacctccaccgccatacagatggtcttcggcgacaccgtcgtcgccgccatcatggaggcgcgccgcctcaccagggaccagtacgcggccaaccaccccgccgggaaaatcggaaagaccctcatcttcaaggttaaggatgtcatgaagaaacaaaatgatcttccattgtgcaaggagggagatatgataatggatcaacttactgagctcactagtaaaggttgtggctgtcttcttgtggttgatgatgagtatcatttgattggaactttcaccgacggagacctccggcgtacactcaaggcaagcgggccagctattttcagtctaacagttggagagatgtgcaacaggaacccaaggacaatcaccgcgggtgcaatggcggttgaagccatggagaagatggagtcgcccccttcacctgtgcagttcctgcctgtcgtcgatgacaagaacgttgtgtctgggatcattacactgcatggtttggtctctgctggattgtaactggttctttgtgtgtagcctgccctggttcttcgtgtttctttgtgtgtagcctgccccggtttttcgtggttctttgtgcctgcttggtcctcccaagacatcagataaattcttgtgaatctgatcggcatcatcttatcgctgttgtagcatctgtagtctagaaatgtggagattatgtgttcgaaggcacactaccagtatca

SEQ ID NO: 284 - DNA, 416 bp, Hordeum vulgare
ctttccaattgaccagtcgcctgcctccgcccccttcgcgaagtttccccgctccacaattacgccatggccggcggcggcatcttcagcagggcgctgagctacgtcgtcaacgagttcctcgtggagggcctcgccaacaaccgtgccttccagaggtttgctgtgaggaccaacaagactttggagaatctctcaaccaaagctaaacaagtgagggaggaggtgtcggagcaatttaaggatgctcgcggacccgatgatcgcttcaagcagtgatacctgctatcagcgctcctggttgtctgttcttgttctggttttggatgccatccgcaagcgtccattgtataaaatccggatctaaattatcttattttctatttagaaattgagaactagaggcagagcactgt

SEQ ID NO: 285 - DNA, 1142 bp, Hordeum vulgare
cgactgcctgttcttccccaataatgcgcggcatcgcctccgccggaacgctccaccccaggccatctgcggctgtccgatcaaaatccaacgcggcagaccgccccaccctccaccgacgacccaccctccacctccggcggtcaccggaaaactctctgccgtccatccgccgcagcggccgcctcatgcctcctcttaccgcggccgccctggccaccagcagcggcgccgaatccttcagcgagctggcctctgccgacgatttcgcggccatcgcatctcccgacggccacatctccgtcatcggcttcggctcccttctctccgagcggagcgcgaggagcacgttcccggagctggaggggttccgtgtggcggcgctgcgcgggttccggcgcgtcttcgcccacgccgccccaatattcttcgagcgcggcatcgccattgaggccactaaggagttctcaagcttaagcgtggagcactgcgagggcgaaatgatagttgtcactgtgtttgaaatcaaggaggaggaggtgccagcattcattgagagggagctcgagttcagatttcttgcggtggtccctgaagggctggacggagtgccttttccaaatcaagctgttgtctgtgcacgctatagtgatgaagagtatttccgagtgagatgcaaaggaagcaaagagatatataatcagcactatggacgatacaacattgataaaatatggagggatgatattttgccctgtcgtctatatctcaggcactgtgttcttgccgccaagaatctgggagaagcagcatatagcaacttcttggaccacacctatctgggtgaccggagaaccacgataagggaatacttggccacgaccggagctggcatcatggaagaggagccaccggagatgctaaaaagccgctatggcggctaactcgacgacgactctcagggccacggccatcacaaattgaaattctcacttgtgtgactgctgcctacgaaatcggcagtcagatatgaacggggttgcgccaaataatgcatgatgctgcagtgcagaatatctaagattgcgattgttttccgcgcaaattattggcgccaaacgctgtgatctgtgatcctgttt

SEQ ID NO: 286 - DNA, 608 bp, Hordeum vulgare
aaactcgagacacagacatacatgggatccttgggccctgccgtgagcgtgagcatggccaaggccagcggcggcacggcggccgtcggcggccagcagcagcagcagccggagcgcggcgcgttcagctgcggcttccggatgccgctgcactacccgcggtacaggaaggcggactacgaggcgatgccggagtggcgcgtcgactgcctgctccgggagtacggcctccccgtcgccggcgacgtcgaggacaagaggaggttcgccatgggcgccttcctctggcccggccagtactgatccaccatcttacatctcgccactcggagcagatcaggccggtcagcaagccagcgcctggcagaggctgatcagcaatggcagaagcaacatcacgtacatccatccccatgtatgaacaaaagagagcttgtgacgatattatattcttatatctatcattctaatagtaatctccaattctctccgtagagaatacatatgatgtttcttggagtatatgtaagcagtggaagaaggacttgtttctgatattcatacgtgtaatgtagtgcttcttaggtaccgtgcgacctgaattcttt

SEQ ID NO: 287 - DNA, 1996 bp, Hordeum vulgare
aaagtcgactgtacctttcgctcgcctccgcctccatgcagcaccgctcgccggcggcggccacggcctccggagctgcctccactgcggccgccatggcgccaggcgtcagcggcgtcgagcctgcggtgacgctcgaccaggtgccgcgctggagcgaccccgaccagcgcctgtacacgccgtcctcctcgcccgccgccgctgatgccgcggacgggggatccgagcccgcagcgtccgccttcctctccttctccgacccgctaaccggcgacgacggcggcgccgccggtggtggccgcgcgggtgcctcgcgcttccccgtggaccacgagatcaactccaggatctacctctggcggggacacccctggaacatggaggtcgatgccgtcgtcaactccaccaacgagagcttggacgaggcgcacagtagtcctgggctgcactctgcagcaggttcagggctcgccgaggagtgcgccaccttgggagggtgccgaactgggatggcaaagatgaccaatgcatacgatcttcctgcgaggaaggtcatccatacagtgggacccaaatatgctgtcaagtatcacacagctgcggaaaatgcacttagtcattgctatcggtcatgtttggaactactcattgaggacggccttgaaagcatcgcaatgggttgcatatacacggaagctaaaaactatcctcgtgaaccagctgcccatgtggcaataaggactgttagacgttttctggagaaacagaaaggcaagatagctggtgttattttttgtattacatcatcatctgatacagagatatacaaaagattgcttccgctatatttccctcgggacaagcaagaggaagagactgcggtatcaaaacttccagctgatgtcggagatgagaatggtgaaactgtaatagatgaaaggaaaataagaataagacctttgcctgctggtgcagcagatagaacagtgcctgcagctcctcttgatcttcctgttgagtctggattggcatcaagcaggaatgcattcaaattggattcgtatttggacccttcatttatgtcattaattaaagacccagatgtgcggcgcaaggagcagtgggaaaaatcttctcaagctcaaaagggatttaattatgctaggttgcttggatatggtgatataggtttccctccattgtctgctgccgaggaatattcacttcattcacgataccttgcaaaagcaaattcccttaatctttcagagatcgctgagatgaaaataatctatcgtggtggagttgatagtgaagggcgcccagttatggttgttgttggtgcacactttcttcttcgctgcctggatcttgaacggtttgttctacatgtagtgaaggagtttgaacctttgattcagaagccgtatactattgtctatctccactcagcagcatcattacaaccgcaaccagatttaggatttatgaaacggatacaacaaatattaggtcggaaacaccagcggaaccttcatgggatttatatgctccacccaaccttggggttgagaacagctattctggggatgcagcttttaattgatggagaggtatggaagaaagttgtgtatgttgacaggctcgtgcaactgttcagatatgttccacgcgaacaattaactattccagattttgtctttcagcatgatttggaggtgaatggtggtaggggcatgattgtggacccaagaacaaaacatatctatcagagaccatctggttgattcatgtcatctatgcagtccaaagctcacacttgccttttcaagtctttgtataattactcctttgttgatatttctcttttccctttgtaactagtttaggagttctattcctttcattcgttcctcagccttcagggaaggggattattgtttgtatatgttaatttctacagctgaaataaagtggcgtctcagaattcttt

SEQ ID NO: 288 - DNA, 1181 bp, Hordeum vulgare
agcaacagctagcgcacatcggaagcagcagcagccatgaagctctgcttctgcctcgccgttgtgaccctggccgcgcttctctcgtccgaggccgtggtcgcctgcatcgacgtgggcttctacgacaggacctgcccgtccgccgagaccctggtgcagcagaccgtggccgccgccttcggcaacgactccggcgtcgccccggccatcatccgcctccacttccacgactgcttcgtcaagggctgcgacggctccgtgctgatcgactccacgcctggcaacaaggcggagaaggactcggggcccaacttccccagcctccgcttctttgacgtggtggaccgcgccaaggcggccctcgaggcgcaatgccccggcgtcgtctcctgcgccgacgtcctcgccttcgcggctcgggacagcgtcgttctgtcgggcggcctcgggtaccaggtgcccgcagggcggcgggacggccgcgtgtccaccgaagcggacgcgctcaacaacctgcccggaccaacgtccaccgcctccgacctggtcgccggcttcgccgccaagaacctcaccgtcgaggacatcgtcgtcctctccggcgcccacaccatcggcgtctcccactgcagcagcttgaccgagaggatctacaacttcccaaacacaaccgatgggattgatccgaagctgagcaaggcgtacgcgttcttgctcaagggcatctgcccgcccaacagcaaccagacgttcccgacgacgacgaccctcatggacctcatcacgccgacgaggttcgacaacaagtactacgtggggctgaccaacaacctggggctcttccagtcggacgcggcgctgctgaccaacgccaccatgaagtcgctggtcgactccttcgtgcgcagcgaggcggcgttccggaccaggttcgccaggtccatgctcaagatggggcagatcgaggtgctctccggggcacagggcgagatcaggcgcaactgcagggtcatcaaccctaccaacgccactagtgccggcgccgttcaccatcatcttctcccgggatcatcaggttcttcaggatccaaccaggtggctgcaagctgattagttggtggtcactagagatatgtgtacgtgcagtgtgcatgaggtcgagtgctctagtgatgcaa

SEQ ID NO: 289 - DNA, 2107 bp, Hordeum vulgare
tcgttccttcgcgatggcggcggtggcggacgcggccacggccatgaccatcgacttcctccgcgcgcgcctcctctccgagcgctccgtctcccgcgcagccaaggaccgcgccgaccagctcgccaaccgggtcgcggagctggaggagcagctccggtcggtgacggcccagcggcgggaggcggagcgggccgccgcggaggtgctcgccatcctcgactcccagggcttctccgacgccgcagattccgtctccgacgacgacgcctgcggcccacccgaggcccccgaccacgggaccggcggccaggcgcgcggtgaggcggaggatgcgctgtcgggctcggagctgggaggcccgccccagcctgggcgcctctcctggaagggccgcgccgcgagccccggcgcggacaggcggcatccgcatctcaaagccagacagcggcatggccatggccacaggaggagctacttttacttgctcggcgcggattcctcgcccaagtaccagccgggccagtcctgccggaagatcaggagaaaggagccgagattgcagactgaaggtggggatgccaaggacaatgctgccgagggtctcgaggaggaccaggcaaaatctgactctactgtttgcacggatgagaagcttgatttggacggtgaggttggtcacggcgggcgaggtccttgtggtgatggaagggttgaggatgacggtgggaggtacgcaatggaggatgtgaaggatggggagatggagagagtcctcgagaatcatgctgcgctgattgggcagtatgaggcacaagaaaatgctcagagggagtgggagaagaaatttaatgggagccgggattcaacttcggatgatgtcgaccgagacagtaagttaaatcagaatgaaaaggcttgtgaacagaggggcagagctgctcagattatggatagagaagtagttggtgaagagacaccgtcaagggataaagatctctctggaaccaacagtccttccgaatgtttgttgaatgtatctgcctttggcttgtccacaaatgctccaaacgtaagtgttattgggaagtgcaaaggatctgataatgatttcgagcgggttactgcagcagttgctacacttgatgaattgcattccaggaaggatgagttagtacataaaatttatactgaaattattgaagggggtgggagtaatcgtggaagatcagcttcttcaccacaaaaaagccatagtagcagcccaaatgcaggacacaatgaaggtcaaggagatggcaattcagacaatggttcaagctaccatgtgaatgcttgctcttatgagcactacggaaccacaccatcacctggaagtcctttgagtgatacccctaaaagcaaagtgtctgaatggagctcgtcatgcttccataaccatattgataaccagattgacatgcagccatcctcaagtgatgatgtgggaggtgttctagaggcccttcaacgggccaagatgtccctcagggaaaagctgagcagggcaagtccacccaggcaagacatgttggcactaccagcacccgaggatcactacacagatgatgattcacaggccaatgatacagaattttcactttgcatgtcacaacgacttagccatgaaatattggcactgccagtatcaggagaatacctaagcaggatcagttggccaggcgatgatgcaaaaataccagttggccctgctggcttgttccggttgccaacagactcgtttccccaaaacgaggtgtgctccgctgatggctatggctcaaggttcagtttggcatcaagtcggcagaccgtcttttcaggaaaccctgctagtaatagcatgttaacttcatctcgtccgcagtatggttctggtttctcaccgaatccgtattacgatcttcatagttcaatgttactgtcaatgcctacaacaagggatgcttctttcatcccagaaattctaaggtctagtgatgattcgagaaggggaatgtcttctggtgatgcaggcatgctgtcccagtatggtaatgcttatgattagtagctggagtgtagtagt

SEQ ID NO: 290 - DNA, 1934 bp, Hordeum vulgare
aaaggatgcatggtctgtggaggtgcggtggttgcttcgagcctctgcaatattttgcgacggccgttcggtgcgctgctttcgagctgcttcgccgtgatcccgatggccgaccttcccccctttatataccgccggccgccgcgatccctcctccatctcaccgcaccaccgcaccacctgccaccgacgagaagcatagtcctcctcgtcctcttagcgccatggcctgcagctgcgctcacggggtggagttcgacgccaacgtgatccggaacagcgcgctggaggacgggctcgccgggtgggcggcggtaggcgcgtgcacggagctgtcggtgcgccatgaggagccggccagggtgcccacggagaccatcaacgacgtggaggacgggtacaggccgagcggcaggtacattctcgcggcgggccgcggcggcgaggaggacggcctctgccaggccatccccgccggcgcgctcaagcccagggtcacgtaccgggtggccgggtggatcggcctcggcgacggcgccgccggggagcacgcggtgcgcgtcaacattcgtttggacggcggcgagggcggggagtgcgcgatggtggtcgagggcggcgcggtgtgcgccgaggccggcaggtggacggagatcaagggcgtgttccggctcaaagccagcccgccgtccggcgccgcggtgcacgtccagggcgcgccccccggcgtcgacgtcaaggtgatggatctccaggtgttcgccacggaccgcaaggcccgcttcaagaagctcaggaagaagactgacaaggtgcggaggcgggacgtggtgctcaagtttgccggcgccggggcgtcgtcggcggtgtcgggggcgtcgatccgggtgatgcagatggacacgagcttcgcgttcggcgcgtgcatcaacccggcggtgatccaggagccggcgttcgtggactacttcaccaagcacttcgactgggcggtgttcgagaacgagctcaagtggtaccacacggaggcggtgcaggggcagctcaactacgccgaccccgacgcgctgctcgacttctgcgaccggcacggcaagccggtgcgcgggcactgcatcttctgggccgtcgaccgcatggtgcagaagtgggtcaaggacctgcccaacgaccagctcgccgccgccgtccagggccgcctcaccagcctcctcacccgctacgccggccggttcccgcactacgacgtcaacaacgagatgctccacggcaccttcttccaggaccgcctcggcgacgacatcaacgccttcatgttcaaggagacggccaggatcgaccccggcgccgccctcttcgtcaacgactacaacgtcgagggcggcagcgaccccagcgccaccccggacaagtacatcgcgcaggtcaacgcgctcatggagaagggcgcccccgtcggcggcatcggcctgcagggccacgtcaccaaccccgccggcgagatcatctgcgacgcgctcgacaagctcgccaccaccgacctgcccgtctggctcaccgagctcgacgtgtgcgagtccgacgtctgcctgcgcgccgaggacctcgaggtggtgctccgggaggcgtacgcgcacccggccgtcgagggcgtcgtgctctgggggttcatgcaggggcacatgtggcgccaggacgcctgcctcgtcaacgccgacggcaccatcaacgacgccggccagaggttcatcaacctgcggcaggagtggacgtcgcacgcgcgcgggaagatcgacagcgacggcaacttcaagttcagagggtaccacggctcgtacgtcgtgcagctcgccacggccacggggaagatgcacaaggccttcagcgtcgacaagggggacacacctctcgtgctggacatggacgtgtgatga

SEQ ID NO: 291 - DNA, 1271 bp, Brassica napus
aaagtcgacgagtcatgcggatggaaacacaaggcaaagttatcacttgcagagcggctgtggcatggggagcaggagaagctctagtgatggaggatgtaaaagtggatcctcctcagagattggaagttagactacgaatcctcttcacttccatctgtcacactgatcttagcgcatggaaaggcgagaacgaggctcagcaagcataccctcgaatccttggtcatgaggctgcaggaatagtggagagcgtaggggaaggagtggaagatatgaaggcaggggatcatgtgctccctattttcaccggagaatgtggtgattgcagagtctgcaaacgagacggagccaatctttgcgagaggttccgagtggatccaatgaagaaagtgatggtaggtgatgggaagaccagattcttcaccagcaaagacaacaagcccatctaccattttcttaacacatccaccttctccgagtacacggtcatagactcggcctgtgtggtgaaggtggaccctcggtttcctctagagaagatgagcctcctcagctgcggtgtctcaactggagtgggtgcggcctggaacgtggctgatattcagcctggctccaccgtcgctatctttgggctgggcgctgttgggcttgcggtagctgagggtgcaagagcaaagggggcctcaaaaatcattgggatcgacgtcaaccctgacaagttcccattagggagagaagtggggatcaatgagttcataaacccaaaggagagtgacaagacggttcacgagagggtgatggagataactgagggaggagttgagtacagcttcgagtgtgcgggaagaattgaagcacttcgagaagcttttttatctacaaactcgggagtgggagtgacagtgttgcttggcgttcacgcaagcccacagcttctacctatccatcccatggagctcttccaaggcagatcaatcactgcctctgtttttggaggtttcaaacccaaaacacagttgcctcttctcttcacacagtgcctcgaaggtcagctcaatctagacctcttcatctctcaccagcttcctttcagtgatattaacgaagctatgcagctcctacatcagggcaaggctctccgttgtcttctccgcctctgatcatctctttcatatttcatgtgtttacaagttgtggtgatgattttattacacaagttaagttgtggtgatgatgatttgattatggtttcctgctaggaattcttt

SEQ ID NO: 292 - DNA, 1531 bp, Gossypium hirsutum
aatcatctttcatttcacgaccagattgcctggccctacttcactgatcctccattggcttacccattgtaaaaatcttcgacgctattatcgaatctttttattctttttactctacagtctacagtcccaacgtttgaagttaagtcacgcatctctcttccttaaatctctgtacatcgctcttcacttcttcttagaacccctcaaaaggactgcctcaaacaaggaagtcaatgtcgttttctgagttcaggccactagacgagaactccctcatcgaatacattaaagccacgccgtctttgtcatcgaagatcggccacaactatgatggtttaaagattaaggaagttggagatggcaatcttaatttcgtccacatcatcgttggcccttctggttcttttgtaatcaagcaggcacttccctacatacgatgtattggggaatcttggcccatgactaaggaacgagcatatttcgaagcggtggcgttaaaacaacatggtgggttatgccctgaacatgttcctgaagtttatcactttgaccgtaccatgtccttgattggaatgcgatatttagagccgccccatataatcctgagaaaagggttaattgctgggattgaatatcctttgttggcggaacatatgtcagaatacatggccaagactcttttctgcacatctctcctatatcagtcaaccacagagcacaaacgtgcagttgctgaattttgtgggaatgtggaactatgcaggctcactgagcaggttgttttttctgacccctataaagtatctgaatataaccgttggacttcaccttatcttgaccgtgatgccgagactgtccgggaggataatctattgaaaattgaagtagctgaattgaaatctaagttctgtgaaagagctcaggctcttatacatggagatctccatactggttctgtaatggttacccctgattcaactcaggtcatagatccagagtttgcgttttatggaccaatgggatttgatattggtgcttttgttggaaacttgattctggctttctttgcacaagatggacatgctggtcaagggaatgacagaaaatcatacaaagagtggatattgaagacaattgaggatacttggaatcttttccaccaaaagtttaccgcactatgggacgaacacaaaaatggctctggggaggcttatcttcctgcaatttataacaatcctgagcttcagaaacttatacaggaaaagtatatgaaggaattgttccacgatactcttggttttggtgctgctaagatgataaggcgaattgtaggtgttgctcatgttgaggattttgaatcaattaaagaagctaacataagagcagattgcgagcgacgggctcttgaattaggcaagacacttctaaagaggaggcgagagtttgtgtctattagtgaagttatttcagccatgaagcacgtctaatcatgatggaaatgatggaaactgctgtgcacgtatccata

SEQ ID NO: 293 - DNA, 1768 bp, Setaria italica
aataaccctccctcccagactcccagtcccagagaagatcattcagccatcagcacttcttcagcgggagggaagacgagacgaggcgtaaacgtaacctcgcctcccccacatggcctgggcgcgcctcgcctcccgctcccgtctccgcccagccgcctcctccgccgtcggccaagccccacgcgcctcgccgccggctccgcctccgcctccgcaggcgggacaagcggcccgcgccgcaccgcccctccggaggctcctccgtctccctcaactccattccgccgccacggcgtcctcggcgtcgcacgcgcggcggctcggcgaccgatggcagcgcctgggggtagcgaggaggtggctcgccagcgacgcatccgcggcggcggaggcggcggagctggtggaggtgccactggcgcagactggggaaggcatcgccgagtgcgagctgctgcgctggttcgtgaacgagggtgaccaagtagatgaattccagccactctgtgaagtacagagtgacaaagcaactattgagataacaagtcgtttcaagggaaaagtacatcagattcactttggccctggtgacatagtgaaggttggtgaaactttattgaaaatgattgtgggtgacagccaaattgtatctccagataatatatttccatccgctgataagtcacttgaagaagagcctgcagttccttcaagtgaaggcaatattcctagtggaactctctctacaccagctgttagacatctagcaaagcagtatgggctcaacataaatgaaatcgttggaacaggtaaagatggtagggttttgaaagaagatgtgttgaattatgctgtcagcaagggtctttacaaagaacaatcatcatctttggaagagaacattggtctaattgacttactggaggaagggaaatcattacctgatgtacccttctatgaagataagaagattcttctcaggggataccagagagcaatggtcaaatcaatgagcctggctgccaaagttccacattttcattatctggaggaaataaattgtgattctcttgtaaaactgaagaaagcatttcaaaatgagaataaagataatactatcaagcacactttccttccgttcctcataaagtcactctctatggcactgaataaatatcctatgttgaacagctctttcattgaggaaaccaatgaagttattttgaaaggatcccacaacattgggatagcaatggctacagcacatggtttagtcgtgccaaacatcaagaaagtgcagtcactatcaatattggagatcacaaaggaattggcgcgattgcatgagatggcatcacacaacaggctaagcgctgcagatattgaagatggcaccataacacttagcaacataggcgccattggtggcaagttcggctctccacttctgaacctgcctgaagttgccatcattgccctcgggcgcattcagaagcttcctcgctttgatgatgacgaaaacgtttacccttcatccataatcaatgttactgttggagccgatcaccgagttgttgatggggccacggttgcaagattctgtaatgagtggaagggcctcgtggaggagccagagctgctcttgctgcatatgcgatgatccagtaagatacctgatgcgagggattgctcaaaatttctgaagataagttgaaatggaggcattccggcatcgcaacttcacaccgaaagactattgcgaatt

SEQ ID NO: 294 - DNA, 703 bp, Setaria italica
ctgtgagcagtggtaccaagggattagcgatggcgaggcggcggccggcggtgctgctgctggtagtcgtggcgctggcggcggtcctgtcggcggcgcgatgggcggacgcgctgtcggtgacggtgaccgacaccgagtgcatccacgagtttgtgccctacgagggcgacaccgtgtccgggaacttcgtcgtcgtcgaccacgatatcttctggagctccgaccaccccggcatcgacctcacggtaacttcaccaggtggcaatactgtacatacgttgaaggggaaatctggtgaaaaatttgagtttaaagctccaaggggtggcatgtacaagttttgcttccataacccatatggagcacctgaaactgtttctttctacattcatgtcgggcacatacccaatgagcacaatttggcaaaagatgagcacttggaccccattaatgttaaaattgcagagctgaaggaagcattagagtccgtcactgctgagcagaagtacctaaaagcacgtgaagctcgtcaccgacacacaaatgagagcaccagaaagcgtgtcatgttctacacaatggcggagtaccttgctttcatggcagctagcgctttgcaagtcgtctacatccgccgcttgttcagtaaaaatgtggcatacaacagagtgtaggatacaactctactttgaaggcgtca

SEQ ID NO: 295 - DNA, 1338 bp, Setaria italica
gacctggtttagtggagtggtgacttgccgtcgcgtcgcgtaccactgccgctattatatatcggccgtcagtgtcccccggcctagcccgatcgcggcatctcgttttcagtttgattcgagtgccggggaggggggcgatcgatggcgaagggcaacggcgctgccatggccgccgcggcggtcctcgccctggccgcgctcctgtgttcgccggccgccggggagctggcccggctggagcacacggccaagaacggcgggtcgctcagcctcctcgtcgtcggcgactggggacgcaagggcacgtacaaccaatccagggtcgccgagcagatggggaaagtcggtgagcagctcgacatcgacttcgtcatatccaccggcgacaacttctacgagaacggcctgacgggcacagatgaccaggcgttcgagcaatccttcaccgacatctacacggcgaagagcctgcaaaagccctggtacctcgttctgggaaaccatgactacaggggtgatgtgcttgcacagctcagcccagtcctgcaaaagattgacagccggttcatttgcatgaggtcgtttattgttaacgcagaaattgtggatttcttctttgttgacacgactccatttcaactgaagtactggactcaccctaaagatgatcattatgattggagagaagtggcgcctcgagaaaaatacttagccaatttgttgaaggatttggacgaggccatgaagaaatcaactgcaacgtggaagattgccgtgggacatcataccatgaggagtgtcagtgatcatggtgacaccaaggagcttctgcagctacttcttccggtcctccaggccaacggcgtcgacttctacatcaatgggcacgaccactgcctggagcacattagcagcagggacagcccgatccagtacttcacaagcggaggcggttcgaaagcatggagaggagtgttccagcccaacgaagataaccttgagttcttctatgacgggcaagggttcatgtccctccagctcgaccaaaaccaagccgagttcaccttttatgacgtcgatgggaatgagctgtaccaatatacgcggtcgagcccgatggaaacgagccacctccggccgtccggctacgccacagaggaatgagtcggatggagatcaccacgagagattagagatcggttcaggtatccgacatcactgtaaaatttgattgtggcattgtgataagcggcggagaagtgatctgagagaaaaatgtactagtactgaagtatggcgtgtagttcatccatccacggagaaggaatacctagg

SEQ ID NO: 296 - DNA, 2522 bp, Setaria italica
cgcttcagatggccgagccgccggagcaggcgtcatcggaccccaccactccgccgcaggaagacaaccaaagcaccaagacaaatagcaagaagaatcgcggcacgaagaaatcgaagcgagccggcgcctcctcgctgtgctccagcaccatggttgaggacccgttcttcgtcctcgccggcggcaaggaaggagggttcctggagttggaggagattgacgaggcggacttcgggattgttgggggatacgtggaggaagtgggagcagatgaggggaaggctggcaaggatcgggggaagaagaagaagaagaggaagcggaagcgtgggggtgatgaccaggtcttgagtggcgatggcgattcttttttgaaacaatgcgatggcgattcagtagttgagaatgagcaggagggggagaaagagaagaagaatgcgaagggaaagagggacaggaagaagaggaaggtgaaggatagtgagaagagtggggagagcggcaaggacatagctgatgacgacaatgcagaagacgtgcaagataaaaatgagaacatggaacaagataaggatgatgatcttattttgggtgaggatgatgtttttgcatggcacgaacttaggcttcaccctctgcttgtcaaggcaatgcgcaggcttggattcaaagaaccaactcctatacaaaagtcgtcctttcctgctgcagctcaccaaggcaaggatgttattggtgcagccgagacaggttctggaaagacgcttgcctttggcctccctattttgcaacgtctccttgaggagcgagaaaaggcctcaagattacaccaggaagacgaaaaaatggaggaaagtgctggggaaagccctcttcgtgctcttattttgacacccaccagggagcttgcccaacaggtatgcgatcatctaaaagaagcagccaagttcttaggaattggcgtcattcctattgttggtggtatatccatggaaaagcaagaacggcttttgaaaaacaagcctgaaattgttgttggaactcccggaagattgtgggagctcatgtcgatgaacaatcaacacctagttgagctgcattcattgtcattcttcgtgttggatgaggctgatagaatgatcgaacgaggccatttccacgaattacaatctatcattgagatgctcccgctgactaatggttctgatgaacaagctgcaagaacaatgccaaactgtgagactgtgccaatcttgcaaataaagaagaggcaaacctttgttttctcagccacacttgcactttcatctaatttccggaagaagctgaagcgtggcttatctacttcaaaggcgtcgactgatgatgtaagctctattgaagccctgtcgaagaaggctggaatgaaaccaaatgcagaaatagttgatctgacaaaggcttcaatcttgcctgagaaacttgaagaatcttttattgagtgcagtgaagaggataaggatgcctatctgtattatatactgagtgttcatgggcaaggtcgagcaataattttttgtacatcaatcgctgcattacgccacatttcctccatattgcgcattcttggtattaatgccttgacaaaccatgctcaaatgcaacaaagggctcgcatgaaggccgtggatcgtttccgtggaagtgagaattccattttggtcgcaactgatggatttgcaaggggtatggattttgatgatgtgcgaacagttatccattaccagttgccacattcaactgatgtttatatccacagaagtggaaggacagcacgcaaatcattggctggctgcagcattgcattaatctcttctgctgacaagtcgaagttttactctctttgtaagtcattgtcaaaggagaacctccagcaatttcctatagatcatgcttacatgcctgcagtaatgaataggctctcgcttgctcggcagattgacaagattacacgcaaaaattcacaggaaaatgctaacaaatcctggcttcagaggaatgctgaatccatgggattgatattggagaccagtgacagtgaagaagaacgtgtaaagggccacaagcaacgaaaggcaacttctgcacatctccaaaagcttcaacaggaattgagtgatcttttgcaacgcccgttgcagcctaatactttttcacgacgctatttggctggggctggaatttcaccattacttcagaagcaactagaagagttggccaagagaaaagtaagcaacaatagaagcaagactgagaataaagggtctcgatttgttgttattgggcaggatcgtgtcgaacccttacaagcacttcagaattctgggcaagaggtctgtgtcaacttagacaaacaaagagaaaagcgaagacttgctcagaactggaagcaaaagaagcatgaagaaaagaaacgttcgcgggagcagaagagaaaggagaaaagaaaagctaaagcgatggactaaataacaggttga

SEQ ID NO: 297 - DNA, 1982 bp, Setaria italica
aaaccctactcggctcggctccactcgccgccgcagccgcagccggagatggaggacatcgaggacgtgctaggcccggccggcctctccggcggcggggcgcctccggggctccgcctccctctctccacggtcgcggtcaagcccaagcgccggtcgtccagggtcgcgcagacaccgccccagcccgaggcccggattcctggcacgcagacgatatacgtcaagacgttcgggtgctcacataaccagagtgacagtgaatacatgtcagggcagctctcggcatttggatatgctattactgaagaacccgaaggagcagatttgtggctaattaacacatgcacggtgaaaaatcctagtcaatctgcgatgaccacccttatatcaaaatgcaagaatgcaaaaaaaccattagtagtggctggatgtgtaccgcaaggaagccagggtctcaaggagcttgaaggcattagtataattggagtgcaacagatagaccgggttgttgaagtggttgaggaaaccttaaaaggccatgaggttcggctgttgagtcggaaaacactgccctcacttgatttacctaaggtaagaaagaacaagtttattgagattcttcctattaacgtggggtgtttaggcgcctgcacatactgtaagacaaagcatgctcgtggtcatttgggaagctatactattgacagcttggtggatcgtgtgaaaattgttgtctctgaaggtgtccgagagatatggttgagcagtgaagatactggtgcttatggcagggatatcggtacaaatcttccaaatctgttgaacgcaattgttgcagagcttcctgctgaccgaagcacaatgctccgcataggcatgacaaaccctcctttcatactagagcatttgaaggagatagctgccattttgtgtcatccttgtgtttattctttcctccatgttcctgtgcaatctggaagcgatgctgttttaacgggaatgaatcgtgaatacactgttggtgagtttaggaaggtagttgacactctctgtgagcttgtccctggaatgcaaattgcgacagatattatctgtggctttcctggtgagactgatgaagattttgccgagactgttaatcttgtaaaggactatcaattccctcaagtccacatatcacagttttaccccagaccagggacacctgctgctaggatgaagaaagtgccaagcaatgatgtgaagaagcggagtcgtgaactgacttctgttttcgaatcattttcaccctaccaaggaatggaaggcaaggtagagcgaatctgggtaaccatgatagctactgatggtgttcacttggtgggacataccaagggatatatccaggtgctggtcattgccccagatagcatgctaggaacatcagcggttgtgaggatcacatcagttggacgatggtctgtattcggcgaggtaatagaaggatctgttgtagtaggagaagcacctaagcaaatcagcattgtaccgcagaaagaacacagacagaatcaggtggaggaagctgattgttgtggcgccgactcttgtggcacctgtgcatgctctgacgtggtacaaaactgcgtccctgaacaatgtaagaatacgcccgatgcacaccagaccattgatgatgttaaccgtcaggaggcaatccagtctacgcttgtgaggagaaacgtagaggggtcaacgaaagcaagtgaaagcagtgctgtaacacgatcggtaggacaggaacagcaggtgaactttgtaactaggagagggttaaatgttgacacgattctgtggtgcggcttggccctgagctttgctgcaacggtagccctgcttgttctccttaccagcaagatttcatcgacatcctccaactaggttaggctgtggttgtaactcgtaacaatttgttcttgagcgtgttgctgatcaatttt

SEQ ID NO: 298 - DNA, 1531 bp, Setaria italica
aaaggatccgtagacctgcttgatccgaccgaccgaccggcggccatggctcccctgccccgcgcggcctgcctcctccgatccgccgccgggcggctgaggtcaccgcctccgccgccggcgcggctcttatccagcgccgcggggaccgggaccggggtgggggcgggagccgggcgcgaggccgcgatcgtcgccgccgccgtggcggtggccgggtccgggctcgggctgtggctgaagccgccctcgctcgccgactccggcgagaccgaggccggcggccagatctcggtcgccggcgccggcgccggcgccgcggaggcgaggggggagaagggtcggttcctgttcgcagactcattccgcagaagggtgttctttaactacgagaagaggatacggcttctcagcccacctgaaaagatctttgagtactttgcgtctgtgaggaaaccagaaggggaagtttgcatgttgcctgctgacttgatgagggcagtagtccctgttttccctccatcagagtcaactgtagtccgcgaagggcgattaaggggggaacggagccctggagagttgcattgtgctccatcgaaattcttcatgttgttcgacacaaatggcgatggcctcatctcctttgccgagtacatcttttttgtgacattgctcagcattcctgagtcaaatttcagtgtggctttcaaaatgtttgacgtcgaccacagtggggtgatcgacagagaagaatttaagaaaataatgtcactgatgcggtcttttaatagacaaggagcaacccataaggatggcttacgtattggacttaaagttggccagcctgtggaaaatggtggtgtggttgagttcttctttggtaatgatgggaatgaacctctacactatgataagttttcaaaatttttgaaggaattgcatgacgagattattcgtcttgagttcagtcattacgatgtcaagtcatcgaacacaataccagcaaaggattttgcattgtccatggttgcttctgctgacatgaatcacataaacatgctgcttgatagagttgatgatttggtcaatgatcctgatctgaaggacatgcgcatctcctttgaggagtttaaggcatttgctgatttgcgccgaagattggagccactgtcgatggccatcttcgcatatgggaaagtgaacgggttgttgacaaagcaggatctaaaacacgcggctcaacacgtttgcggggtcgacttaactgatagagtggtggacatcattttccatgtgttcgacacaaatcaggatgggaacctgagctcggaagagttcttaagagcgttacaaagacgagaaactgatattcgtcaaccaacaataccaggtcctttagggttcttgtcttgctggttcggtggtaggaagtcttcttcacttcgacagatggtgttctgattgggtccccctatgatccttgatgtaaatgtcatgtgcctttgattgtcatctcgtggtgggtaccttt

SEQ ID NO: 299 - DNA, 490 bp, Setaria italica
aagcttcctcctcccgtgcgccatggccggcggcaaccttttcgggcgggcgctgagctacgtcgtcaacgagttcctcgtcgagggcctcgccaacaaccgtgcattccagaggttcgctgtgaagaccaacagaactcttgagagcctatcgtctaaagctaaggaagtgagggaggagctatcggagcaactgaaggaagctcgtggtcaggacgatcacttcaggcggtgaagctggttcgcacattggttcaccaagatgatgctgaccgtgcaatcttttgctgtagttttcctagtacctgtctgggtcctatttattgatgtcattccattgatggagccgttctctggtatcctattttggatgtcactcaattgaaggaacctttgtatagtatcttcagtttctacgcacctgagtatcagacgcagagcagttgatgttcatgtcccttctctcttgtgctgtgaaatggaacactag

SEQ ID NO: 300 - DNA, 1026 bp, Setaria italica
gagatcctctgctactcacttgccgagccagctcaccctccaagctcgcacgagctcccagatcccaatttgtccccagcgcgcgcgcgggccgggggaggaggaggaggagagctcagatggcgatgtccgcggggccgctgctggccgccctactactgccggcgctcctgctctccgccgcctccgccgccgacagcacgaacaaccctgccgatcagctcgtgtcattggtcaacagcaaccgtactgccagcaaggcctcctctctttctgataatcaaggtctgggatgcattgctctgcaatacatcaaagcatatcaaggccaatgcagcgatgtgcgtgacaagaagcctccggagtccagtttcgccgagaaattcgccccggactgtggtgtccaagtggcaacgctctctaagatcaccgggaggctcgtggcttgccagtccaagtacccctctccacctgaggccttggacatcctggtcaacgacgccaaggaccttcaggtgctgcacagcaagaaccacacggagatcggggtggccgtgagcggcaccgacggcggtgggccgtacttctggtgcgtcctgttcagtggcgggaagcccgccaccagcttcaaggtggacggcgaagtgcccaagaccgccatgcacccgggatgcttcagtggcaacaacgacgactgcgcgggtccgagtccgacgaatggcgccgttccgaccatcgctggtgcgtcgaggctggtggcagcccttctttttgttatggcttgtgccttggctttgtgagcttgggtagggatgctgtttcccaccattcttttgctttgtgaggaaaggagcaggacaccctcctgttgcagtgttgcgccattcttttgcttgtttgagcagagcaggtgaactatgtaaggatctatatcattgttcagcatttgagactgtcggttacctgttcagaatgttcatcaaagtagttttgtgcacaatcttcagatgtttgctgggactgtaa

SEQ ID NO: 301 - DNA, 1041 bp, Setaria italica
gcctctcgagacttagagtatttcgcaaggatgtcctggtgcacgattgagtctgaccctggtgttttcaccgagttgatccagcaaatgcaagtgaaaggtgtgcaggtggaagagctttactctcttgatgtggactctcttagtgaactgcggccaatatatgggctaatttttctcttcaagtggatacctggggaaaaggatgaacgacctgttgtcagagatcctaatccaaaccttttctttgctcaccaagtgatcaataatgcatgtgctactcaagctattctctcagttctcatgaaccgcccagaaattgacataggtccagagttatctcaattgaaggaattcacaggagcttttacacctgatctgaagggcttagccatcggcaacagcgaatccattcggacagctcataacagttttgcaaggccagagccattcatttctgatgagcagagagccgcgactaaggatgatgatgtgtaccatttcataagctatttaccttttgaaggtgtgctctatgagctggatgggctgaaggaagggcctgtaaaccttgggcagtgcggtggtcttgatgacctcgattggctacagatggtgcagccagtcattcaagaaagaatcgagcgttattcacagagtgagattaggttcaatcttatggccatcataaagaataggaaggaggtgtacagtgccgagctggaggatctggagaagagaagggagcaaattttacaggagatgaacaagacttccgccacagaatctttgaacaactcgctcacagaggtgatatcagcaattgaaactgtcagcgagaagatcatcatggaagaagagaagttcaagaagtggaagacggagaacatccggaggaagcacaactacatccctttcctgttcaacttgttgaagatgcttgcagagaagcagcagctgaaacctctggtggagaaggccaagcagcaaaagtcgtcgagcccaagcacaagatgatggtgacatgccgtttgatgtatc

SEQ ID NO: 302 - DNA, 1687 bp, Setaria italica
aaaccccaaccatgtctgccgccgccgaacccgccgccgaccaaaaccctaagcctaaggacgccaagccccacgagcccactgccgaagccggagccgagttcgcggaggaagagtacgaagaggatggagaggagtacgaggaggaggaggaggaggagctggacgggcccgcggccgcggcggcggagcgggagcgggtgcagtccgtgttccggaggctgtcgtccgaccccgtgggcatccgcgtccacgacgtgatcatcaagggcaacaccaagacgcgggatgagctcatcgaggcggaggtcgccgacctgctccgcgccgcccccaccgtgcaggacctgctccgggccgccagcgtcgccaccggccggctgcacaggctcgacgtcttcgacgccgtcaagatcacgctcgacgcggggccacccgagctgcccggcaccaccaacgttgtcgtcgaggtcgtcgaggccgccaaccccctcaccggtaccgccggcgtatactcgaagcccgaggcaagatcttggtcgttggaagggtcacttaagttgaagaatccgttcggctatggtgacatctgggatgcatcaggttcctatggttgggaccaaacaacagaggttggagttggaatctacctaccaaggtttaaatcaataccaacaccgttgatggcccgggcatctttgtcatcacaagattggctgaagttttcatcatacaaggagcgtctacttggcctttcatttggcttgatttcaacaatgaaccatgacttgtcttacaaccttacgtggcgtaccttaactgatccgtcacgtgcctcatctaaggctataaggaggcagttagggcataaccttctttctgcattgaagtacacatacaagatcgatgagagggattcacttctcaggccaacaaaaggatatgcatttcagtcaacttctcaagttggtggtctatgggataacaagggcttgagattttttcggcaggagtttgatgttcgtggcgctgtgcctttgggattttataatgctgctctaaatgttggcgtcggagcgggtgtcattttaccacttggaagggggttcatgaattcgtcttcacctgtgcctgataggtttttccttggaggtcattcttctccagtttgcagcttgagcgggctgtcatccctgctgggttttaaaacaagaggagttggcccaacagaagcacggaggcttgtacccaatgaatcagacagtggctctgctccggctccaggaagggattacttgggaggtgatctggctgtgtctgcctttgctgacctttcttttgatctgccactgaagttattcagagatgctggaatccacggtcatgcatttctggctgctgggaaccttacgaaattgtcggagggcgagtacaagaatttctcagtatctgattttaagcgcacattcaggagctctgctggtgctggcattattttgcctactaaacttttccgggtggaggtgaattattgttacattctgaagcaagctgagcatgacagtggaaagaccggaatccagttcagcttctcctcacccatgtagaaacctgccatgaaatgttttgcagctgaagtagcttttcttccctcacccctgtagacttgcgttctccattgttcttt

SEQ ID NO: 303 - DNA, 1372 bp, Setaria italica
aaaggatccgcaccaaaaggagcatggcggcgccgtcgtcctccctcgcctcctcctcccacctctcccggcgcggcacggccacggccggcgccgcggccgtcgtcccgtcgtctcctctgcagccgcagccgcagctcctacggcacgcgtgctccgcccgccgcacgcagcgcgtccggtgcagctgggctggtggcagggcggcgtccaggcggcgcacgctaggtgtttgcttcgtggtctcacctagccagccagcaggtcttgctgcgatcgacgtgccggcggcgagcattcctaacacgacgaccatccccgagcgtatttcggtgtcctcgcttttggaggtcgtctcagacgatttgctcaagctcaataacaatctcaaatcgcttgttggtgcagagaatccagttttggtttctgcggctgaacaaatctttggtgccggtgggaagagattaagaccggcgttagtttttctggtgtctagagctactgctgaattagctggtttgtcggagctaactacagaacatcaacgcttggcagagattatagagatgattcacactgctagtttaatacatgatgatgtcatagatgacagtgggatgcgaagagggaaggaaactattcatcagctatatggtacacgggtggctgtacttgctggcgattttatgtttgcgcaatcttcttggtttcttgcaaacctagaaaacattgaagttataaagctgatcagtcaggtaatcaaggactttgcgagtggtgagataaaacaagcctccactctgtttgactgtgacatcacccttgacgattaccttctcaagagctactacaaaactgcatctctgatcgcagcaagcacaaggtcagccgccatattcagtggcgtcagcactgcaatttgtgaacaaatgtatgaatatggcaggaatcttgggctctccttccaggtagttgatgacatcctggacttcacccagtccgctgagcaacttggcaaaccagcaggaagtgacttggcaaagggaaatctgacggctccggtcatcttcgctttgcaagatgaaccagagctgagggagatcatcgattccgagttcagtgagacggattcgttagctgctgcgatagaccttgttcatagaagtggtggaataaggagggcacatgagcttgcgagagagaagggtgacttggctatccaaaatctgcagtgccttccgagaagcgacttccgaagtacccttgagaagatggtgaaatataatcttgaaaggattgagtaaatggatttactttaatgctccatcagatacagatctcctttgcatgggtttgaagtagcggtaccttt

SEQ ID NO: 304 - DNA, 1169 bp, Setaria italica
aaactcgagacgccatggtgatccctgccgccttctcctcctccctcgtagtccggtcggccgtcggcgtgttgctggcggccgccatcgcagcgcgcgcggtccgccggcgctccctggacgcctcgggcgggatcgccggcttcgtcgtcatggcggtccacatcgcctgcggctacaggtacggcgcggtgctgctggccttcttcttatcctcgtccaagctcaccaagatcggggaggaccgcaagcgccgtgtcgaggaggagtttaaggagggcggtcaacgcaactggatccaagtactagcaaatagcacaattgccactatactagttgtgatatttgaaataataactggagggcaagatcagtgcttggactcaaatggctcaaagattataactggtattatgggtggtattattggccactactgttgctgcaatggagatacttggtcgtctgaaattggtgtgcttagtaatgaacaaccacggcttattacaactctgaagcatgtcaggaagggtacaaatggtggagtgaccttacaaggacttcttgctgctaccggaggaggcctgctcattggtctcacattcattattgttggactgttgacagctgaatgttcttttgatgtggccctccagcagctcctagtactacccatctctgctgcggctggtttgcttggaagtctaattgattcattgctgggagctacacttcagttcagtggatactgcagtgttcggaagaaggtcgtcagcaaaagtggtcctactgttacaaagatttctgggatgactgtccttgacaatgatgctattaatgcagtatctatcctactaacaactatacttacagcttttgtgtgcatttacatcttttaaaaatgatttgtgaagtttcttcacttgtttctgatcttcgttctcatttacaaacacaaagggtctcagaataatagtgacatgagtatacctagccacatagggctgcttgatggcaaaatctgttcgccttgatgacttggagcaaaacttggtttgaatgctagtatgagttgaaaggtgttggttatgtaagcatacatgtctgtataatcatgaaactagacatagataatcttgaacagagcaatgtattgcaccgaattcttt

SEQ ID NO: 305 - DNA, 950 bp, Setaria italica
agtacaccactagcgcagcagcggttggccaccacccgacccgacgccggaggaggaggcggcggcgcggcgatggcggggaagcgcaacggctacgacgacgacaacgtcaaccccttcgcgggaggaagtgttccaccagccaccaattctcggctctcacctctatcgcatgaaccggctgatttctacaatgtagacattcctcttgattcaacaaaggatctgaagaaaaaggagaaagagctccaggctatggaggctgagctaaacaaaagagaaagggaattgaaaaggaaggaagaggcagcatcccgagctggcattgtgatagaagagaagaattggcctccccttttccctctcatccaccataacatttccaatgagatacctatccatttacaaaggacgcagtaccttgcattttcgtcatttttgggattgataggatgcctcttttttaatgtcatagcaactacaacagcatggattaaaggggaaggtgttatcatctggttgcttgccattatctacttcatatctggtgcacctggggcttatgtgttatggtatcgccctctttataatgcaatgagaactgagagtgctttgaagtttgggtggttttttctgttttacatgattcatatcatcttctgtgtgtgggcagctgtggctcctccgtttcctttcaaaggaaaatccttggctggaattttgccagcaattgatgtcataagcaagagtgctattgttgggatattttactttgttggatttggcttgttctgccttgaatcacttctgagcatcgctgtcattcagcaagtatacatgtacttccgtggaagtggaaaagccgcagagatgaaacgtgaggcggcacgtggtgctctaagttctgctttctgatgaacatacggctctgattacagccagttgatgga

SEQ ID NO: 306 - DNA, 739 bp, Setaria italica
aagaggagatctcgttggagccgaggcggaggcggaggaggagaagatggtgagctcttcgtcgccggtggtcaacgtgtacccgctcgccaactacacgttcggtaccaaggagcccaagatggagaaggacacctccgtcgccgaccgcctcgcccgcatgaaggtcaactacatgaaagaaggaatgcgcacaagtgtcgaagcaatcctattggttcaagagcacaaccacccccacatactgctcctgcaaattggaaatacattttgcaaactccctggtggacggttgaagcctggagaaaatgaaattgagggtctgaaaagaaagctgtgcagcaaacttgcagtgaactcgccctcctttccacctaactggcaggttggagagtgtgttgctgtgtggtggaggccaaactttgagactgtgatgtatccttactgccctccacatatcaccaagcccaaggagtgcaagaagcttttcattgttcacctttctgaaagagagtatttcgctgttccgaggaatttgaagctgcttgctgttccactctttgaactctatgacaatgttcagcgatacgggcctgtcatctccaccatcccacagcagctttctaggttccagttcaacatggttagctcttagggcaacaagacaggaagattagtgtggttgaggctgctcttttttcagacttatgttgagatggatcttgacgtgctgagctag

SEQ ID NO: 307 - DNA, 645 bp, Setaria italica
ctcagctgaacgtgaacagggcaggggccaggggaataggggatgctcccagcttaatcaagggtacccctgaatcgaatggggtctcttctcactaggaccggcgtcctgccatggctccagagcaagattgttgatcccgtgctgcaggtcatcagaaggggagcggaacccaagcaactggccttctctgctgcccttggagtcaccattggaatctttccaatatgtgggaccactgttattcttggtggcgttgctgtagcaatgttgggaagccgttgcaatgctgttactcttatggttctaaatttggccgccactcctattgagctaagtttgatcatccctttcctgcgtttgggagaagcagtcacgggcagcgggcacttccccttgacggccgacgcattgaagaacgtcctcaccggccatgcctcaaaggatgtgctgctgagcatagtccatgcgatgctaggttggctgattgccgcgccatttgtactgggcgtgttgtacaccgtctcggtcccgtgtttcaagatcctggcggataggtttggcggcatcccttcgagccccaggacgccgatcaaggcggtgtagctagtgtggcatgcccagtgctcctgaagctgtgtgtac

SEQ ID NO: 308 - DNA, 2303 bp, Setaria italica
agctagccgctagggtttccgcgaccgcgaccgcgagcccctcctcgccggcgatccggggcgcgatcccgcgcgggcgaaccgggtcccccggggggtggagcggagatgaagtcgtcgctgcggaagctgcggggcttcgctctgcagcggcacgagcagcgggtggaccgcgaccgcggccggggccactccaccgccgccgccgccaccgcggcggacgagctcctcgtggctgcccaggatatggcagatatgaggagctgttatgataacttactttctgttgccgcagcaattgcaaatagtgcatatgagttctctgaagcacttcaagaaatgggaacttgtttgcttaaaagggttacgccaaacaaggatggaataaatgataaggttttgctgttgctcgggaaatcacaatttgaacttcggaaacttgtagatagttatcgtgtgcatgttcttaataccatcaccactccatcacagtcccttcttaatgagcttcaaactgtggaggaaatgaagcgccagtgcgatgaaaagagagaattgtacgaattcatgctaaatgcgcagaaagaaaagggaagatctaagagtgctaaaggtgatacaggagcatcagagcaattgagacaagctcaggaagattaccaagaggaagcaactctttttctattccggttaaagtcattgaagcaaggacagttccgaagtcttttcacacaagctgctcggcatcatgctgcacagctaaatttgttcagaaaggggctcaagtcccttgaggctgtagagccacacgttaggcttgcggctgagcagcaacacattgatcatcagttcagtgcacttgaggaggaggattactttgttgaggatgaaaatgatgatgattacaatgacagccatgatggagagctgtcttttgattatggagaaaataaagaagctgaggaatctggtaatgctaccaggagtcatacagaggacttttttaatagaagcaaagaagagtattcttctgtaccacgtgaaagacagagaattgtcagtcagtcagcacctctttttcctgagaaaaagcttgagacagaagagaaaataaaagatttgcggcgttctgcaacaagaaagttaaatacttacgttttgcctactccaaatgatgttcgagctacttctcagatagtttcaggaaatcctactttgggacctctcgacagcagaggtcccctcccatctccgccccacacatctgcagatatgggagatttgagagacaataaactacctagtcctacaagattatctaatgcacagtctgtgctgaaagagagcaacaccaatactgcagaaacaaggaaaacactcccagtgggtgatatagccttaccaggctattatgacctgaaggcttctgataataaaaaggtgaagagagggtcattttctggcccaatagcttccagaccacggtccacagagaacattgatgttctttctgcagcgcccaggcacagctctgcgcatcagccaattcatattagagtatccccaggcaactcaccaccacctatttcctcaccaaaaataaaggagcttcatgagcttcctcgaccgcctgttaatacatcaaaaaatacagcatttcccagtttggttgcccactctgccccgttggtaccaaattctgcctcattggtacccaaagtccaagaccattttagggcaagacaaacaccaccaagtacagcatcacctttaccaacgccaccaacaccacctgggcctatagcccgcagtttttccataccttctaggaggacatcaggtatttcagatggtaaagagacagatgaacgtcaggataagggagctgccagaatgagcctttcttctcttccttcagcgcaaacattcttggaagatcgtgagccgttgtcagcagctgctgaatcagttagcaaaacatagggtatttggtgctgaggtggattattacattatcaaatctcgctgacgctgagccctcttcgtggaagaatgttgtacatactagcatgtgaactcagccagaatcgcaaagtagtcggtatttcgtgtgccctttggttaagatgtagtctgtgcaaataacgggtttgcggaaataaaatccccatttttctcaccgattgattgattgacgcgagatttgttgttgcccccctcattatttgctttgaagcaagttctgggcgcaccagttttctgcaagcttatgtaattatcacctggttccctcagcttatgta

SEQ ID NO: 309 - DNA, 1171 bp, Setaria italica
ctggctggacctggactcctcccacctcccgccgccaaccgccgccctccccaccggaatgccgggctgactgacggctgacgacaccccgacacgatttccggaggaggcgccgccgccgctgctctgggtggtgggtggatcctgcgaggcggagcgcggagccatggcgagcgacgtgcccatgagccccgagctcgagcaggtggacggcgagatccgggacatcttccgcgacctccaaaaggggttccagaagatggacaagatcaaggactccaacaggcagtccaagcagctggaggatctcaccggcaagatgagggagtgcaagcgattgatcaaagaatttgatcgcattctcaaagatgaggagaaaaagaacactcctgatgtcaacaaacagctaaatgataagaagcagttcatgatcaaagagttgaattcctatgtcaccttgaggaaaacgtaccaaagtagccttggtaataagaggatcgaattattcgacactggtaacgatcaagtggctgaggacacaccagttcaaatggcatcagaaatgtcaaatcaagaactcattagcgctggaaggaaacaaatggatcaaactgaccaagctattgagcgttcaaaaatggttgtagcacaaactgttgaagttggagctcagactgctgcaactctgacacagcaaacagaacaaatgaagagaattggcaatgagcttgactctgttcatttctccctgaagaaggctagtcaaatggtgaaagagattggtcgccaggttgcaactgacaaatgcattatggcgttcctgtttctgattgtatgcggtgttattgcaataattgttgtcaagattgtcaacccgcacaacaagagcctcagggacatcccgggcctggcgcctcctgctatgaacaggaagctgctctccatcgaccctttcggaggactctgagcattgcgaatggctcttgtgagccacataacacgatgtcacgattctttcctcgcttgtatattgtctcgttgtcggtgtttgcatcgatccattctttccccattggtgagtagtagctttgtgttcctagcggcagtcgtgttgtgtgtattactcgtgatcaccccccggctttctggttgtctgtgcatatagaggcct

SEQ ID NO: 310 - DNA, 434 bp, Setaria italica
caaaagccaccgcaagcagaagcccgcatcaacttgctccccaagaagaaacgagcggaagagctcctcgcggcgatggcgaagcgtctgatcccctcgctgaaccgggtgctggtggagaagctgctgcagcccaagaagagcgccggcggcatcctcctcccggagaccaccaagcagctgaatgctgctaaagtcatagctgttggtcctggtgatcgtgatagggatggcaagctgatccctgtatccctgaatgaaggtgacactgttctacttcctgagtatggtggaacagaagtgaagctcgctgagaaggagtaccttcttttcagagagcacgacatactgggaaagcttttggagtaacttcgggctgcaatgatcccaaggctgcagttgtttgcaagtagagatgcaggagtgtagcaaga

SEQ ID NO: 311 - DNA, 1709 bp, Setaria italica
gcgagtaatccacagattgaccgctcgatcgattgagagtgaagagattggttggtagttggtacttgcctactaggtgggggagagcgagggaaagcagggagattgatgcgtgcatggcgatgcgggcgcgggtgatggggctgggcggcggccggcgggagctgctggtctccgccgccttcacggcgctcctcgtcgcctccatcctcctcctcccgtcgctcctcctcacgggcgctggcgcgggccccaagagctggcctttcctctcatcgctggccgcctccgacggcgccgccggcgaggcgccgcggtacccggtctcgttcgcgtacctcatctcggcgtcctcgggggacgccggccgcgcggcgcggctgctggcggcgctgtaccacccggccaacagctacctgctgcacctggaccgggaggcccccgcggaggagcaccgccggctggcggagctcgtgtccgggcggggcgtgtacgcgaccgcgggcaacgtgtggatcgtcggcaggcccaatctcgtcacctaccggggccccaccatgctcaccaccacgctgcacgccgtcgcgctgctgctccgcctccgccgccgctgggactggttcgtcaacctcagcgcatccgactacccgctcgtcacccaggacgacatgatggaggcgttcgccgggctgccaagggacctcaacttcatccagcacaccagccacctcggctggaagataaagaagcgggcgcggccggtgatcctggacacggcgctgtacgaggacgggcgggcggagctcctccggccggagaacatttccaccaacctccggagattccccacggccttcaagctctacacagggtcggcgtggacgatgctgtcgcggccgttcgcggagtacgtgaccatgggttgggacaacctcccccggaccctcctcctctaccacgccaacatcatctcctcgccggagttctacttccagacggtggcctgcaactcgcggcggttccgcaacgcgaccgtgaaccacgacctgcacttcatccggtgggacaacccgccgaagcagcacccgctttacctcactgccagggactaccgccggatgctactcagcggcgtccccttcgcgcgcaagttcagggaaggcgacccggtgctggaccggatcgaccgggacatcctccggcggcgggaccccggccagttcgcctacggcgggtggtgctccgaggggggcgcggcgctctgcggcaacccgcaggagcctggcagggagggcgctgtcaaggccggcgccgggtcccggcggctcaaggcgctgctccgcaaggcgctgtctccaaagaatttcaggaagcagcagtgtagatgagatcactacacaattctatttttgcggtctctaattctgatcaaacatgtcatgtatagcaaaaggaacgacatgaattcgaggaggcaattttggttcagaagagagaagactcctgaaactctgaagtagagagagatagtgcagcctttacagaatgctagtttcaggaatgctaccagttatgggctgattattagcaatgaaaaggtcattagtttgacagagctaacattcagcttgtgtacttcactctcgtatcagcaaacaaactttacaactctgtgtacagggtagaactgcctgatgaagtacttggtg

SEQ ID NO: 312 - DNA, 3167 bp, Gossypium raimondii
gaagcgatcttagcttctcttgagacaatcataggtttcttttggcagaaagcagaaagactgaaacccttaccgaacatttttatcgtttttttttcttttcctcatcctatctgattttctgtctctggtaatagcaagaagacaatagaaaccaaccatggctgctggcaacaagttcgctagatttttgcataaacacaccagcaaaatcactgttattttagtctacgctgtgcttgaatggatcctcatcttcctccttttactcaactctttcttcacttacttgattactaagtttgccaattattttggccttaaacctccttgtccctggtgttctagagttgaccatgtcctggagcccaacaacaacaactcctcaaactcttacagggatcttgtctgtgacaaacatggttccgagatttccaaattgagttactgttcaagtcatgggaaactagcggaaacacatctgatgtgtgaggaatgcttggcttctaggccaacgcctagtgacggtaaatccattggaatggcaaggaggattgctttcatttcatgggtgagtggtgatcccaagcttgacaatggtgaaaaggttgtcccttgttcttgctgcaatggcaccaaacttcatcctccatatttcctattcaagcctagttggggtgctttggattgtgcagaaaaaggaagtttgataatacaagcaatcgaagatgatgatgataacgatggcagtgaaagcgatcagtgcaaagatggtgaggatatgattgagattaaactcaacaaccaagatgacgacgatgatgatgacgaccaaaacgatcaaagggctaaaactgagcatcaggtgctttttgaaaaagatgtacatgaagatgatagatcagacgccatcaatattgcagagaagcatttcagtagtgccacaagtggaatcgttgaaccttgttttgctggagattatatgctagacttcattaatctgcatcatcagaaatgtgtttcagatcgcttatttcctgttgaattaattgatttatcaacatctgcaagccatttctcagaaaagcaagataatggaagtgaaactagtgattcttctaatgaagagacaccattacatgctattgatgagattgcagagactattacctgtcccagggaggctgaaaacctggagctagatcatcaactagaaaagaatgatcttaatctaatggctgagcgaccaatttccgagaccaaattgttaagcactcaagactctgatctgcctctagttcaagtgtcagatccttcattgcaatgcttacgagaagatggcttttcaacatttaaggatcaagctaaaggtgttgatgctcctgaatcaagcaagactcaaattcttggttttacactaggtacacatgaagagaagagcacaatggatgagaacggagaaaggacaaacgcttctttatcggtttatacggattgtaacaacaacgaagcagaggaggaaaagttccctgacactccaacttcatcacaccaaggtatgcattacttgcataataaattgctattcttcgagaaaagagaatcgggtattgaggagtctttagataggagtgtagtaactgcgatggaaagtggtgatccggttcgaaccattgaaaggctgaaaacttccttaaaagctgaaagaaaggcattgagtgctttatatgcagagcttgaagaagagaggagtgcctctgcaattgctgcaaatcagacaatggccatgataacacggcttcaagaggagaaggcggcaatgcaaatggaagctttgcagtaccagaggatgatggaagaacagtctgaatatgaccaagaggcccttcaactactaaatgagcttatgatcaaacgagagaaggagaaggaagaactcgagaaagaattggaagtataccgaaagaaggttctctattatgaggccaaagaaaagacgaggataatgaggataagcaaagatggaagcttgggaagtgggaaatcttcggctgcttgtagctatgcggaggatagcgacgagctatccatagacctgaatcgtgaagccaaggatgaagatagcagcttctctggcaaccaagaaagcagcagtgatgcagttggtaacttggaagaaatggcactggattgtgtaaaccatgtaagtgcccttgatgaatcgttgacagaattcgaggaagagaggctgtccatcctggatcagcttaaggcattggaagataagttactaactatgggggatgatcaattcatggaggacttgaaatcaattcagaattcctttgatggtcttgatgagaagaatgacctgcgcagcaaagaaggtaatgaattttcaaaagaaacaagttgtggcaaaacaatggcttccatggcaaagagtctccttcctttcctggatgcagctgataacgggactgaagaaggaactatgtatggaaaacaaggagaatctgattctgaaccggtagtaatgcagacatatcctggtccagaactggagttggaccccaagaaacttgcaattgaagaggaggtggatcatgtttatgagaggctacaagcacttgaagaagacaaggaatttctcaagaactgcatgagttccataaagaaaggagacaaagggatggatctcctccaagaaatcctgcaacatctccgagatctgagagccgtcgaactccgaacaaggaccttgtgtggtgatgtgcaagggtgatcttaggcttgccatgcataaaaggaatcacctggacctagtaatttcatatatattcaagtgtctatagggaatatctccagattgatggggagattccttatcttccttccttttgggcttacaagaatgatgcaagttcccaaaataggaaggatctcctctttatctgccttatttacaaccaaaaaagaaagagtggaaaatgaaggaaaacataccatttacctgggttgttcatgtagggtaagtacctagtaacatgtttttcttatttgtttagatttcatttactcttttctccataaggtttggaggaagatttgacaggtgagggaagaaggctttatcgttttctctcttactgtttccatcagggaat

SEQ ID NO: 313 - DNA, 1020 bp, Zea mays
aaaggatccaagcgaacggacacgatggtggccttgaccgcggggatttccgtagccaccggcgtcgtgttcagccccgccggccgccggcgaggccgcggacacgccgcctttcgctgctcgtcgtcctctgccggagagaggcaggctctcttcagccgcatcgcccccgtctacgatcatctgaacgacgtgctcagcctgggacagcaccggacgtggaagcgcatatgcgtctcttggtcgagagcgaagatgggggatcgagttcttgatctctgctgcgggagcggggatttggcgttcctgctgtctcagaaggtcggcttagatggagaggtgatggctgtcgatttttcaagtcagcaactacagactgctgctggccgtcaggagcaacggtggaagctgtgttacaagaacatcaaatggatcgagggtgatgcacttgatttaccattcacagactgctacttcgatgctgtaacagttggctacggattgcgcaatgtggttgataaaccgaaagcgatgcaagaaatatatagggtcctgaaaccaggatcaagagcctctattcttgattttaacaagagctcgtcacttttcacagcaacattacagagttgggcgatagacaatgttgtggttcctttagctagtggctatggactaaccgaagaatacaagtacttgaaaagctccatatcacagtatctaacaggagaagagttggagaaactggccagagaagctgggttctgtgcagcgaagcactacgagcttggtggagggcttatggggaatctagtagcgactcgatgagtagaatgtagaacggaaactcgagttgcatggttcctctgcatcattttagctgattgtacgctcttcttctatgtatgagcctcggatgaggtcaatgacaagtgttgattccagaggggcctggacgtcttgattatcactgtcttctgtttgaacctgcgcttctgtagagcatcgacgttgggtaccttt

SEQ ID NO: 314 - DNA, 919 bp, Zea mays
gacttgggacttctcacattcccacaccgcactgtgccactgccgccggcccgccgcactagccgttgcttctcccttcccgttcccaaggagttgtcctcgccggcggatccggggcgccgctgcaagaggaggaaggaggaggagaggataccagaatggcgtcgcgctcggcgtccaaggatatcatcacgctgcgaggctctgccgccatcgtcagcgagttcttcgggtacgcggcgaatagcatcctctacaaccgcgctgtgtacccggaggagagcttcagcaaggtgaagaagtacgggcttaccatgctgctcacgcaggacgagggcgtgaagaacttcatcgccagcctcacctcccagctctcagaatggctggaggccgggaagctgcagcgtatcgtgctggtcataatgagcaaagccaccagcgaggtgctcgagcgctggaacttcaacatcgtcaccgacgccgaggtcgtcgagaagggggccatcaaggagaagagcgacaaggagatcatgagggagatccaggccatcatgcgccagatcgcgtcttgcatcacctacctcccctgcctcgacgagccatgcgtgttcgacgtgctggcctacacggacacggacgtcgacgctccgggcacctgggtcgagagtgacgccaagctcatcgacaacccgcagatggttaagctgcactccttcgacaccaagattcataaggtggacacgctggtgtcgtacaagaaggacgagtgggacgaggaggagtagagtttgcaccaaaagttaccctgctgctgctagagcttggcgtgaaggctgtgtgaatcgttcattcacgtctatcgtgtactgcactaatagtatactgctactttggggggaagaaaagtgtgagacgctcc

SEQ ID NO: 315 - DNA, 1052 bp, Zea mays
cctccatggcgcgcgtcctcccgctcgagactgccgagatggccagaggcgaagaggcagtggtagacatgccaaggtcatcagccggggcgtcatgcacagcagttgaccattctgagcagagcagaaaggatgatgaatatgagaggctggttacaagagctcaacatgcaacatctgatgttggcacgacaattttatctgagcaaccaaagtcaagatctttcatttggtggatgaaagttctgcttggctgcttccttcttatattagtgggctatgtcttcgtgaaatggggggtcccctttgtctttgagaaggttctcttgccaatcatgcaatgggaagccagtgcttttgggcgtccagtattagctattgttctcgttgcatctttggctctctttccagttattctagttccttctggaccttctatgtggttagcaggaatgatctttggatatggttggggtttcttgattataatggccgggagtactattggcatggtggttccatattggattggttcattgttccgtgaacgtctgcatgtatggctgacaaagtggcctcagcagatagcactaataaaactcgcgggtgaaggaaattggttccagcagtttcgggttgtcgcgcttttcagaatctcaccattcccatatacaatttttaattatgccgtgactgtgacagaaattaagttcaacccttatctatgtggttctgttgctggaatggtacctgaggccttcatttatatctacagtgggcgtttaatacgtacattggctgacatgaagtacggcaactataaaatgacaccagtggaaatagcatacaacgccatttccttcgtcatcgctatcgccctcacggtcgccttcacggtgtacgcgaagagagctctgggtgacataaaaagtccggacgatggcatcggtaaagacgaagaagatcacggcccaaatggctcaggggtgcgtatgaatcgtcgtcaggagcgtgccgacgcacgttacatagaactagatgatatgtgatga

SEQ ID NO: 316 - DNA, 680 bp, Zea mays
aaactcgagccttcaaatcccatggccgcactcggttcttctgtcacatccagaggcttggcactccatacctccgtgtgtgtggtttttcttcatcgtcgccacgggaatccagtgatcccggccgcaccgtctcgtccccagcgaagtcttgcgagtgggttaacaacgagttcttcaggcatgaacaatgccttccctattatcaaaggaactacacgaattcctgcggttggtcctggccctgcaaatccgccaggaggaaacctaccgatacccagcagcatgcctccgtgggccaagtgggtggccggggccgtcatacttgcgatacctatctacaggaggttcagaactttagaagagaagacggcagaggtggccatcgaggtggtcgacacggtggcggaggcggcggagaaggtcgccggcgaggtcgccggcgcgtttcccggcaacgacggtctcagggaagcggcctcgaagattaagacggtcgcggatgagatcgaggaagacgccgagaaagccgaggccctaatcgagaaggttgacgagatcaagaaagaggttgattcaattgtggatcctataatcgacaaggttgtcaaggacaaagaaatatagagacaggtggtgaactgaagatgtaaacatttgttgggctggtcaggcctttt

SEQ ID NO: 317 - DNA, 2189 bp, Zea mays
cgcggatggcgctactcctccggccgattcctccccctccccgcctccgcgcgctcctcggccgcctcctctccactggcgccagtctatttccctcccgcatgctccccgcgccccgctccaccgccgccgtccctcggctcctgtttgggcccagtgctgtggccgcggcagccacgcggcgcaatggggtccgggtgcgtgcgttcatggcgtcaacgacggcgtctgaggcgatgcacgagaagcaggtgtccgcggagtacactgctgccaatgtccaggtcctagaagcattagatggagttcgcacaaggcctggtatgtacattgggagcacaggaccacgcggcttgcatcatctggtttatgaaatcttggataatgctgtggatgaagctcaagcgggccatgcttcgaagattgatgtagttcttcatgatgacaattctgtcagtgtaacagacaacggccgtgggattcctactgatatgcacccccagacgaagaaatcttgtgtggagactgtcttaacattaatgcacgctggtggcaaatttggaggttcaaaaagtggttacagtgtctctggagggcttcatggtgttggcttatcagttgttaatgctttatcagagacacttgaagttactgtttggcgtgatgggaaggaacacagacaaagctattcgcgggggaaaccaaccactaggctaactagtagcacactgactggtgaaacaagctctcgtcaagggacgcgcatcagattttggcctgataaagatatatttaccaccacgatcgattttgacttcaatacaatctccagtcgcatacgggagcttgcctttctaaatcctgagctaacaataatcttgacaaaggaagaagggcacacagttcaacgcaacgaatattgttatgctggtggccttgttgaatatgttaaatggttgaatactgacaagaaacccctgcatgacccgattgcgttcagaaaggagttggatggtataacagtggatgtctcccttcaatggtcctctgattcctactctgatacagtgctaggatacgcaaacagtatccgcactattgatggtggtactcatattgatggtctaaaggcttcattgacgagaaccattaataaccttgcaaagaagtcgaagactattaaggataaggatattaccttgagtggggagcatgtaagagaaggaatgacatgcatcatttcagtgaaggtccctagtccagagtttgagggtcaaacaaagacaaggttgggaaatccagaagtacggagaatagttgagcagtctgttcaagaaaacttaacagagtacttagagcttcatccagatgttctggattcaatcctatcaaagtcccttaatgctctcaaggctgcgttggcagccaagcgtgctagggaactagtcaggacaaagagtgtgttgaaatcttcatcactccctgggaaacttgctgattgtgcatcagctaatcctgaagaatctgaaatctttattgtcgaaggtgattctgcgggcggtagtgcaaagcaaggacgggatagaagattccaggctattttgcctctaagaggtaaaattctcaacattgaaagaagggatgaagcagccatgtacaaaaatgaagagatccaaaaccttattcttgcacttggattaggagtgaagggtgaggattttaagaaggaggctctccggtatcataagatagttatacttactgacgctgatgttgatggagcacatatccggactctcctccttactttcttcttcagatatcaaagagcattatttgatgaaggttgcatctacgttggtgtacctcctctttacaaggttgagcgtggaaaactagcacattactgctatgatgatgccgacctcaaagagatagttaacaccttccctgcaaatgcatcatatcatatccagaggtttaaaggtttgggtgagatgatgcctgcacaattatgggaaacaacgatggatcctgagaggcggctgttgaagcagcttagggttgaagatgctgccgaggccaatgttgtgttctcgtcacttatgggcacccgggttgaatataggaaggaactgatccagaaagctgctagcatgatcaacatagatcaacttgacatttgatga

SEQ ID NO: 318 - DNA, 2200 bp, Zea mays
gtggttcctaagggcgaatctcgtggcgattcgctcagatttggatttagggtttaggaggcggtgctggtgatcggtttgtgccgccgggagagatgtcggcggctgtggcgtgcgcggagagggcgactaacgacatgctgatcggcccggattgggcggtcaacatcgagctctgcgacatcatcaacatggatcccggacaagcaaaggatacactcaaactcctaaagaaacgtcttgcaagcaagaatacgaaagtgcaaattctaacactttatgtgctagagactctaagcaaaaattgtggggatattgttcatcaacagattgttgagcgcgacatattgagtgaaatggttaagatagtaaagaaaaagccagacttgagcgtccgagagaagatattgagtttgattgacacatggcaagtggcttttggaggtccatctggaaaatatcgacagtatcatgcggcttaccaagaactcagggctgctggtgttgattttccgcctcgcgaggaaaattcagtcccgttgtttacaccacctcaaactcaaccattaagacatccacatctatatacacctccaggtcaaagctatgaagatgctgctatacaagcttctcttcagtctgcccctcctgcatctgccctcagtctgagtgagattcaaagcgctcgagggattgtggatgtgttagatgaaatgttaaatgctctggaccaccggcatcctgagggtgtaagggaggaggtcattgttgaccttgttggccagtgccgatcctatcaatctcgtgtcatggatcttgttaacagtactggcgacgagagccttttatttcaggctctaggactaaatgatgagttacagcgtgttgttcagcgtcatgatgacatagcaaaggggatccctcctggtactggagcacctttacctgcttctggaaatgtcaaccaagggactgccccacctaggcccactgcggtttcattttctccacttctaaatgtacatgaggacgatgaaccagaagacgagttctctgtgctttcccgcaggtctgcgagggatggtgcagtagcacagaacaatgtgccctctgctccaagaaatgagaggtcatacccaagcccacttcttcctccaccaccagcatctaagaggcctgtttataccgaggcaagcagtgttgactatcttagtggtgactcctacaagtcagagaaggtttcagatgatttcatcaacccaactgctccagctaacatatccacatcatcccattcaaaggcagaagcacatccacctccgagttatggtggcaggccagacagagtatctgacgacttcataaacccaactgcacctagcttctcggcgccttctcgtcctacaaatgaggagccagcccgcccatccgtgaagcggcaagagagcctacctgacgacgacttcataaacccaactgctcttcctggtttctcgtcgtcttcagctactaaggagtctggcgaggaccttccaaaggctccatgggaagcacaagctgccgcgggttccctaccgccgcctccggcgaggtacggccagagacagcagtacttcgagcagaacgtgtattctggcgggagcaacgaaggcggctacaatggactgacgacacagaccgaaggtctctcgctgaacccgcggagcagcgagaacgagaggagcgcggcacggccggcagcgtcccgccctgccaaacctgaggactcgctcttcaaggacctggtcgacttcgcaaagaccaagccttcgtccccgtcgaaaccggccaacagccgcaggacccgctagaacgactcgtgcgatgcatggatggacattgggtcgttcggatattcatttcacaggttagcggcttttagatggtaccatgaaataaggccgtctggagactggttttcattgcatatttgcattgcatgggaaattgttttggttgcgtttagagtggcagatgtcagaaacgttgcttgctcataatcctgggtgtgtgatgtctagttagctgctcctaaatttctgtgtcgttggcttccgattctcattttctttttctttcacttagctgtgtatatatatgttacccgattcgacagcaaatattcatagttgagtttgtgacttgaggaatgaggtgttcc

SEQ ID NO: 319 - DNA, 1004 bp, Zea mays
gaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctggcctccttcagctcgccgtcggtcatattcgagcagatctccgtcatcttcgcgctgcccaagctattcatcgcctcattcacgctcgtgctgccattcttccccacgggctcattcgagcgcgttgaggaggagggcgatgtcgccaccgcgttcaccctcgcgcgcattctctcgatgatccccaagtcgcgcggcgggcctaccagcgtcgtcatctacgacatccacgcgctccaggagaggttttacttcggggacgatgtcctgccatgcttcgagacagggatcccgctcctgctgcagcgcctccgccagctcccggacgcagaaaatatcaccattgcctttccagatgacggtgcgtggaagcggttccacaagctgttacagcactttccaatgatagtctgtaacaaggttcgggaaggtgacaagagaatagttcgtataaaggaaggactacctgaaggccgtcatgttgttattgttgatgatttagtgcaatctggggggactcttagagaatgccagaaagttctagctttgcatggcgctgcaaaagtcagtgcttatgtgactcatgctgtgttccctaagcagtcatatgaacgtttcatggcgtctagttctgctgggccaggcgaccaatttgcttacttctggatcacggactcatgcccacacacagtaaaagctattgggcaaagacctccatttgaggttctgagcctcgctggctctattgcagatgctcttcagatatgagcgtacactggttga

SEQ ID NO: 320 - DNA, 578 bp, Zea mays
gacgactttctagtctctctcctcccgcctccgagtccgacccgtccgagaaaacaaaacaaaccaaaagaagaaaagaaaggcgacgacgagggagggaaggctcgccgcgagatctgggggagctcccattcccaggatgcacgacttctgcttcaccatcccctacgggttcgccgtgctggccggcggcgtgctggggtacctccgccgcggcagcaccgcctccctggcggggggcgccggcgccggcgctctcctcctcctcgcgggcttcgtcagcctcaaggccttccagaagcgccgcaactcctacgtcgccctcgcgctcgagacgctttgtgcattagccttaacttccgttatggggcaaagattcctcgagacttcgaagattatgccagctggtgccgttgctggtctcagtgccatgatgtccgcattttatctgttcaaaattgcaacgggcggcaaccacatcccaccaccaaagaaagagtaaaccaggctttaacttgtaaattatgtttgattgatctcgaagaagactacgagcgattgtgttgtctagttgcatg

SEQ ID NO: 321 - DNA, 2283 bp, Zea mays
aagtggcgatcacaccaaactcacatacagatggagatggcagagaccttgcatgtattgcccgatgatgccaatggaagtgctgcagttcagactgagccttattgccatgaagacgccattgaggacatggaatctttcttggatgaagtaaacgacagggttcatgtttcaggaattgtgactggtgctatcatcaaggggatcctaagtgatgtgcggcaagaagctgctagccaaattgctctcaaggatgcagagatatcatcactgaaccagaagctgcagcagccagtaaatggcagcttgagtttatctgagggacgggataaaagacatgatgagttttatagtctccgccagcagcttgactccatttccaagttactgttgaattctgaatgggggctatcgggatcacagcataactttgaagattcagaaaatgccagcaagcagcaggacaaagaaaattcctctagaaatggtgtagcaaagaccattcatcctggagactctaaagaagaagtttttggtgatccgaaactcctggatcacatggataaggttgctttgatagcccatttcaataaatcgatgaatgagatgaaaaggcagcatgattcagttctgtaccagaggacggaagagatattcaaattgaagcgtgaaatcctgaagaaggatggatcaaacccttttcatttacgaaataacaaagaacttgagcaaacaaggaagaaaatagaggaagtcatctccaagttggatgtgctcctcctggagaataaaagaacctctgttcgagtcaagtcaaatgcaattcctggtcaacaagataagaacaatgtattaggttctgaaaccgagcaactagaaagtggtgcaagtaataatgaagactaccattgctctattccaactcactcttcgcattttgcatccagagaggcagatcatgaactgaatattgtaaggcctcaatttgacgttgaagatgtcagaattgcagtcacctttagagaagaaatagaaaggattataataaaagagttcattagtgaaataaacatagaattgcatggctatgagattgagggtgatatgaagcaggaagtttgctcaatagttcacaatgaggctattgctaaagcaatgtcaaacattgattccttgttgttgaagtacgaggagaaaaaaggacatgctgaagaggaatctctacataagcaaaagattgaaaaactgaaacttgttgtggattccttcactgaagtattgagtgaaaaggagaaatttgtatcacagattggattggaagcgatgcagactcgcgtggagtcaatgtgttgtgaacttgatttgttaagggacaaagtggcaaagcaagattcctacctatctgaaaagaacagggaatttggtgccattatgggcaggttggagcaagctcagcagcatgttcaacacaatgatgttaccttggttgagctgaatgatagacttagaaccatttcaaactctctaaaagacctagagaaacagaatcaagctctacattatgtcattgaagaaaaagagaagatgctaacatctgctgtttccaaagacaatgatatgagagaattcatggaaaatctcgttaaatctatcaaatattttgaaattgtcatgatgaatcagcaggctgttgtggcaaataaagtcgagcatcatgaatcaaggttctgtttattaaaagaacaatgtaaacaccttgcaaaagaaggcaatcttttaagaaagaaggccttacgatacaaagagatatctgatacaagaggctctaatcttcacaaagctgaacttgaggtggatttgcttggtgatgaggttgaggccttaacagatcttcttgcaaaaatctatactgcacttgatcactattctccggtccttcgacactacactggcgttatggagaccttgaacatgattaagaagcacattagcatggcgaagtaaaatgcttctggtcggcttgacattatagaaacgtaggcttgacagcaggcttccagtggtttgagataagtttgtagaagtgtaggtggcagcaagcttttgtttccgactcaaggactaggttgagtgggttgctcccttttgcaggcagagtagtggtcttggtagcttttgagcactttgtaaatgacccaaccgtagctattagttcttgtgcttggcttttgatgccatgggctttgccacctgctatgctgggttgcaaaggtgaactcttgt

SEQ ID NO: 322 - DNA, 811 bp, Zea mays
tagatcccaaacagtctcctgcccgcgcgcgtttggggtggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctggcaaggcatcttctgtttcggacaaccaaggtttgggatgcatcgctctgcagtacatcaaagcatacgaaggccattgtgaccaggtggacgacaagaagccgatggagtcaagcttcaccgacacgttcgccccgacctgtggcgtccaggccacaaccctctccaagatcaccggaaggctggtggcttgccagtcccagtacttggctccagctgaggccttcggcgtcttgttggtgaacgacgcgaagggcctccagatactgcgcagcaagaaccacacggaggtcggggcggctgtgagcggcaccgatggcggtggaccgtacttctggtgcgtcctgttcagtgacggcaagccgactaccagcttcaaggtggatggcgaagtgccgaaggcagccatccacccgggatgcttcagtggcaacaatgacgactgctcgggccccacaaatggcgccgttttgaccagtgctggtgcgctgaggctggtgacggccattctttttgctgtagctgctttgtgagcgtgtaagtaggtgtaatgttttctgccattattttgctttgtcaccatctcctgtctgtctgcagtggcacgctatata

SEQ ID NO: 323 - DNA, 1669 bp, Zea mays
gcttctctcttgtcttagctccaagagggcaaaactcgtcggggtagggaaatggcggaggtgaagccggaggagataagccatccgcccatggagcagctccaggggttcgagtactgcatcgactccaaccctccctggggcgaggcgatcatactgggcttccagcactacatactggcgctgggcacggcggtgatgatccccacggtgttggttcccatgatgggcggcgacgatggggacagggtcagggtggtgcagacgctgctgttcgtgacggggataaacacgctgctgcagtccctcttcgggacccggctgccgacggtcatcggcggctcctacgcgttcgtcatcccgataatggccatcatccaggacccgtcgctttctgggatacccgacggtcatgagaggttcctggagaccatgaaggccatacagggggcactgatagtgtcctccagcattcagatcattttgggctacagccagctgtggggtattttctccagattcttcagcccagtggggatgactccagtggttgcgctgctcggatttggcctcttcgaaagaggtttccctgtggttgggagatgcgttgagattggcctgccaatgctgatcctctttgtcgtgctgtctcagtatctgaagaacatacagataaaagaaatccccatactggaaaggttctcccttttcatctgtgtcgcgttggtatgggcgtacgctcagatcctcacttcaggtggagcctataagaacagcgccgaggtcacccagaacaactgccgcaccgacagagccaatctcatctcttctgccccatggattaagatcccctacccactgcaatggggtgcgccgaccttcaacgccggccagtcatttgggattgtgtctgctgttttggtctcgctggtagagtccacagcctcctacaaagccgctgctcgtcttgcgagtgcgactccacctccggctcacatcctcagcagaggcattgggtggcagggaatcggcatcctccttgacgggctctttggaacggggactggctccactgtctcagtggagaacgtcgggttgcttgggtcgacaaggatcgggagccgacgggtcatacagatctcagctggcttcatgatctttttctccatgctggggaaatttggagccttgttcgcttccatcccgttcaccatctttgcggccgtgtactgcgtcctgttcgggctagttgctgcggtggggctgtccttcctacagttcactaacatgaactccatgcgcaacctctttatcgtcggcgtctccatcttccttggcctgtccgtcccggaatactttttccgctacaccatggctgctcatcgtggtcctgcgcacacgaaagctggatggttcaacgactacatcaacaccatcttctcgtcgccgccgaccgtggggctgatggtggccgtgttcctggacaacacgctggaggtgaagcaagccggcatggaccgggggatgccgtggtggcagcggttccggacgttcaagggcgacagcaggaacgaggagttctaccgcctgccattcaacctcaaccgcttcttccctccggcctaaaagtcaagtcactcagactcagattgctgagcagaggcatagt

SEQ ID NO: 324 - DNA, 1769 bp, Zea mays
ccacgatgcgtcacctcctcctctcccgcttcctccgccgcggtggcggcagcggcatccccaacggccactaccaccacctccccctcctccgcgccctctcctcctccccctccccggtctcctcggacgcagagctccgcaagtacgcgggctacgcgctgcttcttctcggctgcggcgccgcgacctactactccttcccgttccccgccgacgcgctgcacaagaaggccgtgccattccggtacgcgccgctgccggaggacctccacgccgtctccaactggagcggcacgcacgaggtccacgcccgcgtcctgctccagccggactcgctcccggccctcgagggcgcgctcgccgccgcgcacaaggagcgccgcaagctcaggcccctcggctccggcctgtcccccaatgggatcgcgctctcccgcgctgggatggtcaacctcgcgctcatggacaaggtgctcgacgtcgacgccaagaagaagaccgtcacggtgcaggctgggatacgtgtcgcggagctcgtcgacgcgcttcgggaacatggcctcacgctgcagaactttgcgtccattcgggagcagcaggtcggagggttcactcaggttggtgcccatggcactggtgcaacattacctcctgttgatgagcaagtcattagcatgaaactggttacccctgccaaagggacaatagagctgtcgagggagaaggatcctgagttgttttatcttgctcgctgtggacttggtggcctaggtgttgttgcagaagttacccttcagtgcgtagaaagacaccagcttgtggaacacacatttgtttccaatgcagatgaagtcaagaaaaaccacaagaagtggctatccgaaaacaaacatattaagtacttgtggattccatatactgacacggttgttgttgtccaatgcaatcctccctcaaagtggataaccccaaagttggcatcaaaatatggaaaagatgaagctttacagcatgttcgggacctttatcgcgagtcactgaaaaaatatagaactgaaacagaaagtaaagacccagaaatagatacactttcatttactgagctgagggacaagctgcttgcccttgatcctctggataaagatcatgtggtgaaaatcaataaagcggaagctgagtattggaagaagtcagaagggtatcgcatgggctggagtgatgaaatactgggcttcgattgtggtgggcagcagtgggtttctgaaaactgcttccccactggaaccctagcaaagccaagtatgaaggatcttgattatatagataagctgctgcagttgattgaaaaggaggagatacccgcacctggacctatcgagcagcgttggactgcccgcagcaagagcccgatgagcccggcatcaagctctgaagaagatgatgtattttcatgggttggtattataatgtatctgccaacatctgatgctcgccaaaggaaggaaatcacagaggagttcttcagttacaggagcctggcgcgaagtctctgggatgattattccgcctatgaacactgggccaagatcgaggttccaaaagacaaggacgaacttgccgaactccaggcccggctgaggaagcgttttcctgtcgatgcatataacaaggcacgtatggagctggaccccaacaaggtgctctcaaacgccaagttggagaagatgttcccagtgttggagcctcctcaccagacaaagtaataa

SEQ ID NO: 325 - DNA, 1233 bp, Zea mays
aattccagacaccacacaggacacagcgcattcggctaatttcctcgtctctccccaatccgaccacccccatccattcactaacccgaaatagaaggccgtccccagccaccagcctccggagttcctccggcgatccccgtccccttgtgtgcgcgctccaggagggccttctgcctccagcttgcagagcccacctaattgctgcgagatggatagagggcagaacgggagggatgacgtcttcggacgcagggatccattttctgggtttggcttcggcccccacaggagcttgttttctggtctccttggggggagggatccatttgacgatccgttctttacccatccgttcgggggtcggatgatgggtgaccatgacatgtttgtacctagtccttttgggccgatgggagggccttttggggacatgaggaacggtgggtttatcgagcaagctcctcctaggggtaacagaagaaggcctgtgatcacagaggtcgaggaggatggtggagagaacgcagagcatggtaaccagcagcctaaccaagatccttatgttcaggagccagacgatgggattgatgagacagaaggtggccaagtcgagctgcacagggatctcagtagggctaatagtggagggcagccgcaggctcgtactttcacatatcagagctcttccgtgacgtttggtggtattaatggagcttactacaccacttcaaagtctcggcggactggtagtgacgggatcactgtggaagaaagcaaggaagctgatacaacaactaaagaggctactcatagaatctcccgtggaatccatgacaagggacattccctgacaaggaaactgaattcggatgggaaggttgacaccacacagacactgcacaacctgaatgaagatgaactagctggatttgagcaatcatggaaggggaatgctggacattacttgcctgactggaaccacaatgctggtgcacctaatagcgataattctggtgaccgtagctccaatggacgtgaccggcgaccggcctcaggctgggcgcttcctgggaccgagcaaggccgtgatccgaggcgcaacgggaagccaaaatcacgggtcatccctatctcctgaagagcatggacggagtagatatatagagtagataaataaacagctggtttgtactactatgcaaggtttaggttcaagatcgtttcaaggaa

SEQ ID NO: 326 - DNA, 697 bp, Zea mays
gacctgagcagtgccaatctcgccgcgggcttccactgctttgccctatgcactttacgccgccccccggactggaaaattgcttccccgcggacctccactccaacggtgcccgtatctcctttgtcctggctggatccgtataatctcctttgtcctccccctcccctcgttcccgtctccctcgcgttcctctcgaccgtacgccgccgcctggctcgcaccgtcgacagtacctcagtccagatcgaccctccctctacccagatcgggttccagttggcctaccgcccccgccgccctactacaggtgccgaggccttcaccggcgaagagcgcccgccagacaaatggaactgggtgataaggcggtcggttttctgctgactctgacaagcttaaccttatttacatactacacattctgggtcatcattttgccatttgtcgacagcgaccactttgtgcacaagtacttcctgcctcaagagtatgcgattttgataccggtactggccggcgtggttctcctttcgttcttgagcgtgtttgtgggccttgtgatgctcaaatcgaagaagaagaagacggcttaatcgggtttgccatgtacactgctgtgtcattcacttagtgtgatgaaatgcatgagttcgcagtatctaattgctagaagctcggttctgtaatcagttcc

SEQ ID NO: 327 - DNA, 916 bp, Zea mays
tactgctccttcctttgtcctctcctgcctcacgtctcacgccagcagaagcgccaaacaccagcagccgatggtgtcgacgagctcgactccgcaccctctggatccgtccgtcccggccgtcgtggggggcggcaaggaggaggaggaggaggcggtggagtcttgtgccgccgccgccgccacgcccttgccgccggttgggatcgacgacgaggaggagggcccccggagagtgcgcaagccctacaccatcaccaagtcgcgcgagagctggaccgaccccgagcacgacaagttcctcgaggcactgcagctctttgaccgtgactggaaaaagattgaagcatatgttggctccaagacagtaatacagattaggagtcacgcacagaagtactttttgaaggttcaaaagaatggaacaggtgagcatttgcccccacctaggccaaagcgaaaggctgcccatccatatccacacaagtcctcaaaaaaggcccttcaagttgtcttaccacaacaagtttcacacataatggagcaaggctgtggtacacctatggatgtagctactgttgctacagactctagtgtaaataatgcttttcctgttcaacatttcagtccgaggcatacacaagccatgccagactttgctcgtgtatacaacttcctgggaagcatatttgatccagagacaaatgggcatttgcagaagttgaaggaaatggatcccattgatgctgaaacggtaatgttgctgatgaaaaatctgtcaatcaacctaactagtccaaactttgaggagcataggaggttgctctcttcggatgcctcaagcatggatcaaaagtcgggctcttcccgggttcatctcccgttcatgataacgagcaagtgagagaagcagtga

SEQ ID NO: 328 - DNA, 552 bp, Zea mays
aattcctctctgccctagcaccagccatggcgaagccgcagcttcttctctgtttcctactcgccgcctccgcgccgctaatcgtcgccacggccaagaaatccggggacgtgtcggagctccagatcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattgggcactggacaagtgatcaaaggatgggatcagggtctcctgggaatgtgcgttggtgaaaagcggaagttgaagatcccatcaaagcttggctatgggcctcaaggctcgccacctactattcctggtggagcaaccctcatatttgacacggagcttgtcgctgtcaatggagaaccaaccaaccaatctgacgagctttagattcatcaaacaaatgaatccattcacctttttactcggaactcagcagatgtaatactttccaagaaatgagccttca

SEQ ID NO: 329 - DNA, 1538 bp, Zea mays
tgaaaatggatggaagtagtaaagggagtgggcattctgaagcattaaggaactacaacctgggaagaactttaggtatcggtacatttggaaaagtgaagattgcagagcataagcttactggacatagggttgctataaagatcatcaactgccgccaaatgagaaatatggaaatggaagagaaagcaaagagagaattcaagatattgaagttgttcattcacccccatatcattcggctttatgaggtcatatacacacctacagatatatatgttgtgatggaatattgtaagtatggcgagttatttgattacattgttgagaaaggcagattacaggaagatgaagctcgtcgaatcttccagcagatcatatctggcgtcgaatactgccatagaaacatggttgtccaccgtgacctaaagccggaaaacttgttacttgattcaaagtataatgtaaaacttgcggattttggtctgagcaatgtcatgcatgatggccattttctgaagactagctgtgggagtccgaactatgctgctccagaggtaatatctggtaaactatatgctggacctgaggtcgatgtatggagttgtggggtgattctttatgctcttctttgtggaactcttccatttgatgatgagaatattcccaatctgttcaaaaaaattaagggaggtatctacacacttccaagtcatttgtctgctttggccagggatttgatcccacgaatgcttgttgttgagcctatgaagagaatcacaattagggaaattcgggagcatcaatggttccagattcgccttccacgttacttggcagtgcctccaccagatacgacacaacaagccaaaatgattgatgaagatacacttcgagatgttgttaatatgggatttaacaagaaccatgtgtgtgaatcactgtgcagcagacttcaaaatgaggcaactgttgcatattatttactattggacaatcggtttagagcaactagtggctatcttggggcagattatcaagaatcaatggacaggaatttaaatcagctggcgtcatctgaatcatctagttctggtacgaggaattatgttccaggaagcagtgatcctcatagcagtggtttgcggccatattatcctgttgaaagaaaatgggcgcttggacttcagtctcgggcccaccctcgtgaaataatggttgaggtcttaaaagcacttcaagaattaaacgtcagatggaagaagaatgggcactacaacgtgaaatgcagatggtgcccagggtttcctgaagttaatgacacgttagatgccagcaacagctttcttggtgactctaccatcatggataatgatgatgctaatgggaggctacctactgtgatcaagtttgaattccagctttacaagacgaaggacgacaagtacctcctagatatgcagagagttactggacctcagctgctcttccttgacttctgtgcggccttccttaccaagcttagggttctatagtag

SEQ ID NO: 330 - DNA, 530 bp, Zea mays
aaaaaatgttatcttctacctccttagctgctcttctccatggccgcccccattatcctttccctccgtcgaaggcgcatcttttcctagctctccccaacaaccctacccgtttcctggcctcggcctccgtccgggtcgcctatcctccccggtggcctctccgcgccgccgacggggagcgggacaaccgcgtgcaggagctgagggtgcccgattcttggctgacgcctgcaggagcaacgcaggaatctgaatggctgagggagacactgcgcaagtggctcgacgacgagtactgcccggagccggccaacgtggacatcagcagcaccgccgcgcggtcgtatcgcgaatccctgatagcgcggcagtctgacctgggagagatcttgctgaggatggtgggcgacctggacaagctgtcgtacagggagagcttccacggccccttctcggccgccaacgctgcagtccgtttgatcgctcagaggatggaggagtcactgcctgatgaatgacggtggtaa

SEQ ID NO: 331 - DNA, 3798 bp, Zea mays
aaccctagtaccatcaccgactggcgacgcctcgccggcggccggcgagatgcacatcaaggaggtaactctcgaggggttcaagtcgtacgcgggacggactgtggtgccggggttcgacccgctgttcaacgccatcaccgggctcaacggttccggcaagtccaacatcctcgactccatctgcttcgtgctcggcatcacagatctccgtcaggtacgcgctgcctcgctccaggagctcgtctacaagcaaggccaggccggggtcaccaaggctaccgtgtccatcgtcttcgacaattccgaccgctcccgctccccgctcggctacgaggactccccggagatcactgtcacgcgccagattgttgttggtggaaggaacaaataccttatcaatggccatcttgcacaaccttcccgggtgcagacccttttccactcagtgcagcttaatgtaaacaatcctcattttctaattatgcaagggcgcataacaaaagtgctgaacatgaagcctccagaaattttgtcaatgttagaagaggcagcaggtacaagaatgtacgaaatgaagaaagaatctgctcttaagacacttgaaaagaagcagaataaagttgatgagattaataaactccttgatgttgaaatcctccctgcactagagaaacttagaaaagagcggtgtcaatacatgaaatgggccaatggcaatgctgaactggataggctcaaaagattttgtattgcctatgactttgttcaggctgagagagtgcgagatggcgcactgaatgatgtcaaacaaattaaaacaaagattgttgagctggatgaaactacagaaaacataaaagcagctatacaagaaatggacaataacatttctaccttggctgctgaaaaagaagctaaagtaggtggtgaaatgaaggttctgtcagacaaagtggataaactatcacatgtacttatcaaggaaacttctgtgatgaataatcaagaggaaaccctgaagtctgaggaaaagggtgctgagaagattctcacaaacattgaggacataaaaaggtctatactcgagagagatgctgctgtaaaaaatgtagagaatgaggcttctgacatgaaaagaagagcagaggatctcacaaaggagttggacgagaaggagaaagaataccagggtgtgctagcaggaaaaagcagtgcaaatgagaagaaatgccttgaagatcaactgagagatgcaaaagctgcagttggagatgcagaatctggactaaagcagctagctacaaaaataaagcattctgaaaaggagttgaaggagaagaaaactctattagtatccaagcgtgatgaggctattgctgctgagaatgagctgaaaacaaggacaaaagacttggaaggtatcaaggcatccatgggatctattaattatgatgagggtcagatggaagctttgcaaaaggaccgttctgcagagttagaaattattcaaaaattaaaggatcgtgttcgtaacctttctggtgagcttgctaatgttcacttcagttatcgagaccctgaaagaaattttgacagatcaaaagtcaaaggggttgttgcacgtcttattaggattaaggacagctcaacagcaacagcactggaggttgctgcaggtgggaggttattcaatgtggttgttgacactgaagaaactggaaagcaacttttaaaaaatggggatctacgaagtagagtaaccatcatacctttgaacaaaatccaaacttacatgatacctgacagagttcagcagacagctcgtagactggttggtcctgacaatgtaacattagctctagaattggttggatatggtgaggaagtaaagaatgccgtggcttttgtctttggctcaacatttgtgtgtcgtaatatggatgcggcaaaagaggttgcgtttaataggcaaattagcagtactagtgtgactcttgagggtgacacttatcagccaagtggtcttttgactggaggtagtaaagggggtagagggaacttgctaaggaaactcgacgaactagctaaagctgaggctgatctatctgatcatgagaaaaagctctttgtcattgaacagcagattggagcccttttaccattgcagaaaaggcacactgagttgaaatctcagtttgaactgaagtcatatgatctctcgctgtttcagaacagagttgagcaaaatgaacatcacaagttaggtgagctcgtaaagaaaattgaacaagagcttcaagaatctaaacaagagttgacagaaaagcaagtgcagcatgaaaaatgtgtgtccacagtttctgagttagagaaaactatcaaaacttatggcacggaacgagagggcaaactcaaagcgctggaaaaaagaatcaaatcaattaaatcagagatgcagtcgatgtcgaagcaactaaaggcttatgaaagtgacagggagaggctgatcatggagaaagatgcggttgttggtgagcttgctacactggaagagcagctaacgacttcaaaagctcagattacttctctgtctgaaaccttggaaaaacagaaggacaaggttacatccataaagcaagattatgatcaagctgaaagtgagctcaacgttgggcgttctaaactgaaggaatgtgactcacagataaaccgtatggccaaggaacagcagaaacttcaacagaagttaagtgattcaaatgttgagaggaagaaaatggaaaatgaggttaagaggatggagatagagcagaaggattgctcttcaatagtcgataagctagtcgagaaatataattggattgcaactgagaaacaattgtttgggaaaagtggtacagattatgattttgaatcttgtgaaccacataaagcccgagaggaacttgaaaatcttcaagctcaacaatccagtcttgagaagagggtcaataagaaagtaatggcaatgtttgagaaggcggaggatgagtacaatgatttgatgtcaaagaaaaacatcatcgagaatgacaaggcaaaaatcaagaaagtgatagaggagttggatgagaagaagaaggaaacattgaaggtcacttggctcaaagttaacaaggatttcgggtctatattcagtactcttttacctggtacaatggcaaaacttgatcctccagaaggtggtacttttttggatggtcttgaagttcgtgtggcatttgggacagtttggaagcagtctctgtctgaacttagtggaggacaacgatcccttcttgctcttagtcttatcctggctctgcttctttttaaacctgcaccactttacatattggacgaggttgatgctgctcttgatctgagccacactcaaaacattggtagaatgatcaaggctcattttccgcactctcagttcatagttgtctctttaaaagagggtatgttcaacaacgccaatgtgatatttcgaacaaaatttgttgatggtgtgtccaccgtgacacgaacagtgccttcgaaacagagatgaccagtttacacatcatgcatcttctgaaccaaaactaggcatataattccaaatctgtcattttaaggagctgctataatcaaacattttcgctgtttattcagccaggaaaattattccatgaaagctgaaccccacaattacttgacgctgatgcctcaagcccctcgcttgtcaggcaatgacatcaaaataggtgctgtaactgtaatctcatggcg

SEQ ID NO: 332 - DNA, 799 bp, Zea mays
gcgacaaaagcaaaacctagccgccgcggcgccgcccgccgacctgccgtgccgactgctgagtgccgaccgacgtgcgcccgctgtccgctcgacgttgttggcctccctcgacgccgctggcaggtggccgctcgacggagtcgacgcctcacagcctccctcgacgcgacgccgctggccactcgacggagtcggcgcctcacagtcacagtgagatgtcagaatacaagaacgtcgttggggggaggctaaagctgaagggtaaggcactggacgtgaaggaaggtggagtcaagaagaaaaagaagaagcatcaactcgaagagtcgtctcagattgagcacgatgagctccacaaagggggagactctggcttaccaactgatcacaacaatgagcttattgaagctggcaaggtgggagatgaagaagggaatccacatcccgactatgaccatctgacaccggcggagcgacgctatatagaacagaagcggaagatcgacatgcaaaagctggccaaagttgccaacaagtcacacagggaccgcatccaggacttcaaccagtatttggcgaacctcagcgagcactatgacatccctaaagttggccctggctaacatacatagccaaactgttgtgtaggcacaaacaattgtatgctaggtgggcttcaaggacattaaaaataaataaataaatgtatgtttggtctatccagctttttgttagtatgttatgtatgattttatatttgttgtataatgacatggtcgattcatgccgtcaactg

SEQ ID NO: 333 - DNA, 592 bp, Zea mays
accttgcaggattatcgatctgattgcggcatgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctataggagatatgctggactgtttttttcaatatgtgtggacataactgataatgaattggcatacttggaatgcattcacttgtttgtcgagatattggaccatttctttagcaatgtttgtgagctcgatttagtgtttaattttcacaaggtttacctgatactagatgaatttattcttgctggggagctgcaagaaacaagcaaaaaggcaataattgagcgaatgggtgaactggagaagctggaatgacgaagaccaggaagatgctgccgcgtgtgttgtattccaatttgtattattcgtttcaggtgttttacatttgctctcctggttcgttccggctgacagcgtgatgcccatgctgtcactcgaaagaatggta

SEQ ID NO: 334 - DNA, 1108 bp, Zea mays
catcaccggttccgttcgaatgggccgcaagggacgcaaggctagggtttcgcgcgacgccgacgtcgacggcagcgaggatgagatggccgccgctcctgccgccgctgcgggcaggagcctctacgagatcttgggagttgagaagactgcttcacaacaagaaataaagaaggcatatcacaaattggctctgcgcctccatccagataagaatcctggggatgaggaagcgaaagagaagtttcagcagctgcagaaggttatatccattcttggagatgcagagaaaagagctttatatgatgagactggcattactgatgatgatgcactggtgggagaagctgcaaatgatcttcaggagtacttcagaacaatgtacaagaaggtcactgaggctgacattgaagaatttgaagctaaatacagagggtcagattctgagaaaacggacttgaaggaactctacacaaaatataagggcaacatgaacaggcttttctgcacaatgatttgctcagaaccaaagcttgattcccaccgcttcaaggatataatcgatggggcgattgctgaaggtgagctgaagtcaactaaggcgtatgagaaatggtctaaaaagatttcggagatggagccaccaacaaatccattagagaggagagcgaagagtaggaagaaaagtgaggagaacgatctgatcctggccatctcacagcgcagggctgagcggaaaaaccagttcaactccatcctctcgaacatcatgtccaagtgtgattccaaggcaagcagttctgagcccacagaagaggagtttgagctggcgcgacagaggctggagagcaaaatggccaagaggcgcaaatgatgcctgctgccagccttctttccctatgcgtctatgccgaacatcgtcttaagctttgggtgtgatctgattttaccagcacgcaagtgatggttgtgagagctagcttgagcgtgtcaggatctgtatcatatctcgtgtcctctgggacagtaggtcgtgtggttatcgccttgccgagagggaagctttctctgaacttcaataccatggatacgtgggtaatggctatgc

SEQ ID NO: 335 - DNA, 1172 bp, Zea mays
gaagaacagccttgatttggtgccccaagtgatgtagtgtgagaggctaacttcttgagagcgcgatgagcagccagggattcggtgcggggagccccaagtccttccgctaccccagaggcggcgacttcgatctcgagtccgggtccccccgcaagggccgcaagcccaagaaccctcacctcgagacctcgatcgtcatgaggatccgctatttctacgaggcgcaccccgtggccgtcgccctcatcctcctctccttcgggctcagcgtgctcatcctcctctccgtgtacgagacccggttcaggacgatgaggagcgtcagtgcgtggtccagtgacggtggggattatccattgccaatgctccggaaccttgtcatggtggctgggcattcgatctatacgagctcaagatgcggggagaccgagagtgagaattcctggttcttggagccgtaccagaagcacgctggacaggcggccaccttcctggctcacatcaaggagggggtggggatcgcggcgagggatgagggggcactcctgttgttcagcggcggggagacgaggagagatgctggcccgaggagtgaggcacagagctactgggctattgccgagtcgaaaggatggttcggaaatgatgagggtgtaagaagccgagcactcaccgaggagcatgcacgagatagttttgaaaacctcctatttagtgtgtgtcgtttcagagagctaactggaagatacccacagaacataactgttgttagctacgatttcaaggaggaacgttttgcacaactgcacagaaccgcactcggattcccggaaggaaggttcttcttctcaggtacaccagctacgccttccgcaagggaggctgctctgaaaggcgaagcagctgtccgagctcagttccttgaagacccgtatggatgtctaggatctcttcatgtaaagaggctgaagcgggacccgttccaccgaaccattccataccctgccggttgcccagagctgaagggtctgttctcctattgtggccctgtgccttactctgggcacctcccttggactgagtagtagtgtaatgtacatcagccttggatggagctccccactgccacttcacgatgtccagcagccttgcactgaccttgttctgaa

SEQ ID NO: 336 - DNA, 401 bp, Zea mays
agagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttag

SEQ ID NO: 337 - DNA, 1232 bp, Zea mays
tcgctagtcacctaccggctaccgcaccgccgccgccgccgcgcccatctcgcacgcgcagcacaggacgcgcgcgatcccctcgcgtccggatcgccatggcctccacggcgttcgccgccgccaagtacttccccgcgcacctcgactcctccccgcgcatcgcgccccgccgcgccgcgcccaccgcgagcctctccttctccccgctctccgccagcccgtcgtccctgctccgcctccggaccccctgcccgtccggcccggggggcaggctgcctccgccgccgccgccgccgccgcgatcgtacggcggcggcggcggatctggtggcgacgccgcgaactccggcggcggccgccgcggcgggggcatcctcgggctcttcctcgccgggtgggccgcccgcgtcgccgcggacccgcagttccctttcaaggtgctcatggaggagctcgtcggcgtcaccgcatgcgtgctgggcgacatggcctcccgccccaacttcggcctcaacgagctggacttcgtcttctccactctcgtcgtcggctccatcctcaacttcgtcctcatgtacctcctcgcccccaccgccgccgcgtcgtccgccgcctccgcgctccccagccacatgttcgagcccggcgccttctcgctcggctcccgcgtcgccacgctcgtgtccaagggcgccaccttcgcggtggtcggcttcgcagccgggctcgcgggaaccgcgctctccaacggccttatggcgatgcggaagcgcatggacccggcgttcgagacgcccaacaagccgccgcccacgctgctcaacgcggccacctgggcgctccacatggccggcagcagcaacctgcggtaccagacgctgaatggggtcgagtacatgctcggcaaggtcgcaccggcgccggtgttcaaggcgtccgtcgttgttctccgctgcttgaacaacgtgcttggtggggtgtccttcgtgctgcttgctaggttgactggggcgcaaaaatcagataagccggcgacggtcgcggaagagaaggataggttgatagctgtgggcaatgctgcagcagatgccatcggtgaggcgagagatggagaggagggtaagtaagtggtagaggagaggaacagtaagatgatggtgcatcgtcccacgctcttttgcaagaaacctgtagagttggttggaatggaataaggagtgaggctcaac

SEQ ID NO: 338 - DNA, 2442 bp, Zea mays
aaaggatccggtggagttcttgcctttctcgccgcttccgactctgccatgccaccatagatccagctagggcgttcaatcctgtgcgagagtacgcgaaatcgccgccggattgatattgaccaggggtttctccgcccaactgaggtttcgctgccatttgcagggaccgtgctccagttcggcctttcgggggaaaaggaatcgtatctgctgaatccccgggctccggggatggatcttgacatggacggctacgtagacccctacgaggaggccgcggccgagggcgactccgacgaccctgacgaggacgactcggatgcggagagcgactacgaggagaagtcgttcggcctcctcaagtccggcaagcaccgggtgcgcaacccggacggcaccttccgctgccccttctgcctcggcaagaagaagcagggttacaagatcaaggacctcctccagcatgccgacggcatcggcgtctccagcaagcaccgacgtcacggccgcgaacgcgcgaaccaccgcgcctttgcacgctttgtccgcaccgatccgtcctttgcggaagacctcgtcggtataactggcattcaaggtgccattacaactacccctgctaatgagaactacagcgccaatggcaacgggaaggccaaggctaatgtagatactgctggttccagttctgtggcggcaaaagtgggtccgccacaggaggttgagaggtttgcttggccgtgggcttgtgttcttgcagctggggcaggctttaatgctgaggactttgttggtagagtagcattgttcagttcggttgaggttgtgcctttgtttgtcgatgagatggaagtcacagaaaccttcgcaattgtgaggtttaccaatgattggagtggattcaatgatgcacttacgatagagaactatttcagcgtcaataagcttggtaagaaggaatttcagatgagagatagtggtcttggttccgtggagggagatggcgaaggcgatgtcaaggtttatgggtgggttgcccgagctgaggactacgatgcaacgactgtggtaggaagattcttgagaaagcacactgtcctgcaaacaatagacgaggtttccaagactgaattagagaaatcaggggagatggtggcgatactggcatcccagatcgaggaaaagaaccgatacttgcaggatttggagacaaagaagaatgcgacagaactctccatctcaaggcttgaggaggacaacaggaaacttcatgaggcatacaatgaagaaatgcgcaatcttcatcgcagggctcgtgaaaatgcgctacggattttccaagagaatgaaaacttgaggattgacttagaaaataagaggagagaactgaacttacgagctaaggagcttgaaaaaatgtcagctgagaatgctaacgacaggaagacactcgatgatcagaagcagaagacaaagtatgataatagtgaacttgagctagctagcatagagcaacagagggctgatgcagatgttctgaagctattggctgaccaagagagggaaaaggaagatgtacttgctagaatgcttcagctggaaaaagagctgcatgagaagcaacagcttgagctcgaagtagaacggttgaatggtacactccaagtgatgaaacatctagagggagacgatgacgggggagatatccatgaaaagatggagaagctgagtgaaagatttgagcgggaaaagaagcgcctggaggatttgagtggtgatctggtgacaaaagagcgtgaaagtaatgatgagctacaacaagcccgaaaagaattgataaagggtttggaggaagagctaaatggacggacagctgttgggatcaaaagaatgggggaactcgatgaaaagcctttcctaaatgcatgtaagagaaaatatgggaacagtgaataccaggtcaaagcagcagagctggtcacaaattggcaggaggaactaaagaatccatcctggtatccttttaagatgattcatgttgacggagaagacaaggaaattctggttgacgatgatacgaaactgaagtttctgtggattgagtttggcgatgacgtgtgtaatgcggtgaagaccgcattgatggagataaacgagtataacccaagtgggaggtatgttgtgcccgagctgtggaacttcaggaaaggcaggaaggcgacgatgaaggaggtgctcaagtacctgttcagtcagatggacacgacgaccaagcgcaggaggggctgagtaggtgcccttggccatgccgtgaagcccagtcgttcgctgctcgatcccgtagtgccagtctgtcagagatgcctcctctttgtttactgtatagtgacatctgacgtaatgttcaggcttgggtatggtttgagctaaggtaccttt

SEQ ID NO: 339 - DNA, 1927 bp, Zea mays
agctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggcgtacgcgtcgctctggcgctacgcggaggcgctagatgacgccaagcggaccgtggcgctgaagccggactgggccaagggctactcccgcctcggcgccgcgcaccttggcctcggtgacgcgcccaaggccgtcgaggcctacgagaaagggcttgcgctcgagccgtccaatgaggcgctcaaatccggcctcgcacaggcgcgccagtccgcatcggcgccgagacgtccggtgggctccggggctgacgccgttggcaagatgttccagggccctgagctatggagcaaggtcgcggccgatcccaccacgcgtggctacctcgaccagccggacttcgtgcagatgctgcgggaggtgcagcgaaaccccggcagactgaacagctacctttctgaccaacgaatggttcaggtgctcaccctcatgctgaacatcaagttccagaaccagagcagtggggcgcctgacccggcagcagcacaatcgaacccgccgccaccaaagcagcagccagaggcgaaggcaagagaaccagagccggacccggagcccgagcctatggaggtgacagaggaggataaggagcagaaggagaggaaagcgtcggcgcagaaggagaaggaagcaggcaacgccgcttacaaaaggaaggattttgataccgcgatccagcactacacagaagccatggagctcgatgacgaggatatctcctacatcaccaatcgtgctgctgtttaccttgagatgggaaagtatgatgaatgcattaaggactgtgataaggctgtcgagagaggaagggaactgcatgctgatttcaagatgatctcaagggcacttaccagaaaaggaactgctcttgccaaacttgctaaatcatcgcaagactatgatgctgccattgagattttccagaaggcgttaactgagcaccggaacccagatacactgaaaaaactaaatgatgcagaacgagcaaagaaggagctggagcaacaagagtactatgacccaagaattgctgacgaggagcgagaaaaaggtaatgagttctttaagcagcagaaatatccagaagcagtgaaacattacaccgaagctctcaggagaaaccccaaggaccccagggtatacagcaatagggctgcctgttacaccaagctaggggcccttcctgaaggtctgaaagatgctgagaagtgcattgagctagatcccacattctccaagggatacacaaggaaaggtgctatccagtttttcatgaaagaatatgacaaagcgctggaaacttatcaagctggcctaaagcatgacccgaaaaaccaggagttacttgatggtgtaaggaggtgtgttgaacagatcaacaaggcgagcagaggcgaactcagtgaggaggaactgaaagagagacagaacaaagccatgcaagaccctgagatccagaacatcctgactgatccgatcatgcagcaggttttgacggatctgcaggagaaccctcgggctgcgcaggcgcacctcaagaaccccggagtgatgcagaagatccagaagctcgtcagcgcagggatagttcagatgaagtagacggtggctggaatgtccgggttcagatctgggacctgtgctggaaatgctgtgaacttgatcattgtttcgcattttggaaactgaacccttttgtgcgaccatagtttggtcatggctgttaatga

SEQ ID NO: 340 - DNA, 902 bp, Zea mays
tcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggcccgcctcaagaccttcgcccacggcacgcagaccctcactaaacttcgctttacaaggaatgattttactgaggatgataaagcggcgttcaaaaaagtgcttcaggaagatggcttttatacaattaggctgccatctaatgtgttggacactacaaagaaacatcatgttgtttcttcaatcagagctagatgcattccacgtgacagtttggatgaacacattgttatccacatggatggtgtaaatatcttggcagtcaattatggctctgttgatgggtgccaataccctaggcctatgaaattgccatcaaaatggacattcagctcttacactatcctaaagactgctgaacaggcaccaagaaccccatcgtttgcagatcagttaatagaagctgacaatggtcttggcgaagtaatgaaaccacctgagaaatctttctgggctaaatattggatgtacatcattccgcttggtcttattgtcatgaatgctgttacggcagctgccaacataccagaggaagctgcagggcagggccaacctggagcacaacgggcacctgctgctgttgctgggaggaggagatgatga

SEQ ID NO: 341 - DNA, 1117 bp, Zea mays
aagctctcttcattggttcatagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgagccaggcggccagcaagtacatgcagaggatctaccctctaggcatgcagaggagcagctccagcctcacattgtcgtcgctctcgctgtcgcagaactccaacgactcctccatcagcagctccaacgccagctgggagcccaaggtgccgctgctctacgccggcaccttcagcccctggggcgacgtcatggtgtctcgggagatgaggcgggaggacgacgacaaggtcagtgaccatgacgtcgaaggaggcgaggaggacttggactgcagtgagccggggagcctgcgtaggtgcagctggatcaccaagaacagtgacgaggcgtacgtccagttccacgacgagtgctggggcgtccctgtgtacagcgacaaccggctgttcgagcttctgtcgctgtcagggatgctgatcgaccacaactggacggagatactgaagcggcgggacatgtacagggaggcgttcgccgacttcgaccccagcgcggtggcgcggatggaggaggaggacgtggcggagatcagcggcgacagggagctgaggatcgccgagtgcagggtccggtgcatcgtggagaacgccaggtgcatccagagggtggccagggagttcggctccttcagcggctacatgtggggccacgtgaaccaccggccggtggtgggcaagtaccgccaccacaagtacatcccgttccggacgcccaagtcggaggcggtgagcaaggacctcgtccgccggggcttccgcctcgtcggccccgtcatcgtctactctttcatgcaggccgccggcatggccatcgaccacctcgtcgactgcttccgcttccacgactgcgtccgcctcgccgagcgctcctggggcatcaccaacgtcgccgcgtaggcgtagccagccgggccctcaatatctgtgcatgcatg

SEQ ID NO: 342 - DNA, 1956 bp, Zea mays
ctacgcctcccgtagacaacagttgcgccctgctctccggcaagctatggccaagctgagctgcttccccgctctgctccccggcaagaggaagaagaagacacgcaagatcaccgatgctatcaaggccagcggcaacgagtgccccaaggtgaagccggtcgaagtcgaactcatcgacccgacgcttggtgcaggcgtcgtccaggacgtcgtccccgccgagctctcggtccccgtggaggaccgcaacaataaggaagcggctgatcaactggtgttggtgaaggagagcgatctgtcagatttcgacttcagcttccacgcggccatgaagcccgtccggtccgacagtgacgtggcactggacacctcggccgacgctgcggtggcggacacatcgccgaagctgaagcggtcttgctccaacatcgagactaagcgaccaggctcgcgttccgcgcccgagatgccggcccggtcgcgctcctacggcgatctgggcaacctggtcgccggcctcgccctggacgcgacggcgaccccgcacggcgcgccggaggccagtccggcgtccgtgaagacgtcgcgcactgccgaccgcgtgatgctgaagaagcggtcgtccagccaggtgctgccctcgcgcagccggaagctctggtggcggctcttcctctggagccaccgcaacctgcacatgccgcggtcggcgcgcacggcccaccgatcgttctcgcctggccgccacgacgggtacacctcggacacgttcgaggagggcccggccgccgaccgcaagaacaagacggtcatggtcgacgagtcgccgccagcagcgtctgtgcccaaccagtgggtcgccttctgcgccgagagctccatccacgaccgcgtcagcgcgtgggtcagcagcatcgaaagcgagcctccgttcgatatcgccgaggaggatgacgacaactacgacggagaggacgatgaggagaatggcgagtgtgcggcgtcgcagccgcgccatctcgagctcggggagccatcgtccgggaagggcggaaacagcaaatccaagcgctgcgcaacgacggccgacgaggtcgtccaggccaacaccgtggtgcagtccctgaacgccttctcgtcggtggcgcacatctcagggatgggcctcaaggtggtgccgatgatcgcgcccttctcaaccctccgggccgtcaacctctccagcaacctcatcgttcatatctcccctggatcgctgcccaagggcctccactctcttgatctgtccaggaacaagattgccagcgtcgagggcctccgggagctcacaaagctacgcgtgctcaacctcagctacaacaggatttcgcggattgggcatggtctgtcgaactgcacggccatccgggagctgtacctggcgggcaacaagatcagcgacgtggagggtctgcaccggctgctgaagctggcggtgctggacctgagcttcaacaagattacgacggccaaggcgctggggcagctggtggccaactaccactccctcctggcgctcaacctcgtaggcaacccggtgcaggccaacatcggcgacgacgccctgcgccgggcggtcacgggcctcctcccgagccttgcctacctcaacaagcagcccgtgaagccgcagcgcatcgcgcgggaggtggccacggacagcatcgcgcgcgccgcgctcagcggctcggacagccggagcatccggaagaggacgtcgcggcggctcacgcagagcccccgctcgtcgtcgttgaccagggcccgtggcggcggcggcggcggttcacccacaccaagaaacacctctcgtcgtcgttgaccagaagaaccaactgcgtgattcgcgttgctctttggagacgggagacggtggcgtgactgcgtgcaggcagactcagacgacaccatgat

SEQ ID NO: 343 - DNA, 549 bp, Zea mays
atctcttgggtcatcctctacgcgagcgggccgcttctcccatccagccgcgcgcggcgtcgccggaaccggagaagggaggggaaggagcgcgagatggacaaggccaataagctcagcaccggagcgggggagaaggcgaccaagagcaggagccacgggtccacggcgctgttcgtcgcggtggactacgcgttcctgctcgtcttcgccggcttcctcgcctacctcgtcgggtcgcggatcctcccctccgccgccggctccgcctagaccggcccgcgttcgtggatctctcttctttcttccacgtttttttggagtcgatggctgcgggagcaccgggatcttgccgggtggttctcgtctcgatctgatgccgctcccgcgatgtaatctggcgacaatttgacgagaagagaagtagcggcgtgtttcttggcaactcgcctggtaatgtgacgcatctttccttattctgttgctattgctactagtactatccctgctcgtgtcgtgtgtgctgagagtctgagattgcttgggact

SEQ ID NO: 344 - DNA, 480 bp, Zea mays
aaactcttactcgcggagctgcagccaggggggcgaccggtgtgtgaaccgctgccgctatggctgctgcttccgttccgccaacatcttcatccggcggctgggacttcacctgtaaccttgaagtcgattatgggtctgaagaaaatgcatccatagtctacagaacgttagcagttgacaaggagttgcagcctgacaaggtgaagagggagatgactctatcaggcagcaagctggccgtccacttcgcagccgtggaggcccgcttcctgcgagcatcgttcagctcatttgtggatcttatgggactcgtgacgaagctcgtcgaagaatatggtgtggccaatgcagggcattcttgaatcttgatgaacaatctcatacacggcattgcggagttgattttagttcgcctgtgagcaatttggagttttggacagtctttaccagtggaactgctcttgatctgtgtcaagc

SEQ ID NO: 345 - DNA, 1341 bp, Zea mays
aagtccatagccagcgaaactcccgaaaccgtaccaaccagacaattcaccatggcggcgccggcgcaggcgcaggtcatgcctctcctccggtggagccggagcgcctccttcctctgcgcctcgtcgcgccgcctcttctccgccctccaccgccccgctgccgctgctcgctgcgaggccggctccaaggccatgctcaaggggatggactactcggaactcgagaattgggtgcaggcgcaggggtttcggccaggccaggccatgatgctgtggaaatgcctgtacgggaacaacgtctgggctcattgctacgacgagctggctggtttaaataaggatttcaggaagatgataaccgagcatgctgatctcaaggcattaactatgaaggacattcatattgcatcagatggaacccgtaagatattgttctctcttgaagatggttcagtgattgaaacagttatcattccttgcgctaggggcaggacaactatctgtgtttcaagccaagttggttgtgccatgaactgccagttttgtttcactggaaggatgggtttgagaaaacatctctcgacagctgaaattgtcgagcaggctgtgtttgctcgtaggttattctcagatgaattgggatcaattaataatgttgtatttatgggcatgggtgaaccatttcacaatattgacaatgtaataaaagcctcagcaataatggttgatgagcaaggtcttcattttagccctcgcaaggttactgtctccacaagtggtcttgtccctcagttaaaacgcttcctccaggaatccaattgctccctggctgtcagtcttaatgcgacaacagatgaggttaggaactggataatgcccataaacagaaagtacaatcttaacttgcttcttggcactttaagggaggaacttaacctcagacaaaaacaaatagtgctatttgaatatgtcatgctttctggagtgaacgacagtatggatgatgccaagaggcttatagagctagtccaagggatcccatgcaagataaacctcatctctttcaatccccacgggggttcccaattcaagcccacaccagacgataagataattgagttccgcaacgttttaattcaaggtggcctcactgtttttgttcggctcagcagaggggatgatcagatggctgcctgcgggcagctaggagagcctggaggctataagctacctctgctccgtgtgcccgagaaatttcaggtcgccttgtgatgctaaacagtgcatacagtaaaaatggtcctgagcagcttgacgaacacacggagtaattggctt

SEQ ID NO: 346 - DNA, 1883 bp, Zea mays
gtttagcctcccgctgttgtggagccgcgggccattcccaaccatcgttgcggtggtggccggtattggccgagacccatgggcatccaggtcgcggcggtcgtgatcccgccgccctgctcttctccttcctcctcctcctcctctccggcgtcgccttcgtcctcggccattgccacgtcgccgcagcatgccgttcttggcgccaggctggcgaggagccagtcgtcgctggcttgctggaacgccgccggtctcggccggcggcgcggcggggagcacacgatcaggcgcgctctcagcgcgagcatcgacagcgtcgggagcgacggcggggacgacgaggagttctcgaggaggatccaggagctcgcggtgggtcagcacccgggcgccggcggctgcgggtggccggcgagcgtggagcggagcgcgagcagcgtcgggctgccgctgtccctgcggatgctcaaacggaggaagcagcagcagctggagcaggggcggtgggacgagcggctggtcgacagcgccggcgagtccgcgcgcgccgcggtggggcgcgccttctcctcgatggtgctcatcatccgggagctccagagcttcacgctgcagatgcgggagacgctcttgtacgaggacctgcagggcgtcctggcgcgcgtccacgccgagatgcacgcctccttcgtctggctcttccagcacatcttctccggcaccccggcccttatggtctccctcatgctgctcctcgccaacttcaccgtctactccatgggcgacagcgtcgcggccgctgccagcctcctcccaccgcacgcagccgtggcggctgtggagatggtggacacccagcaaccggagcaatcccattcccagcagcagcggttcgacacccccgcgctcaagacgttctccactggccgcacggcctcggtgggcggaaacggcggcgggggcggcaaggtgcggccggttgccggcgccacgggcgacggccagtcggacgagtcgtcgtcgtaccgacaaagcggagctgtgctgccgcaggacgtgtcgcaggcgacgcccctgggcgcgggcgcgggcgcggggtcggaggcgtccgtgtccgactcaatggccgtggaggaggcacagcagactgtacaggacgagctggtcatctggaaacggatatccgacgaagccatcaggatgcaggcgagcgtgcgtgcagaggagctgatggacccggaaatcctggagcagctcgtcgcgcccgtggaggcaccgaagccagacgtggcctatccgtcggaggagcacgtggccacggcgcagagatacgagcaggccgtgtccgaggagcccaacagctcgctgctcctggcgaactttgcgcagttcctgtaccaggtgcagggcgacctcgacagggcggagcacttcttcaggagggcggtgcgcgcggagccggcggacgcggaggcgctggggcggtacgcggcgttcctgtggcaggcgcgcaacgacctcgcggccgcggaggagacgtaccaggaggccatcgccgccgaccccggcaacgcgcaccacgcggcagcctacgcgcacttcctgtggaacacgggcggtgaggacacatgctacccgctcgactgatgcatgcgacgccgctaccgtccagcacagttcatcggtgcctcccatagaaaaaactgaaacaaaaaagaaagagaaaagaacactccgccgctccactgcctcggcaagtccacgctctttctcacggcatgtgcttgagcggccacccggggcagcagtactagactacaagtgaagctgaagcttatacacttcgcgttacaggaaccgttggttcgctttagtgtcta

SEQ ID NO: 347 - DNA, 612 bp, Zea mays
ctgtctctcgatcctgcatctctgcacctgctcgcctccccagggaggcagggacaatcgacttcgccgggcgccggctagccccaccggcgacgacaggcacagtggaccacggaggagaaagtactctgctttgaatgggaagtgccatgaacaaagacaaagttcatgacaaggagactcacggaacaagtagtgatataactgagaaaacacctgtggaaacggtgaagggtcccaatctgcttgagcgagcaaaggaagagatcgaggcccttgccggagctgttcatactaagatggagcaccattccagtccccacgcgaagaaggatgaatcacataaggaaggcaaggaggggagcctgcacaaaataaaagcccacacggatgaaactcacggaacaagtgctgacataaatgagaacacaccagttgacaaagtcaaaggtccgaatgtgtttgagcgtgccaaggaagagattgaagctattgtggaagctatccatccgaagaatggatctgacagtaagtgaagactgaaacccctggggctgttttgccttaactggctgcaaaagccttaacgtgaggccatgtgctaccagatag

SEQ ID NO: 348 - DNA, 939 bp, Zea mays
aaagtcgacacagcgctagcggcatagccggcgacagaaacaaccgatgccactcctcgccgtctgtccccgccgcgttccgccgctttcgctcgcgcgccgccaccgccgcagcttgtatcgggcccggtccctcgcgctcaaatgcgaggtctcctctcctccgctacttctgacccggaggatgtccgccgctggctcgctgcttgtcgctgtcgtccccgtccccgcgccgtcgccgcaactccccgtcgcctccgcgtcggagttggagacggagacggcggaaggagagagcggagcttctgaggggttagcattggagcgttacaccgaccaggagcagggcttcaccctcctcaagccggcctcctggcccaaggtggagaaggcgggcgcgacggcgctgtttcagcaggagggaaaagggagcaacaatattggggttgtcgtgaaccctgtccggctcaattcgctggcggagttcgggacgccgcagttcgttgcggacaggcttctgcaagcagagaagaaaaaggaaagtaccaagtctgccgaggtgatttcagtgggagagaggtcaggtcatggtggcttgacagtgtatgagatcgagtacacgctggacagcacaaggggagggatgaagcggatcttctcgggtgcgtttgtcgcttcaaggaagctctatctgctcaacatagcctattcagacacccaggagaagcccttggacagggagacaagaaccgttctggaaaaagttctccattcttttgattctgtataggtgatatttttttatagccgaggtatggcaccttttcttattttcggaatttctttcacttgaaaatacagtcgcaagtaattgtttgtttgtaaaatgagtgctgaccaaaatagctgcagtgtccatgtgtccaatacggatccttt

SEQ ID NO: 349 - DNA, 2419 bp, Zea mays
gctttaaatacgaccacgaagccggtgcggcgactcggcgatctctccatcactgctgcggtgctgcctagctaccttctcggcctcgggtgggggcggcattgtcggtccagactccagagcgcgctgcttccggagctggccgcttgcgctgagccctctgccggaggcaatgaggagcggccgtgcctgctccgctctcgcgtcgctcctgctgctgtggctgggcgtcgccgccgcgcagaaggcctcgtcctggaagacattgagcggcaaggctccagcaatcgtagccaagggtggattctccgggttattccctgattcaagcgaatacgcttatcaatttgcgctgctcgctagctcgccggatacgatactgtactgcgatgtgcggctgaccaaggatgagattggcatttgcctgccggacatcaagatggataactgcacgaacattccagatttctatgcgcagggtcagaagagctacctcgtcaatggcgtgcctacttcgggatggttctcggtggactacaatggcactgagcttgaacaagtgactctcaagcaatcaatcaattctcggacacccagatttgattcaagtttctttccactacttgctgttgaagatgtgcagtccaaattcaaaccttctggaatttggctcaatgttcagcatgacagtttctacagccagttcaatctaagcatgaggaattatatcatttctgtatctaagcgtgttgttgtcaattatatctcatcgcctgaagtgagcttcctcaccagcctacttggaagaattagcaacaaaacgaagcttgtgttccgctttcttgacgagagcagtctcgagccatctacgaaccagacatatggttccatgttgaaaaatcttacatttgtcagtacatttgcatctggtatacttgtcccaaagggctatatttggcctcattcaccagacaattatctgcaacaatacacttcagttgtcgatgatgctcataaagcggggttggaaatttatgctgctgattttgcgaatgattttgtggtcagttacaaccacagctacgatcccttggcagaatatctctcgttcattgataatgatgtcttctcagttgatggtgtattgactgatttccctatcacagcatcagaggcaattgggtgttttaccaatttaaacaaaagcaacactgatcatggaaagcctttaattatttcccacaatggtgctagtggggattaccctgggtgcactgatctagcttatcagaaagcagttgatgatggcgcagatgtcattgattgccccgttcaagtgaccaaagacggaataccaatatgcatgagttccattgacctgatgaacgatactactgttgcaagatcacaatttatctctcagactgccacgataaaggatattcagattgcacaaggggtttttacttttaatctcacctgggatgacattgtaaacaacctgcagcccaaaatatccaccccatggtactccttcagattggaccgaaatccgagatataggaatgcaggaaagttcatgaggctatcagactttctggacttcacaaaagacaaagatttgtatggaatcatgatcagtgtagagcatgctgcgttcatggcaggggaacttgggttcgacatggtggataaagttatcaaagcccttgacgacgctggttaccatgaccaaactgcccagaaagttatggtccagtcaaccgacagttcggttctggagaagttcaaggagcaaacgaagtacgaccttgtgtacatggtcaacaaaaaggtcggggacgctgcgtcgtcctcgcttgtggacattaaaaggttcgctagcgccgtgtccgttgataccggctccgtcttccctgagacccactacttcacagtgtacgaaaccaaccttgtccagacactgcagacggctggcctctcggtctacgtctacactcttatgaacgagtttctgtctcagccatacgacttcttctcggatgctacagcgcagatcaatgcctatgttaagggtgctctggtggatgggctaatcacagatttccctgctacggctcgaaggtacaaggtgaacagctgcatgaacatggggaacagcacaccgaatttcatggcccctgctcgtccgggtgatctcatgcaaagcatcagcaagagcgcgcagccaccagctttggctcccgttccacccttgactggttccgacgtggcggagccgcctttacctcctgcgagatcgaacagcagcacagctccgacgcaatcactcgcgagcaggacgcgtgcttgcgctgctcacatcccagccctggcctcactggcaatgctttgcgcctggctttccctggtatgataa

SEQ ID NO: 350 - DNA, 2269 bp, Zea mays
actccctcgtcaattcacctccgccgccgccgccgcgccgcttcgaacacgatggatctactgagacaccccttcaagggagttgtcactgatatcaaaggaagggccacttggtacaagcatgattgggttgcaggactccactctggctttaggatattggcacctaccatgtatatcttctttgcctctgctctccctgtcattgccttcggagcacaactgagcacggcaacaaatggaatactctcaacagttgaaacactggcatcgactgcgatatgtggcatcatacattcaattcttggagggcagcctttgttgattgttggagttgccgaaccaactattatcatgtacacttatctctacaattttgccaagaatcatcaagctctgggtgagcagctatatttggcgtggacaggatgggtctgcatctggactgccatcatgttgtttcttttggcaacgttcaatgcttccaacgttattagcagatttacaaggattgcaggagaactttttggcatgttaatcactgttctcttcttgcaagaagctatcaaggggatgataagtgaatttagtgtgcccgaagacgctgacagcagttcaccaatataccaattccagtggctctatgtcaatggcctactcggtgtcatattttcaattggcttgctgtacactgcattgaggaccaggcgagcaaggtcatggctctatggcacagggtggtttagaagcttcatagctgattacggcgtcccacttatggtgattgtgtggacaggattgtcgtatttacatccaggcaaggtgccttcaggagtccccaggaggctttcttctccacttccctgggagtcaagttcactgggacactggaccacagcaagggatttgttttctgtccctccagcatatatatttggagccattctgcctgcttttatggttgcaggactttacttctttgatcacagcgtagcttcacagttggcacagcaaaaagagtataatttgaagaagccttctgcctaccactatgacattttggtccttggattcgtggtcctgctctgcggtttgcttggtatccctccatctaatggagtgcttcctcagtctcccatgcacacaaaaagtcttgctgtccttaagaggcagttgctaagcaaaaagatggttgatactgccaaggagagcataggaggaagtgctaccagtttggaaatatatggcaagatggaagaagttttcatcaaaatggatagcgaacagaatactgattctgttgacagggagttgaagaacttcaaggatgctgttctgcaagaaggcgacgaagaagggagattggctagagaatttgaccctcgcaaacatatagaagcccacttgcctgtccgagtgaacgaacagagactgagcaatctgctgcagtccatactggttggtgggtgtgttggagctatgccagtcatcaggatgatacccacatcggtcctctggggttactttgcctacatggccatcgacagtctaccagggaatcagttctgggagaggatacagcttctgttcattacagaaagccgacgctacaaggttcttgaaggtccccatgcatcgtttgtggagtcagtggttcccaaaacagtaaccatcttcacgatcttccagttggtttacctcctaatatgcttcggcataacgtggataccgatagccgggatcctgttcccagtgcctttcttcctcatgatcgtcatcaggcagtatctcctcccaaaattttttgatcccgtcgtcttgagggagctcgatgcagctgagtacgaagaacttgacggggtcccccttgaacacaaactggaagatgaagcatctgaagtaggaagttgtcctagccgtcctgatgcggagatattggatgaactcacgaccaaccgcggagagctgaagcacagaagttctagcctgcgtgaagaaagaccaattcaagtgacagtgagcacgcatatggttgcttcaagtgcggttcagccaagcctgtgaagacggcgaagtgttctttttatccgtagaattatgatcctcaagctgcactccgttgatgtgaatactgttgctatgtaatgtactgctactactagtgttgtacttgggtttttgacccaaacgcgtctgttggtaaggggtgatttgtaagaacagggacttacgtaaactacgtaggatcgattggtaagaagagagggag

SEQ ID NO: 351 - DNA, 839 bp, Zea mays
cggcaatggaggtcacctcctccccctcgccttccgcgccgccgccggcctcctcgaagccggcgctccagctcaaccccgcggccgtcctcctccgccgcctgccgaccccgaccccaacagcggcgacgcccgtcaccgcgacggcgccccccgcgcggcccgccaccgcgtccaacccgctcgcggccttgctcgtccccttctggcgcgggctgcggcgagcgccgaaacagccggtccaccccgcctccgccgccgcggcgcggagggcggcggagcagcaggaggcggaggcagaggcgcggcagctggtggggtgcgcggtgccgctgttccggccgtacgtggcgcagctgccgtggcacggcggcgcgcgggcgtggctgtccaagctgttcccgcgctacggccactactgcgggcccaactggtccagcggcaaggaggccggctccgtgctctgggaccgccgccccgtcgaccacctcgacttctgctgctactgccacgacatggcctacgacacccacgaccaggcccagctcctccgcgccgacctcgccttcctccgctgcctcgagggcagccgccacacgcccgcgcgcgacggcatcgccgccgcagccatctaccgcgccatgtgcatcttcggactgaagacgatcctgatcccgtaccggacgaacctcgtgcggctacagacggggcccaactacgcggatttcttcgccgatttcgtgaagagggtcgcgtcgtcgtcgggcaggccgaccggcggcgagaagcagaggctgtgaacgaatttgctcgcctcgtcctacatgtaaaggtggtag

SEQ ID NO: 352 - DNA, 1450 bp, Zea mays
agaagttgagcggactgactggtcactgtagttcgatcgaatccgagtagggctgatacagttcgattcggcgggaggcatggcgtccgaaaagcacttcaagtacgtcatcctcggcggcggcgtcgcggcggggtacgcggcgcgggagttcgccaagcagggagttaagcctggggagcttgcaatcatctccaaggaggctgtggctccttacgagcgtcctgccctaagcaaaggttacctctttcctacgaatgctgcaagactcccaggattttatgtatgtgtgggaagtggtggagagaagctattgcctgagtggtactcagagaaaggcattgagctgatccttagtacagaaattgtcaaagctgatctttccaccaagactctgactagtgcagctggagcaaactttacatatgagatcttgctcattgctactggctcctcggtcataaagctcaccgattttggcacacaaggagctgattctaacaacattctatatctaagggaaattgatgatgctgacaagctggttgcagctatccaggcaaagaagggtggcaaggcagtggttgttggaggaggttatatcggcctcgaactgagtgcagccctgaagatcaatgactttgatgtcactatggtgtttcctgaaccttggtgcatgcctcgcctcttcactgccgatattgctgctttctatgaggcttactatactaacaaaggtgtaaagatcttgaagggcacgctagctgttggttttgatgctgatgccaatggtgatgtcactgcagttaagctaaaggatggcacagtacttgaagccgatattgttgttgtcggtgttggaggcagaccattgactactctcttcaagggtcaagttgctgaggagaagggtggaatcaagactgacgcttcctttgaaacaagcgttcctggagtatatgccattggtgatgtggctaccttccctttgaagatgtacaatgagttgaggagagtggaacatgttgaccattctagaaagtctgcagagcaggctgtaaaggcgatcaagggcaaagagtccggtgaaccagttccggagtatgactacctgccatacttctactcccgatcattcgacctggcgtggcaattctacggcgacaacgtgggcgaaaccatcctgtttggcgacagtgaccccacctccagcaagcccaagttcggctcgtactggatcaaggacggcaaggtcttgggcgccttcctggagggcgggtcaccggacgagaacaaggccattgccaaggtggcgaaaacccagccgccggtcgctaacctcgaggagctcaagaaggatggcctccagttcgccagcaagatctgagacgctcccgttccatgtaaaattccgtgtcatcgtgaaggttcttctggagctctggtctag

SEQ ID NO: 353 - DNA, 1199 bp, Populus trichocarpa
gtgtgatgacaatggaggaagctattgtggtgaacaaaggagatgatctgattgatttgccaccaggttttcggttccaccctacagatgaagagataataactcattatcttacagagaaggtgatgaatagtagcttctgtgcaagtgctattggtgaagttgatctcaataaggttgagccatgggatttgccaaagaaagcaaagatgggagagaaggaatggtatttcttttgccaaagagacaggaaatatccaactggtatgagaaccaatcgtgctacagaatcagggtactggaaggctactgggaaagacaaggaaatttacaagggaaaacatagccttgttgggatgaagaagactcttgttttctacaaagggagagctcccaaaggagagaaatccaattgggttatgcatgaatacagacttgaaggcaaattctcatactatagcctccccaaggttgcaagggacgaatgggttgtttgcaggattttccacaagagtacaggcatcaagaaaacctcaattcatgacctcctaagggtgaactctttcggagatgatttcttggattactcctccctgccacctttcatggatccccttaattacaatagcaggccaagcaccagcagcttcagtggtggcgataacaatgagttcaaggaaatggcaacaagatcatcagatggaaattatttctccaatacaagcatgctcaacaacaatcaaaactttgctcaacctccaaataccaactaccaagcaccaaactccagttttcaccctcaaattccagcctcaaatcctctttacacctttcaaaccagtcccaatatgcctggctacttgcaccaaggaaagagttcttctaattcattccaaaactttcaaaactctatcttcagtgacaatgaacatacccttctaagatcattagctagaaacagttatagagaagcatctggattggagaaacagtgcaaggttgagcgcttctcatctaatcaatctatggtcagcctttcacaggacactggacttagcacagacgtgaacaccacagctgagatatcatctgtggtttcaaagcaagaaatagggagccatgataaggtttttgaagatcttgagggtccatcagctggccccattgcagatttggattgcttgtgggattattgatga

SEQ ID NO: 354 - DNA, 1526 bp, Populus trichocarpa
tggatatggccattcaagcaactttcatagcagatccagttctcatttcaagcccatcaagaatctccatcagaggttgggagcaatgtattgggtcttttgtgttgaaaacgaggcctaggcatccgaggctttcaaatggaggcagagtcagagcaagagcttctctgaatgctgatttgaaagcggttggcattcctcatcagtggtacaatgttgttgcagatctttcagtgaaacctcctcccccactgcatcctaaaacatttgaaccagtcaaacctgaagatttatctcctctatttcctgatgagttgattaggcaggaggcaagcactgacaagttcatagatatcccggaagaagttcttgatatttacagtctctggcgcccaactccattgatcagagcaaagaggttggaaaagcttctcgatacacctgccagaatttactacaagtatgaaggtggcagtccagccggatcccataaacccaacactgcagtcccacaagttttttacaatgcgcagcaaggcatcaagaatgttgtgacagaaactggtgctggccaatggggatgttcattggcctttgcgtgcagcttatttggtcttgactgtgaggtgtggcaggttcgcgcttcttatgatcagaaaccatatcgtagattaatgatggagacctggggtgcaaaggtacacccatctccatcaagcattaccgagactggtaggagaattctccagatggatccgtcaagtccaggaagtttaggaatagctatatcagaagctgtagaggttgcagctaaaaatgctgacaccaagtactgcttggggagtgtgctgaatcatgttttgttgcatcagacagtcataggtgaggagtgcataaaacaaatggaggctattggtgaaacccctgatgtgataataggatgtactggtggagggtccaattttgcaggactcagtttcccattcatccgagagaagctcaatgggaaaatcaaccctgtcataaaagctgttgaacctgcagcatgtccttcactgacaaaaggtgtatacgcatatgattatggagatacagcaggaatgactccattaatgaagatgcacactctaggacatgacttcattcctgaccctattcatgctggtggattgcgttaccatggcatggctccattaatttctcatgtgtatgaactgggtttcatggaagcaatggcaatccctcagattgagtgctttcgaggtgccatacaatttgctcggtcggaaggactgataccagcaccggagccaactcatgcaatcgctgctaccataagggaagcactgcattgtaaagagactggagaagcaaaggttattctcatggcaatgtgtggacatggccattttgacctgaaatcttatgagaagtatttgcaaggaaagatggttgacttgtcattcgatgaggagaaaataagagcatcattggacaaagttcctcaggtgacaagaaattgatga

SEQ ID NO: 355 - DNA, 1589 bp, Populus trichocarpa
caaacatggcttcctcttccttagctttcccttcccttcaaacccaattccagtcactaaaaaagccgtctagtcccaagccctccactcgtcgcttctctgtccgtccgatcagagcatcaatatcagaaaaaccatcagttccaggtccacccgctactgtttcaccatctgaaccaaccaaactccccatccgcaaaatccctggtgatcatgggctccctcttattggtccctttaaagatcgcatggattatttctataaccaaggcagagacgagtatttcaaatccaaaattcaaaaataccaatcaacggtgtttagagctaacatgccgcccggtccttttattgctccaaatccgcacgtcgtggttttacttgacggaaaaagctttccggttctatttgacgtgacaaaagttgaaaagaaagatctttttacaggtactttcatgccttcaacagaactcactggtggctaccgagttctgtcctatcttgacccgtccgaaccaaaacacgccaaactgaaacaactcatgttctatctcctcaagtcacgccgtgatcacgtaatccctgaattcaatgccagttacacagaactctttatgagtcttgaaaaaaacttggctctcggagggaaagctagtttcggtgaagctaatgatcaagcagcttttaatttcttggctaggtcttggtttggtactgatccggcagagaccacacttggccttgacggacccggtctagtttcaaaatgggtgctctttaaccttggtccagtgctcaaactcggtcttccaaaatatcttgaagatcttaccgtccattcattccgtctaccaccatcactaattaaaaaaagctaccagcgtctttacgatttcttctacgcttcgtcaggcttcctgctcgacgaagcagaaaatttaggaatttcacgtgaggaggcatgtcataatcttcttttcaccacatgctttaattcattcggtgggatgaggattttatttccaaacatgatgaaatggctaggccgtgccgggaccaaactccacgctcgattagccgaagagatcagatcagtggtcagatccaacgatggaagtattacaatgcggggcatggaagagatgccattgatgaaatcagtagtctatgaagcactccgaattgaaccaccagtctcgctacagttcggtagagcaaagcgtgatctgataattgaaagccacgacgctgcttttgaagtcaaagaaggggagatgttattcgggttccaaccattcgctaccaaagacccgaaaatatttacccaagccgaggagtttgtcgctgacaggtttattggggagggagagaagatgttggagcacgtgctgtggtctaacgggccagagacagagaagccgacgttgggaaataaacagtgtgcagggaaagattttgtggtactcgtgtctaggctgtttgtggtggagttgttcttaaggtacgattcattcgagatagaggttggaacgtcgcccttgggagcagctgtgacggttacttcattgaaaagggcaagtttttagtag

SEQ ID NO: 356 - DNA, 1113 bp, Oryza sativa
cgaccagagtgaatttggaagttgcaatgggtgaaaacgctcaaggtagtggtcgccgcccctttggagatttaacaaatgtccttggcaagcgcccagccccatcgaatttggagaaaagtgcaggtggaatcaagattgtccgggttgaaaaggctgttgagccaagaaaagagtttgatgaaactgcaaaagcaagtggtggagcgacacgaaacacattgcccctttttgatagtattgccaaagagaatttaatgaggccctcaatttttcgggaaactaagatgcagcacatggctgctgaggcagctgtgttgctatccaaggaatccgatgacatgaggagttgtgccatgtcattaggctcatctggcttgcatgataaggagcaggagtcttcgctggaatcagaaggtggctgtgaagaagatgatgatgatgacatggatagtgaatacttggcatataccagagatagtactaaaacggcaactaatgatggtgaatgtcttactcaagaggagatggctggatcatcagggaatcagaagccactatcttcactggacttcacaacaggttgtgatgacatgccatgttccgatgtccatcaccattcactgggaaatagtgaactggaaaatgacgataccactaagtcgtgtgcttgttctttctgtcttaaggctgcattcatgtggaccgatctccattatcaggacacaaggggacggcttgctgcattgaagaagagcataaagttcgctagattgctgggcaagagaagccaaggagatgaatattctgttaatgcaggcagatacaacttgaaacgggctgcagagatggagtttgagctatatcaacagcaaagatcactcttccttcatacagaaaatgtccttatccgtgagagcgcacagcttcattcatctcttgtgaagttaaaggaattcagagagaactgcaagacagatctcgagacggctagcagttcgttgttgggaaaatgaatctttcatggttgtgctgttaaactgcttttgcctgggattcttcagatcagctgggccagtttgagtcaagttgtgcattgagattggttgattg

SEQ ID NO: 357 - DNA, 726 bp, Oryza sativa
gttgagagttcgttccatctcccttcgctcgccacgtggcagccgctagtccttatcgccgccgccgcccacctcgccatggggccgccacccgccgccgccgccgccgtggacggagtcggggtcggggtcggggcgcacagcgtgttcgtgtacgggagcctgatgcaggacgaggtggtgcgcaccatcatcaagcgcgtcccgccctcctccccggcgctcctccccaactaccacaggttcaacatcaagggtaggatttatcctgcaatcctacctgttcaaagcaagaaagttgctggcaaggtcatcaccggtgttactgatgcagagctccagattctggatgaatttgaagatgtggagtacgtgaggacaagagttgagatatcattaactgatacttcagagacaatgcttgctgacacctatgtgtgggctgatgcagaggatccaaatctttatggtgaatgggattttgaggaatggaagaggttgcacatgaaagatttccttgcgatgacccacgggttcatggatggcctcgaacagcctgaatccaagtccagggttgaaacctaccaatcattcatgcaggaaatccaacagcctgggacgacgacgacgacgacccaggttgagatttgaaggactacattgcaatattcgccaatagccgatatatatagtgaaatggcagttcgctgtattagcatgttatag

SEQ ID NO: 358 - DNA, 2357 bp, Oryza sativa
ctcgagttgccgacgacgacgaccactaccaccaccaccaccaagaacgctaagtctctcgagagacttagcgttcttggtggtgttcgcgatctttgcggcgtccagtggcagtggattgcggtggtgggattggcgcggatcctgttttgctcgtttggttgtcgatcgccggcggtggattccggtggtggaggtgtttgggttgtgagctcgtcggcggcggcggcggcgcattgggtgttgggggccgagatgggcggcgtgtgctcggcggggatcccgggggacaggtcgccggcggagctgtcgttccgggcgatggggctcgtggtggagcaggagctcaaggcgttcccggccgtcgccggcaaggtgcaggggaagcacaagacggcaccggtggaggtggcgccggagcctgatccgccgcgccgcctctcccccgagaaggccccccggctgtccaccggcggcggcggcggcaaggctcgccggtcggtctccaaggagccgcagctggtgcgctcctcgtcggagaagctcaaggccggcaagtccaggacaagcacctccggcaaggcttcagacaaaggctcggtgtttggtagagccagcacatctgggattgggaaagcagtggaggttttggacacactgagcagcagcatgacgaatttgagccctgtaggtgggtttgtggcgggcgcgaagatgaaggggagcccacaaaagattcttgcgtttgaggttgccaacacaatagtgaagggcatgagcctgatgcagtctctgtccaaagaaagcgtcagatacttgaaggggaccgtcctccgatcggagggcgtaaagcgtttggtttctagcgatatgagtgagttgatgagaattgctgcagccgacaagaggcaagagctggcgctattttcgcgagaggtgatcagatttggcaatcgttgcaaggatactcagtggcacaacctcgatcgctatttttccaagctagaatcagaaattacgcctcaaccaaacttgaaagaaatagcagaagcagagatgcagcaattgttgacactggttcggcacacggctgatctgtaccatgagttgcatgcattagatagatttgagcaagattatcgccgtaaattggaggaagagaaaaaatcagttgcttttgaaagaggggacactgttcagattataaggcaagaattgaagagccaaaggaggcatgtgaaaagcttgaagaaaaagtccctttggaataagatgctcgaagacgtcatggataaacttgtggatattgtccactttttacatgtagagattcaagaatcttttgggacctatgatggagctttacaattgaatcaaccttcagagagccgtcagacgttaggatcagctggcctctcgctgcactatgccaatatcatttcacagattgacaacattgtttcccgaagcaccgttccaccacaaagcacaagagatgcgctctatcaaggactgcccccaactattaagtctgctcttcgaaaaaaactacataattgcccacaaccacaagaggttccgatcactgaaatcagatcttcaatggagagaaccttgcaatggattatccctattgccaacaatacagccagagctcaccatggattcggatgggtcggcgagtgggcgaacacagggaacgatgcgatgcggagggcggctgggcagccagacgtgatcaagatcgagacattctaccatgcggacaaggccaagacggaggcgtgcatcctggacctcgtcctgtggcttcaccacctcatcagctacagccgcccaagcaacggtggcaggtccaggtcgccgagcaggtcgccggtgcgctcccctcccctcacgccgccgcaccaggtgccgacgacgacgtcgtcgtcctcgccgccaccgccggcggtggcgaggccgagcggcggcaccggcggtggcctcaccagggaggaccgcgcgatgctccaggacgtgtacgcgggccgccggcgtcgcgctcccggtcacagcaggagccaggagctgtcgtcagctcgcggcggcggcggcgccggcggcgacagctcgtcggcggtggcagccgcggcgcagctgagcaagaacgacaggctgagcaagagcagcaacgatgctccggcgcggagcggcggcggcggcggcggcgggaagctcttcccgctgagcaggaggccctcctccgccgtggtgtcgcccgccgtcgacttcgacatcgacggcatcaaggcgctggcggatgcacagaagcggcagtgaccgtgacgtcacagccaccatcttcttctgaattc

SEQ ID NO: 359 - DNA, 1076 bp, Oryza sativa
ttctcatggagtcgtgtagcttccgcaccgccgcctcgccatcgccattcccctcgcttccctcctcctcccgacaagcgccgccatgctccagcctccgattccccagaccaagaaacgggaggatggtgggggtgcggaggagggcgtccggattcgaggccttccctcccctacctggtaaggtgttcgtcgaggaggcaattggagctgaatatggggaaggttttgagacatttaggatggatggaccactcaaggtcgatgtggattatctgaacgaaaaattgcaagaatgcttccttcaaaggataagacatgctatgaagccagatgaagcatgtgggcttattttctcatgggacaacgtaattgctgatacagactcactaaagttggatgcctggagacagcttgctttggaagaagggaaggatatcccaaatgctggtcatgtccaaaagagtattcttcatggtgctgccgaccatgtgcttagaaaggttttatgttgggcaaaagatgaaagtcaaatggaaagactgaaggcacggcttatagagttatactacgaaaatctcttcaaacttgatacaccagtaaatggattgcgggaatggttggatgctgtccagacagcaggcatcccttgtgctgtcgcatcgtccctggataggagatgcatgattgaagctttggatcgaatggaactaagcaaatacttcaaggcaattgtgactgacgaggatgatatggagtcaatagcacataggttcctctcagctgctatgaagctggatcggaagccctcaaagtgtgtggtgtttgaggatgacccgagaggcgtaaccgctgctcacaactgtaccatgatggcagttgcactcattggtgctcatcctgcgtatgagctggtacaggctgatctcgccatcgcaaaatacagtgagctctcggttatcaatctcagaaggttgtttgcacataaggggttaagtttcatggacttgcagaagcagatcatcgagaggtcacctcccaagaggaagctgacagtagacaccatcttctaataa

SEQ ID NO: 360 - DNA, 1819 bp, Oryza sativa
agcggcttcctctcttctgcggccgcgcgcgatctccacacctcccctgcggaggcaaggaaggagaggcgcccctccacacgcggagcagaagagagccatgggcctccaggtcgcggccgtcgcgccatccccgtgcgcgcgctcctccgcctcgtcttcgccgccctcgacatcctcctcgcgtcccgccctcggcggtgcggggctcgcgagatcccgcgccccggttaattggggcgccggtgttatggcgcggcgccgcgggttgcggcagccggcgaggtgcgccctgagcgccagtttggatggcgtggggggcggggacgcggagttcttgcggcggatcgaggagctcgcggcggcggtgggtgtgcagcccacgggttgcgggtggccggcgagcgtggagcgcagcgcgagcagcgccgggatgcctctgtcgctccggatgctgaagcggaagaagcagcagcagcagctggtggcgcggcagacgcggtgggacgagcggctgctgggctccgccggcgactcggtggggcgcgccttctcgtcgatggtgctcatcgtgcgggagctgcagagcttcgcgctgcagcagatgcgggaggcaatgctgggcgacgacctgcagagcgtcctggcgcgagtccatggcgagatgcacgcctccttcgtctggctcttccagcacatcttcgccggcaccccggctctcatggtctccctcatgctcctcctcgccaacttcaccgtccactccatgggtcacagtgtcgccgccgccgcagccatccctcccgctccacctacctccgcggctgtcgcggtggtcgacacccagcacgccgacccatccctcccgcggttcgacgcggcctcggtcaagacgttctctattgggcgtgccgcctcggtcggcgggagcagcggcggtggcgggaaggttcggcccgtcgcgggcgccactggcgacgaccggtgggacgaatccctagctcggctgagcggtgtcgcgccgcagcaaccagcgccgccggcgggaacgggagctggtatggccgtggacgagcaggccatctgggaaaggatggtggcggaggcctcgaacatgcaggagaacgcgcgtgcagaggagctgagcgacccggacgtgctcggcaacctcgtcgcaccggtggaggcggagatcgagacggagggccacgctgagtacacgcggacggagcagcggtacgagctcgccgtgtccgaggagcccaataacccgctcatcctggccaacttcgcgcagttcctctacctcgtgcagaacgaccacgaccgggcggagcagtacttcgagagggcggtgcgcgcggagccggcggacgcggaggcgctgagccggtacgcgacgttcctgtggaaggcgaggaacgacctcgcggcggcggaggacacctaccaggaggccatcgcggccgaccccggcaacgcgcaccatgccgccgcctacgcgcatttcctctggaacaccggaggtgaggacacatgtttccccctcgattgacgcggccaccggcacaacaatggccactcgaaatcagacagaaaattaggaagcggaaaaaaaaaagaatctctattcaaagaagtccagttcgtgcagcatgcgcgggggcggccacgcggcgagacgcctagagcacacgacgacatgggcggcggagtggagctgacgcatgatgccttccgtttacttaggtaggttgagtagaggtgtgcgtgggcagtggagtgagttgtgagcttgtgagttgtgtgatacgggaga

SEQ ID NO: 361 - DNA, 1510 bp, Oryza sativa
gccgtttctggtaatctcaggaacttgaaatggcagacgaggagcatgctccaacgtctaggaagagggttgcaggtacccaaatcaacaaggataatcctgagcctgatgatgactcaactgagcaagagatggggacatttaagagagctagtgaggaagtgatggcaacacggagaattgtaaaggttcgacgccagcagccctcatcagctccttctaatcctttctctgcaatcagatttacccccagtgataccagcgcccaagcaactatccctgtctcagagcctcaaccttctgatgtcattacagcggatgcaaaggatagttcaagtgagaaagctgatgagggaagcaatggcagtgggaaagatgctttacctgtaactgacaagagtgcaggttctagtgaggtagctgagacagaaaaggatggatcagatctgaaaggatcagatgaaaaagccaagtccagtgactcaattgaaccaccttctcaacctgttgagaccactgacgaagcaaaagacttggggggcggatcagtggtagctggagaggccaaggaagataacagcaaggcatctgatatcgaggacaaaacagcaaaagagggagatgctgaagaagaggatggagcaaatgaggctggagctgaagacaaaattagcaagggtgatgatgagaagaaagatggagatgaatcagagacaaaggatggatcgtctgaggagcagaaggatgctgataacaaggggcagtcgtcatcaccaacaccccttttctctttcaagaacctgtcgagtggccaaaatgccttcacaggactggctggaactggattttcaggctcttcattttcatttggatcaggctctaaagaaagctcgagtgctcccctgtttgggctaaagactgatggctcatcattcccatcttttagtattggtgcttcgaataatgggagttcctcccctgcgcttgcgacttcagcagaagctcccaagaaatttgctatgccagagggcccagttgaaactggtgaagagaatgagaaggccatattcacagccgactcagcattgtatgaatacttggatgggggttggaaagaaagaggaaagggggaactaaagttgaacatcccagtatctggtggcgagaggtctcgtctcgtcatgagaaccaagggcaattacaggctagttcttaacgcaagcctttacgaggacatgtcgctgaaggacatggacaagaagggcgtgacgtttgcctgtatgaacagcatcggcgactcgcagagcgggcttgccacatttgctctgaagttcagggataccagcatcagggaggagttcaaagctgcggtggagatgcacaaggcgaaaaaggcgtccggcacactcaagacacccgagaactccccgaaggcatcagatgattgaaggttgaagcccaactctcgccacaatgcaccgagtccatgaagtggaggagctgagatacg

SEQ ID NO: 362 - DNA, 1160 bp, Oryza sativa
aaaggatccaccagctggctattctctcttgcccttccacgttcaagtttcagcccaggtacggccggaagctatctaaggactgcagctatgggcaatttgttctgctgtgttcaagttgatcagtctacagtggccattagagaacagttcgggaagtttgatgctgtgcttgagccaggatgtcactgcctgccttggtttgctgggaagcgtatagctggccatctcacactcaggttgcagcaactggatgtgcgctgtgaaaccaagacaaaggacaatgtgtttgtcaatgttgtggcatcgatccagtacagagctttggctggcaaggcaaatgatgctttctacaagctgagcaacacaagatctcagatccaagcttatgtcttcgatgtgatcagggcaagtgttccgaagctgaacctggacgacgcatttgagcagaagaacgacatagcaaaggcagtggaggatgagctggagaaggctatgtctgcttacgggtttgagattgttcagacgctcatcgttgacattgagccagacgagcacgtgaagcgagcgatgaatgaaatcaatgcagctgcgaggctgagggtggctgcaaacgagaaggcagaggcagagaagatcgtgcagataaagagggcggagggagaagcggaagcaaagtacctgtcggggctgggtatcgcgaggcagcgtcaggcgatcgtggatgggttgagggacagcgtgctggggttctcagtgaacgtgccgggcaccacggccaaggacgtgatggacatggtgctcatcacccagtacttcgacaccatgaaggagatcggcgcctcctcaaaggcctcctccgtcttcatcccccatggccccggcgccgtccgcgacatcgccacgcagatccgcgacggccttcttcagggccaggctaccaccacctcccattagcatccatgtgggacaccagctgtgggattgctaagctgctgtttctcttgatttgtcctgtgtgattagatatgtcttgtaatttcttcatgctagctgtccgaccgacgtgtgtgcgcgcgcgggcaacattttcattttagttgtgaatgatatcctatcgtgtatgtatgtgtggaactatgccttgtgaaggtaccttt

SEQ ID NO: 363 - DNA, 1440 bp, Oryza sativa
aaactcgaggatgagaggaggcgatgagaatggccgcgccgcagcaagtgcatgtgcgtgccgccccgctcgcgcgcgcgctccgaactcgcgtcgccgccgccgccgcgtctgcgagctctcccgaacgcgcgctcctcggcctctccgaaccggatctccggcagctcgccgtcgacctcggccagcaaagttacagggggaagcagcttcacgacctcctctacaagtccagggccaagcaaatccaagaatttagccacgtaccaaaggtgttccgtgaggccttggtcggcgctggctggaaggttggccgctcgccagtgcaccatgctgtgacggcctccgatggcactaccaagatacttctcaagttggaggataacagattgatcgaaacagtagggatccctgtcgatgatgacaaaggcccgtcaagactcactgcctgcgtttcatcacaggttggctgccccttgcgttgctcattttgtgccactggcaagggagggtttgcaagaaaccttcatgcacatgagattgttgagcaggttttggccatagaggagacgttccaacacagggtgacaaatgtagtgttcatggggatgggtgagcctatgttgaacctgaaatcagttttagaggcacatcgatgcttgaacaaggaactaaaaattgggcaaaggatgataacaatctccacagtaggcgttcccaacactataaaaaagttagcatctcacaagcttcagtcaacacttgcagtcagcctgcacgccccaaatcagaaactacgggaaacaattgttccaagtgcaaagtcatatcccttggaggcactaatggatgactgcaagaattacttcctcgaaactggacgaagggtatccttcgagtacactctgctagctgggattaatgacgcaaaggagcatgctgaagaacttgcagagctactgcatacatgtggcggtggttatcatgtgaacctaattccctataatccgattcaaggttctgaatacaagaggccctacagaaaagtggttcaagcgtttgttgatgcgctagaagctcggaagataaccgtaagcgttcgacaaacccgtgggcttgatgctaatgccgcttgcggacaactaaggaatgagttccagaagaatccactgcttgaatcatcaccttcatcagagcccaacctcttaccagcttgatgagaagactgagttcatgatggccatgcacaatgattgcagattatcagtccatcacactgaaagctgatattgtactcgtagttgttttcggcatttcctgatgtatttgaattttcaagagttgttataagtagatatatatttagtgccacatacgggtgctatagaatcattatgcacattgcttaggtatgtaatctgcctgacgttggaattcttt

SEQ ID NO: 364 - DNA, 2119 bp, Oryza sativa
taacacaataggaggagcagagaggagagagccactgcaccgcgcgtccgcccgcgctccctccctctcctctcctcgcactcgccgtccctcccaatggcctccgctgccgcccacgcggccaccgccaccgccgccgccgtcctcctcgtcgtcttcctcgccccccttgccgccgcctccgactccgaccacaagtaccaatcggaggagaaggttatgctctgggtgaacaaggttggcccgtacaacaacccacaggaaacttacaactactacagccttccgttttgccatccgtccaataaccccgtgcataaatggggagggcttggggaggttctcggtggaaatgagctgattgacagccagatcgacataaagtttggaagggatgttgacaagggtaccatttgttcaattgaacttgatcctgacaaggccaaacagttatctgatgcgattgagagttcatattggtttgaattcttcattgatgatttgcctctatggggttttgttggagaggcagacagaaatagcgataacaaatatttccttttcactcacaagaacatcgtcatcagatacaatggcaatcagattattcatgttaatcttactcaagaaagtccaaagcttattgatgcgggtaaggcattggatatgacatattctgtcaagtgggaaccaaccaatgtaacatttgctcaccgctttgatgtataccttgactaccctttctttgaacaccagatccattggttctcaatcttcaattctttcatgatggttatctttctcactgggctagtgtcaatgattttgatgcgcactctaagaaatgactatgcaaagtatgcccgcgacgatgatgatcttgaaactctggaaagagatgtcagtgaagaatctggatggaagcttgtccatggggatgttttccggcctcctcgcagtttggctcttctttcagcccttgttggtgttggcacacagttgtctgctcttattctgctagtgattttgttggcaatcatcggaatgctgtatattgggcgaggagctattgtcacaacattcattgtttgttatgcccttacttcattcatctctggatatgtcagtggtgcactttattcacggcatggggggaaaaactggatcaaggcaatgattatgacagcatcactatttccgtttatgtgctttggaattggcctagtgcttaacacaatcgctatattctatcgatcattagctgccataccatttggtactatggtggttgtgttcatcctgtgggccttcatatctttccctcttgctcttttgggaactgttgttggtagaaactggagtggtgccccaaataatccatgcagagtaaagactattcctcgccctatccctgagaagaaatggtacctcacgccttctgtcattgccctcatgggaggactgcttccttttggtagcatcttcattgagatgtactttgtcttcacatcattttggaactacaaggtgtactatgtatatgggttcatgttgctagtctttttgatcctcataattgtcaccatctgtgtaacaatcgttggtacatatttcctgctgaatgcggagaactaccactggcagtggacttcattcttctctgctgcttctactgccgtctatgtttacctctactccgtatattattaccatgtgaagaccaagatgtcaggattctttcagacaagtttctacttcggctacactcttatgttctgcctaggtttaggaacactctgcggtgctgtcgggtatcttggatcgacactgtttgtgagaaggatctacaggaacataaagtgtgactaaaaattgaccccggtttagacagatggggcgaaaaactttgtatgtgtggcttgttccgtgaagtgatcagccatgttttggtggccaagaagccagggcagtttatggagtacaaacgttcttcggcgacattgctgggatgccatggtttttgttttcttgtcccttttgttctctttgatccccctctcggtgccacaattttcatgttcaactagccatatatagctgcgatcatagtttagatgtt

SEQ ID NO: 365 - DNA, 987 bp, Oryza sativa
aaagtcgacccacttcgtttgataccctcggcgaccgcgcggcggccagcgggcgcatccatggcggcggcgggatccataggcgtgtacaaggcggtgttcgcggcgctgggcgctctcatgctgggcaccctggtgtacacctgcgtcaccgacggctcgccgtttcgcctcgagctgctcaccccgtggttggtggcaacactgattgatttttatgtgaatgtgactgcgatttcgacttgggttatctacaaggaagtaaattggattagttctttcttttgggtagttctgttgtactgttttggcagtattgctacatgtgcttatgttgttgtgaagctttttgaaataaaaacttccggaccttcacaagatccacttgatcttttattcctcaggcaaggaaatctatcccaaagaaagtcctcttttgtcataattgggagaattattttcagcattttgggtgcaatgatggctgcagtcgtcatatatactgtcatcactgatggactaccttttaggaaggacttgttgacaccgtggatggcagcaaccttacttgacttctatataaatgtcttcgcaatatcggtatgggttgctcacaaggagtcaaactggatatctactgctatttggatatgcttgttaatatgctttggaagcatcacgacatgcggctacattgtcatacaacttttccaagtgtcgtaccaagacccgatctaccatgtgctattgaacactcgtaacaagtatgacattgttccctcccaataatccttgatcttcttcaagccttgttagcttgtggatgtctaaacgttgcttgacatatggtcatttatctggaatttatctgtctgaaatgtaggaagatttgaaaaattcattgaaggtctatgctattcttggtatacagtaatatttgcctcaataaatggcatattacctagcaattacagaatgaggcctaaa

SEQ ID NO: 366 - DNA, 1159 bp, Oryza sativa
gtttcggtgcttcctcctcctcctcgccatggcgctcctcctcctccgacgcggcggcggcttcgctgcggccacggtcctcgcggtcgtcgtcgtcgcgctcgtcctctcctgcggtggtggcgcggaggcggccgtgagggacctcagggtcgggtactacgccgagacgtgccccgacgccgaggccgtcgtccgcgacaccatggcccgggcacgcgcgcacgaggcccgcagcgtcgcgtccgtcatgcgcctccagttccacgactgcttcgtcaacgggtgcgacgggtcggtgctgatggacgcaacgccgacgatggcgggggagaaggaggcgctctccaacatcaactcgctccgctccttcgacgtcgtcgacgagatcaaggaggcgctggaggagcgctgccctggcgtcgtctcctgcgccgacatcatcgtcatggccgcccgcgacgccgtcgccctgacaggtgggcccttctgggacgtgaggcttgggcgcgaggacagcctgacggcgagccaggaggactcggacaacatcatgccgagcccacgcgccaacgccaccaccctcatcaagctcttcgccggctacaacctcaccgtcaccgacctcgtcgcgctctccggctcgcactccatcggcgaggcccgctgcttctccatcgtcttccgcctctacaaccagtccggctccggcaggcccgaccccaacatggaccccgcctaccgcgcggggctcgactcgctctgcccccgcggcggcgacgagaacgtcaccggaggcatggacgccaccccgctcgtcttcgacaaccagtacttcaaggacctcgtccgcctccgcggcttcctcaactccgaccagacgctcttctccgacaacgccgggacccggctcgccgtgaggaaattcggcgaggaccagggcgccttcttcagggccttcgtcgaagggatgatcaagatgggggagctgcagaaccccaggaagggagagatacgacgcaactgccgtgtcgccaatgccccggcgccgccgcctgtggaggcggaggtggcggcgacgtccaaggcggtggtcctggtggacttctgacgaacgagctgctagtcccctgactccccagctgttggtgttcgagag

SEQ ID NO: 367 - DNA, 2736 bp, Oryza sativa
tgagacatccaccatatcttccccgcctcggcgcgcgcgtactcctacgtctacgtgcgtgagccccccacacaccctcgctcgccgcgccgccgtctctagttttttttttctaaaaaaaaaaaaagcctcggccgccgcagccgcccctgcccatcgatcgcggcttgtctcttccccttccctctgcctggcgtggagtactactgcgctactagagagtttgctggtggaggaggaggacgaggaggaggaggctgggtggtggcggccgccgcgatggacataacggaggtgacggtggtgcaccacgcggcgctggtgctgctcgcgctctgggccgccgtgtcggccgggtgggcgcacccggcgatcttcctcgccgcgctcctctatctgttcgcggtgaatgaacgatacacaatgaggctgcgaaagcgaatacaacatgaggaaaggaaatgtgcaaaccaaagaaggcttctctctgatgcagagactgtcaggtggttgaattatgctgttgagaagatctggccggtttgcatggaacgggttgcatctgagcagttccttttgcccatattcccatggttcctggaaaagttcaaaccatggacagcgaggaaagcagtgatccaagacctttacttgggcaggaacccaccaatgtttacagatattagggttgtcaggcaatcaactgatgatgaccatctggttttagagataggaatgaacttcctatctgcagatgatatgaatgcaacaatggctgtgcaacttaggaagagattaggatttggcatcacagcaaacatgcatataactgggatgcatgttgaagggaaggtcctagttggggtgcgatttctccgacagtggccatatattggtcgcgtaagagtgtgctttgttgagcctccatacttccagatgacagtcaaaccattatttggtcatgggcttgatgtaactgaacttccaggaatttctggatggcttgacaggatgttggatgtcgcctttggacagacccttgttgagcctaatatgctagttattgacttggaaaagtttgcatcggaatcaacagatagctggtttagtgttgatgagaagccacctattgcacatgccaaggtagagatcttggaaggtgctgatatgaaaccctctgatccaaatggattagctgatccatacgtgaaaggccatcttggaccctatcgtttccagacaaagatccacaagaaaacactcaatccaaaatggatggaggagttcaaaataccagtaacctcatgggcagctctcaatcttctctctcttcaagttcgagataaggatcccatctttgacgacacactcggtgactgttccataagcatcaacaaattgagaggtggacaaaggcacgacatatggattgctctgaagaatataaagacagggcggattcatatagcagtaacagtacttgaagatgaaaatgaaaaggttccaaacgatgacgatgagcagtgtggaacacccaaggggggtaaagcaagcacaccaaggtctagcttttcgtccaggaccaacaatgaaagtgaatcatcagaggagtttcgaaagatatctgctgaatatgagccagtagacattgaaggactggaaaaggttgatgtttgggtccatcggccaggcagtgatgtcgcagtcacttgggagcctcggaaaggacgtgcgaggtgtcaggattccagaatcctacgagagaatgatgtctactgtgacagccctaagtcgtgccaatcagaatctcagagaagtgactccagtactgaagaaccagccaatggcaaatcacgccatcatctccacaaggtcaaaaagggtttggggaaactagctggtgcgatgttcaagagcccaaagaaagagagtgatgatgaagcctcgccatgtgtgacgcctcacccaaatataaaaccacttggagaaaaaagggtgtcagtaagatacgtcgtcgatgaagatccttctgaaaacttgccagatgaccagcattccagtcctgagagaggcgagtcggaaagtccgaccaagaggcatttgaggaagaaggctgtgcacatggtgaaacatgcggggaacaaaacagctcataatctgaagaacatgttcagcaggaaaggcagtgacaagagcaaagaaggccaagatgaccagaaagacgatcctgatactatagtagtagaaccttcaaaagttaagaaagacaatcctgatgcaagtgaggtagacatagacccttcacaagttgagaacgacatccccgattcaacggcaattgaccctttgaaggttgattctaatgtggccaacaacattgtggttgatgcactagagtatgcatctgaatctgatgcgaaggacaaaccacagtgaaatgtgttctgctatttttggcggtcctcgtgctgttgggactgttcatgtaggcaggatactaggtagcaaaatagtctgatagcctcctgacagcaagcgaaggttgacagtatagtccgtttggttggttgagtcctccatcttacctgacgaccgatgtttttcttgtattatagatgctcaaggaacaatacctctgtacatgtcgtatgcagactgtctaagctgtttgcttcttggacatggaaagcaggtggccggttggctttggcaaggtgttggataggagagaacgga

SEQ ID NO: 368 - DNA, 866 bp, Oryza sativa
actgacaacaacaagctcatcgccaacccgctactgaagcagcagcctaccagcaatggcgttgccgctgctcaagtcgtccccccacttctctgctcttcactccgcgaacagagcccagctccatggccgctgccgtgcaacgctcggtggattccatgacccgaggtccaactccagccgttgcaagaaatcggccgggaggggttcagtgaaggcgaacgcgtccccgttggacgtggtgacgctgatggtgacgatggtggagcacgtcgacctgcagagggactacgtcgtgcacaagtcgatctggcatctcagcgacgccgccctcaagagcgtctataccttctacgccttcttcacagtctggggcatctgcttctttgcgtccatgaaggatcctttctacgacagtgaggcgtacaggggacaagggggtgacggcaccgtgcactggtactatgaccggcaagaggacctggaggcgtctgcaagagaggagctcctgagggaggagctactcgaggagatcgagcagagggtcggagggctcagagaactcgaggaagcagccaaggaggagcagcttacaaactgatggatgaatgagagattgcgcatggatggatgactgcatgatcatggcgcgatgcggctgcattctgtaataccgtacagagcggctgtgtaatagcaagatacacagttgcctgatagcgcctgtaaatgttggcatcagactcaaaaggaaagcaaataggtgctccgtctgcatgaatgcattatattgcatttgtagtgtaggctaaaagaaggaatgtactactccatgttaatcaaagaacctgtaccgttcaccatgg

SEQ ID NO: 369 - DNA, 2909 bp, Oryza sativa
catagcttgccagtttctgatgagccaagggagctctgtgcgtcgtcagctctcctgcccgggacagtgatgagggcaaggagccatgcttgtcaggttaggcgtcgttgttgtagcctccgtcgcagctttaactcttaagagagccaacagtggcaacagagatggccaagcaaggaaaggaaaggataaaactcgctactctgaacatggggagaaagaagaagagaaggaagaggttaaaacaatcagcggcataatcaattcagctctttcagatgatgacgacatgctctccgagatcgagagcctcctatcaggggagattgacatccccctaccaagtgacaggttcgacgtcaaagaacgctctcggtacaacagtgttaactccgagctggagaggctgcgtggacttgtgcgtgagctggaggagagggaagtgaagcttgagggagagctgctagagtactatggcctcaaggaacaggagactgatgttgtagagctacacagacagctcaagatcaagatggtggagatcgacatgctcaaaatgaccatcaactcgctgcaagaggagaggaagaagctgcaggatgacgtcgcccgtggcacaggagccaagagggagctggaggctgcgaggaacaagatcaaggagctgcagcgacagatacagatggaggcgaaccagacaaaagggcagctgttgcttctaaagaaccaggtgattgcgctgaagtccaaggaggaggaggcagccatcaaggacgcagaggtgcagaggaagctgaagaagctcaaggagctggaagtggaggtagttgagctgaggaggaagaacaaggagcttttgtatgagaaaagggatctcatcgtaaagctggatgcagcacaaggaaaaataacagagagtgatgtagtttcccatgcaagagaggagatcaacaagctgaggcatgcaaatgaagaccttaccaagcaagtagaaggcctacaaatgaacagattcagtgaagtagaagagttggtttacctgcgttgggttaatgcttgtctgagatatgagctccgcaactaccaggcaccgtctgagaaaatttctgctcgtgaccttaacaagaccctgagcccaaaatcgcgtgagagggccaaacttctaatgctggaatatgcaggatcagaacgaggacagggcgacactgaccttgaaactgcttcttctgcaccttcttcacccagaagcgaagacttcgacaacgtttcagttgacagttcttctagcagatacagcttctttggcaaaaggcccaatctgatgcaaaagctcaagaagtggggaaggggcaaggatgacggaagcagcttagcttcaccgacacagtccttcactagtgactccccaaagagcgccagccagaaaccaaaggggcccctagaggctctcatgctcagaaacgcaggagatggtatgggcattacaacctttggaaagagggaacaagatcccagtgatatcatggatgaggcaaatgttgcatcttcatttcatttgatgtcaaagactgtacaaggttttgctgatgacaagtatcccgcttacaaagataggcataaactcgccacagaacgggagaaggcaataaaagagaaggccgagaaagctagggtacaaagatatggcggtgtcaacagttcaggtattgtgccatctccaagatctgcactccctccaaaacttgctcaaataaaggaaaaggctcctacagctaatgctgaatccagtgaccaacctagtgataaccagaacaaccctctagttgtgacacaactgaaacttgcaaatattgagaagagagctccaagagttcctaggccacctcctgcaccatcagccactgccaacactgcaagtgcgttacctccaccaccgccacgcccgccaggtgcacctcctccaccaccgcctcctggcaaacctggtggcccgccaccgccgccaccacgccctggttccctacctaggaatcttgctggtggtgacaaggtacaccgtgctccagaggttgtagagttctatcaaagtctcatgaagcgtgaagccaagaaggacacaacttctctgggatcaacaacatcaagtgtctctgatgtgagaagcaacatgattggagagattgagaatagatcaacattcctcttagctgtcaaagtggatgtggagacacaaggagactttgttgagtctctagcaaatgaggtccgagcagctagttttgtaaatatcgacgacgttgttgcatttgtaaactggcttgatgaggaactatccttcttggtcgatgagcgggcagtactaaagcactttgattggccagagagcaaaactgatgcactaagagaggcagcctttgagtatcaagacctgctaaaattagaacacaaggtttcgtcgtttactgatgatccaaagcttgcatgtgaagaagctctcaagaagatgtattccttgcttgaaacagtggagcagagtgtttatgcgctacttcgtactagagacatggccatatcacgctacagggagtatggaataccggtggattggctgtctgattccggggtagttggcaagatcaaattggcatctgttcagctggcgaagaagtatatgaatagggttgccacagagctagatgccttgcaaggcaccgagaaagagcccaacagagagttcttgcttcttcagggtgtgagatttgctttccgagttcatcagtttgccggaggctttgacgaggaaagcatgaaggcgtttgaagagctaagaagcaagatgtgtacaacacagacatctgctccacaaatttcatagctctaaccatgcatgctgcattccacagttgact

SEQ ID NO: 370 - DNA, 881 bp, Oryza sativa
ttgccatggcgagagcgttccgcgcggcctcgccgctgccgctgccgtcctccagctccagggcggccgcggcgagcggtggcaccggcggaggcggaggcgggaacttcccgtggctgagcaggaagcggctgggcgccaagccgccgtcgccgcagcggcgaggtggacaggagagggagggaggtggagatgaggcggcggggatggggacgacgacgagggccgcgcggttctccgcgacgtcgtccgcggagcctgctgaggtgcagtcgtcgtcgtcgtcgaggaagcgcgcggacgcgctggcgaggctgcgggcggcgttcctggcggcgatcacgcaccggcggcggcggcggcagctggggtcgagcctgacgggcaccatcttcgggcggcgccgcggccgcgttcacgtcgcgctgcagacggacacccgctcgccgccggtgctgctggtggagatggccgcctactccaccggcgcgctcgtcagggagatgtcctccggcctcgtccgcctcgcgctcgagtgcgagaagcaaccaatcaacccaggcgagaagcggcgggcgctgctggaggagccgacgtggcgggcctactgcaacggccgaaagtgcggcttcgcggtgcgcagggagtgcggcgccgacgagtggagggttcttggcgccgtcgagccggtgtccgtcggcgccggcgttctccccgacgacgccgccgccgccgccgccgccgaggagggcgacctgatgtacatgcgcgcgaggttcgagcgggtggtcgggtcgagggactcggaggcgttctacatgatgaaccctgacggcagcggcggcccggagctcagcatctacctgctcagagtctgataa

SEQ ID NO: 371 - DNA, 1585 bp, Oryza sativa
aaactcgagttgggcgatggagaaggagaggaagcaggggttcttcgcggcgctgaaggaggaggtggtgcgcgggctgtcgccggcgaggtcgcgggggaagtcgccggcgaggagcgcgtcgccggggaggatgctgatcccgcgccgccgcaaggagaagcagcagcagccgccgccggagaagctgctgcagcagtacttcgcggagccgctcatctcgcggtcggggagcctgcggcccggaggggaggccctcgcgcccctcattgaggggcccgacccggagcgcctcgccgccgggggggacttcgccggcggggaggagtcggcgcggcgggaggggttcggccgatgggtccgcggccagctggcgcgcacgccgtccgtggcgtcgtccgccgccgccgccgccgccgccagtcccgggggttcgggcgactcgttccgccgctccgacctccgcctcctcctcggcgtcatgggcgcgccgctggcccccatcccttcgaagctagcagatcccctgcctctcctctccatcaaggggacccccattgagtcgtcgtcggcgcagtacatcctgcagcagtacatggcggcgtcgggcggctaccggctgctgcagtcggtgcggaacgcgtacgccatgggcaaggtgcggatggtggcgtccgagttcgagaccgcgacgcgcgtcgtcaagaaccgcgggcccagcggccgcggcgccgcctccgtcgagcaggggggcttcgtcctctggcagatggcgcccgacatgtggtacgtcgagctcgccgtcggcggcagcaaggtgcacgcgggatccaacggccgcctcgtctggcgccacacgccgtggctcggcgcccacgccgccaagggccccgtgcgcccgctccgccgcgtcctccaggggctcgatccgctgacgacggcggggctgttcgcggaggcgcggtgcgtcggcgagaagaaggtgaacggcgaggactgcttcatcctcaagctgtcggccgacccgcagacgctgaagcagcggagcgaggggccggcggagatcatccggcacgtcctgttcggctacttcagccagcgcaccggcctgatcgtgcacatcgaggactcccacctcacccgcatccagccgcactccggcggcgacgccgtctactgggagaccaccatcagctccgcgctggaggactaccgccccgtcgagggcatcatgatcgcgcacgcggggcgctccgccgtcacgctgttccgcttcggcgaggccgccatgagccacaccaagacgcggatggaggaggcctggagcatcgaggaggtggcgttcaacgtccccggcctgtccgtcgactgcttcatcccgcccgccgacatccgctccggccccgtcggcgagtcctgcgagctgccgccgccggccgcggcgccgcacggcgagcgcgccaggcacccggcgcgcgtcgccgccgtggaccgcgcgcctccccaccacaatgccggcggcgccaacgtcggccgccgcggcgacaagatcatgtggagagtggaagtgtgatgagaattcaaa

SEQ ID NO: 372 - DNA, 954 bp, Oryza sativa
aaactcgagcacttcctccctccaatcccgcgcgccgccgcgatggccccgaagagaggcgcgaaggcgccggtgccggcgaggaagaaggcggcggcggcggcggcggcggtgaacccgctgttcgagaagcggccgaagcagttcgggatcggcggcgcgctcccgccgaggaaggacttgcaccgcttcgtcagatggcccaaggcggtgcggatccagcgccagcgccgcgtcctcaagcagcgcctcaaggttccacccgcgctcaaccagttcacccgcaccctcgacaagaacctcgcaactaatctattcaagatgctgttgaagtaccgccctgaagataaggctgccaagaaggaaaggcttttgaaaagagcgcaagcagaggctgaagggaagactgttgaagccaagaaaccaattgttgtgaagtatggtcttgaccatgtgacctatttgattgaacagagcaaggcacagcttgtggtcattgctcatgatgtcgaccccattgaactcgtcgtttggctcccagccttgtgcaggaagatggaaatcccttattgcattgtgaagggaaaggctcgtcttggatcgattgtgcacaagaagacagcatctgtcctttgtctgacgactgtgaagaatgaagacaagttggagttcagcaaaatcttggaggccattaagtcaaacttcaacgacaagttcgatgaggtcaggaagaagtggggtggtggtatcatgggctcaaagtcacaagccaagaccaaagccagggaaaagcttctagccaaggaagctgcccagaggatgacctaaagaactagcctgaaattttgcgttgtggttgttactaggaacacattgtgatcttataacttcggtctgcagtgtagtatgcttatagttattatgtggatgtggaccttgagtgtagaattcttt

SEQ ID NO: 373 - DNA, 2531 bp, Oryza sativa
gttggttggttcaagaatttcgttcaagatgatgcagaggccgttccgtccggaggagtactccttgaaggagacttctcctcaccttggtggtggagctgctggtgacaagctcaccaccacctatgacttggttgagcagatgcagtatctttatgtccgggtagtaaaagctaaggaccttccaagcaaggacatcactggaagctgtgacccatatgttgaggtgaagcttgggaattataagggtacaactcggcatttcgagaagaagactaatcctgagtggaaccaggtctttgccttttctaaggagcgcattcagtcatcagtggttgagatcattgtcaaggataaggactttgtcaaggatgacttcatcgggcgggtgttgtttgacctgaatgaggtcccaaaacgagtgccacctgacagcccattggctccacagtggtatcggttggaagagcggaatggacacaaggtgaagggagagttgatgttggccgtttggatgggtactcaagcagatgaagcattccctgaagcttggcactctgatgcagcgtcgatcccaggagatggacttgcaagtattagatcaaaagtttaccttaccccaaagctttggtatctgagagtcaatgtcattgaggcacaagatcttataccaaatgacaggaccaggttccctgatgtttatgtcaaagccatgctaggtaaccaagctcttagaacccgggtatcaccaagccggacgctgaatccaatgtggaatgaggatttaatgtttgttgctgctgaaccattcgaggaacacctgattctgagtgtagaagataggattgccccagggaaggatgatgtacttggaaggacaatcatttctctgcagcacgtacctcggaggctggatcacaagttgctgaacagccagtggtacaatcttgagaagcatgtaattgtggatggcgagcagaagaaagagaccaaattttcaagccggattcacttgagaatatgcctcgaaggtggatatcatgtcttggatgagtcaacacattacagcagtgatttgaggccaactgctaaacagttatggaagcacagcattggcattcttgagttgggtatcttgacagcacagggcctgttgccgatgaagaccaaggatgggcgtggaacaactgatgcttattgtgttgctaagtatgggcagaagtgggtgcggacaaggactattattgatagtttcacacccaagtggaatgaacaatacacttgggaggtgtatgatccctgcactgtgatcactattggtgtatttgacaattgccacttgaatggtggggaaaaagccaacggtgcccgggataccagaattgggaaggtccgcatccgcctctctacgctagaaactgatcgagtatatactcatgcttaccctctgattgttctgacacctgctggtgttaagaaaatgggggaggtgcagcttgctgtcaggttcacatgctcatcactgctgaacatgatgcatctgtattcacaaccattgctgcccaagatgcactatgtacacccattgtccgtgatgcaggtagacaatctaaggcgccaagccaccaacattgtatcaacaaggctgagccgtgcagaaccaccactgcggaaggaaattgtggagtacatgctggatgttgactctcatatgtggagcatgcggaagagcaaggcaaactttttccgtatcatgggtgtcctaagccctctgattgcggtggccaagtggtttgatcagatctgccattggagaaatccgctgaccaccatactgatccacattctctttgtgattttagtcttgtatcctgagctgatactgccaacaatcttcctctacctgttcctgattggagtgtggtactaccgctggcggccaaggcagccacctcacatggacactcgcctctcacatgcggagagtgctcatcctgatgagcttgatgaagagtttgacacattccctacttctcgtccgcctgacattgtgaggatgcgttatgaccggctacggagtgttgctgggaggatacagaccgtagtcggcgatctcgcgacacaaggagaaaggctgcagtccctgctaagctggagagacccaagagccacggcgctctttgtgaccttctgctttgttgctgccattgtcctctacgtgactccattccgtgttgtggtcttccttgcaggcctgtacaccttgagacacccaaggttccgccacaagatgccctctgttcctctgaacttcttcaggaggctccctgcaagaactgatagcatgttgtaagctcgactgcctcatgctatgctatcgagctgcccaggcgatggctgcaatgcataagaaattggagaaacctgaactcttatctattctcttttttgtagtctatcagttgcatggttatgtatgtcttcaggtggttttgaacctttcatgtaactgctgaacgcattatgtgact

SEQ ID NO: 374 - DNA, 431 bp, Oryza sativa
tatagcggatcttctgggtctctgatcctgtgaatttcgggaatttttgtgatcgatcgatcgatccatggcggggctgcagcggtcgagcgagacgttccggcggtcgggctcgtcggggctcgtgtgggacgacaggcacctgtccggggagatcaagccggcggacggcggcggcggcggcgcggcggcgagggtggagcgcagccggtcggccgggcacggcgggtacagggcggcggggcgcgtccagccggcgctcgacccgccgtcgccgcgcgtcgccgtgtgcggcttctgcaggttcttcggcggcagcggcaagggcgggaggagcggcggcggcgccgccgccgccgtcgccggcggcaaggccaaggctaggcgccactcgtcgtcgtgatccgtcgagagctagagcgactcatcgt

SEQ ID NO: 375 - DNA, 1156 bp, Sorghum bicolor
ttagacaacgacccaaaccaaccagcaaccatggctggtggtgctcatcaacaggtggtggttgtgctcgctatggtggcgctcatggtgacggcggccgagggtttcatctccaagaagacatggagcgccatccggcgagcggaccgcgacggcccctttgtggggctggtggtgcccaacacctacgagatggaccccgtcctaagctctcctgacttcaagcctagcaacaacatccccattctagatgtccaagggcgacgattccgcttcggaactattggaagccaaaacgttgtcatggtcatgactgggctgagcatgctgaatgcagggctcaccacccagctgctgctgagcctgttcagggtgaaaggcatcgtccactggggcatcgccggcaacgccaacgaggaccttcagatcggcgacgtgaccatccccgagtcctgggcgcacctgtccctgtggaactggcagaggcacggcgatggtgcggagaacgagctgccgctggagagcgccggcgactacacgagggagtacggcttcctcaacttctccgactacactgtcggccaggccaacccggagctgtcggcgaacactctgaacagcgtgtggtaccagccggaggagatcttcccgatctccggcacgccggaggagcggcagcacgcgttctgggtgcccgtcagcaagcgctactacaggctcgccgcgaagctggaggggatggagctgccggcgtgcgtgaacgagacgacgtgcctgccccgtgcgccccgggtgacgcgtgtgcccaggggttgcagcgccaacatctacaccgacaacgccagctaccggcagttcatccgcgctcacttcgggtgcacccccgtggagatggagagcgccgccgtggcgctcgtggcgcaccagcacggcgtccccttcattaccatccgctccctctccgacctcgccggcggcggctcgtctctcagcaacgaggccgccacgttccttgacatcgcggccaagaacgccgtcgacgtcatgctcaagttcgtgcccctccttggccgcggtggcgagcaggagcaggccgacggtctggcccaagacatgtaatgtaaggcgggccaggagacagatagacgacgctgag

SEQ ID NO: 376 - DNA, 1322 bp, Sorghum bicolor
cccaaatggaggacccaccagcgcttgctccgccggagccggagccggagccggagcccgaggcctccccggcgccgccgcaaaggctgctgcggctgcgctgcgcggtgcagcactacgagtggggccagcacggagccgcctccctcgtcgcgcgcctcgccgaccagaaccccgacccggctcgcccctacgccgagctctggatgggcactcacccgtccggcccctccacgctcctcggcgacggcgcgctcctcagggactggctcgcgcggaaccccgacgcgctcggccccgccgtcgccgcgcgctggggaggcgacctcccattcctcttcaaggtgctgtcggtggccaaagcgctctcgatccaggcgcacccggacaagaaactcgccgaggtgctgcacgcgctgcggccgtccacctacaaggacgacaatcacaagccggagatggccatcgccttcacggagttccgggcgctttgcggctttgcccctattgaggagctcaaggatgtcctgaggacagttcctgaaattgaaggcctaattgggcatgaagatactggcaagctgatgaacatgaaggagtatgatggggttagtgaagtaaagtccagtttgcgatcagcttttgctaagctaatgacagcaagtaaagacatggtttctgaagcagttgcaaaactgatcagtcgcctgaatactgacagcaagattaggaacttaacagacaaagaacagctggttttgtccctggagagacaatatcaagacgatgttggagttctagcagcacttttctttaactatgtgaagctcagtcctggtgaagcgctttatattggtccaaatgaaccgcatgcatacctctctggggaatgcattgaaattatggccacttcagacaacgttgtacgtgctggtttgacacctaaatacagagatgtgcaaactctctgctcaatgctaacatacaaacaggccttcccagaaattttgcgcggagttcctgtgcagccacacgtaaggcgctacacgccaccatttaacgagtttgaggtcgattgctgcttggttcctccaggtgaactgcttgtcatatccccggtaccaggaccatccgtatttctcgtaatgaccggggaaggcgagattcagttggattctatgtcaggtggagaaaaggcaaaggaaggtgatgttttcttcgttcctgcatacactgaggttaagatctctgcgtgtggccccgagtctgtgctgctgtacagggctggggtaaacagcagattcttcagctaactggcgtga

SEQ ID NO: 377 - DNA, 1897 bp, Sorghum bicolor
gagcattccaccactttgctacccaccacacttacacgtagctagctagctactcagtgggtgtaggcgtgtagtgtagctctcagagctactagctagacctcgccgtccggcgatcaccatggcggcgaagaagcagctgccgcaggccgtcgcggccgcctccggccacaccaagatgggggaggagaagctgatcatccggtcggagaaggtgaggttcatcgacgtcctgtcgatgctgttcctgcgccgccccatcaccagctacgcgttcgtggaggccggcgaccggaccgccgccgacttcggcagcacgccgggcgactggctcgtcgcgctcacgcagctcatccagaaggcgctcgacgccgcctactacccggcgctcgtcatcggcgccgtcgtcgagttcctcctcaacttcgtcgccctcaacaatggcatactcggcatctttctcaacatcttcagatgtaagctggtgatcccacaccgtgacgcgcccaacttccggtccatgatcgggctcatcgacggcaggacggagctgaagccgctgccggccggcggcggccctgaagaccggcggctgcaggtggtgggcgtctccgccgctggcagcgacgactactacgtcaacgtggagagcggcggcggcggcacgggcacggcggcggtgccgctggtgcagcagcagtacgtgaacgggcggctgatccggctgcgcaccttctcggtgttcgaggtgagcatgatggccgccaagatcgcctatgagaacgccgcctacatcgagaacgtcgtcaacaacgtctggaagttccacttcgtggggttctacaactgctggaacaagttcgtgggggaccacacgacgcaggcgtttgtgttcaccgacaaagcgaacgacgcgagcgtgatagtggtatcattccgtggcacggagcccttcaacatgcgtgactggtccacggacgtgaacctgtcatggctaggcatgggcgttctgggccacgtccacgtcggcttcctcaaggctctcggcctccaggaggaagacggcaaggacgccgccaaggcgttcccgaaagccgcgccgaacgccgtcgccggcaagcccttagcctactacacgctccgcgaggagctccgcgcgcagctgaagaagcacccgaacgccaacgtggtgatcacgggccacagcctgggcggcgcgctggcggcgatcttcccggcgctgctggcgttccacggcgagcgcgacatcctggacaggctcctgtccgtggtcacctacgggcagcctcgcgtcggcgacaaggtgttcgcggcgtacgtgcgcgggaacgtgcccgtggagccgctccgcgtggtgtaccgctacgacgtcgtgccccgggtgcccttcgacgcgccgcccgtcgccgagttcgcgcacggcgggacatgcgtctacttcgacgggtggtacaagggacgggagatcgccaacggcggcgacgcgccgaacccgaactacttcaacccgaggtacctgctgtccatgtatgggaatgcgtggggggatctgttcaagggcgcgttcctgtggaccaaggagggcaaggattacagggagggcgccgtctcgttgctctaccgtgccactggactgctcgtgcccggcatcgcgtcgcatagccctagggactacgtcaacgccgtccgcctcggcagcgtcgtcgtcgccggcaaggaggaggaggtcgtctgatggatgaagatgagaggttttgctagcttttggatgttgtggctgcgtgtgtcgatctctgtgtatggatggactgtgcagcgcgagaggaaatcaagcatatgtaccgtgtgtctgtgtgttcatttccacgtacgttag

SEQ ID NO: 378 - DNA, 443 bp, Sorghum bicolor
aaccctagagtctctcgcacggcctgcgcatcctaaagttgacaatggctgctgttgtggaggtcacgtttgatgcacaaaaacatatcaatgtctccaaggggtctattgttggtgaggatggtggtattggataccttgtgtaccccatgcccccagctggcacttttgacctgtccactgacaaggaattactcaagaacatcaatcaagagctcgtcggttgtaaaggaggtgataacgcccgtgcaggcagcccaaagacactgcgtaaggctcgcgagaaagctgttcgcagggcctttctggcctatctagggcagtaaatgcatttgaacattgtctcaacaaatctgagtattatgtgaataacacgtatgatatgtgctggaagtagcaggggttaacccagtgcgccgggtgaacaagtatggaatgaacaa

SEQ ID NO: 379 - DNA, 395 bp, Sorghum bicolor
gcgacatcgaatttcagagccgcccccgcgagatcccggccttcgttctcttcccccgagaggtgccgcaatggctgggaaaggcgggccgaccaacttggagaaggagcagatgtttgggatggcagagaaggagatggagtacagagttgatcttttcaataggcttacacagacctgtttcgacaagtgcattgagaaaaggtataaagaagctgagctcaatatgggcgagaacagttgcattgatcgatgtgtttcaaagtattggcaggtgactaatttagttggtcagatgcttgggaaccgtcctcagatgtgaactgagaagcactagttccattttgtagctattgctctgtttcttctttttggttggctttagagtgcctaca

SEQ ID NO: 380 - DNA, 693 bp, Sorghum bicolor
aaagatatcaggatcagcgatgccttcccctacgccgcctccgatgtccacgccgcacaagtcctgctcgtcgccgtcgccgccaccgccaaagctgcagcgtgctccggacatccggcacaggcctatctgcggcggagcctgcaggctgccgatcaccaggagagctcacgccgcatccctcctcctcctcggcctcgcgccggcgccggcgccggtcagggcggaggaggatgggagcggcggcgaggagggcgtcctcggcgccatcaagtccatcttcgaccccaacgagaagaccaaggccggcaagacgctgcccaaggcgtacctcaaggcggccagggaggtggtgcgcacgctccgcgagtcgctggaggaggacgacggcggggacatggccaggttccggcggaacgccgacgccgccaaggagtctatcagggagttcctgggcggatggagaggccagcagaccgtcgccgccgaggagtcgtacgtcgcgttggagaaggcgatcaggtcactggcggagttctactccaaggcagggccattcgcgccgcttccacaggacgtcaagaacaagatcctcgatgatctcagcgccgcagacgcctgcctgtagattttgcttctccaggggcattgtattgcatgcacatctcaaccatgatgatttcggaattcttt

SEQ ID NO: 381 - DNA, 1271 bp, Sorghum bicolor
caaggcatcaaccatcaatatcgatcgaagacaccatggcagccaacggcaagagcagcttggcgaacggcgcctcctccacccagggaaagcccatcaattgcaaagcggcggtggcgtgggcgcccggcgagccgctggtgatggaggaggtggaggtggcgccgccgggtcgcctggaggtccgcgtgagggtgctcttcacctctatctgccacaccgatctcagtttcttgaaaggagagaacgagctgcagcgcaagttcccccgcatcctcggccatgaggcagccggagtggtggagagcgtgggggaaggggtgcaagacctggcccccggcgaccatgtggtccccatcttcaacggggagtgcggagcctgcgcgtactgcgagtcggacaagaccaacctgtgcgggacttaccgcgtcaacccattcaagagcaccatgtcctccgatggcggcacgaggttctccgtggtggaccgcaactctgggctgcggcagccggtgtaccacttcctcaacacctccaccttcgccgagtacaccgtgcttgacgcggcctgcgccgtcaagatcaaccccaaggccccgctccacaaaatgtgcctcctcagctgcggcatctccacaggagtcggggctgcatggaacacggcaaacatttccgcgggcaacaccattgcaatattcggccttggcgctgttggtctcgcggttgctgagggtgccaagctacgaggggcagctcggatcatcggtgttgacgtaaaccctgaaaagtttgccaaaggcaaagacatgggcgtcacggacttcgtcaactccaaggcctgtgacaaaccggtgcatgaggtgatcagggagatgactgacggagctggtgtcgactacagttttgagtgtaccggaatcaacgatgtgctgagagaggccttcctgtccacgcatgatggttggggcctgacggtcgtgctggggatccacgcgacgcccaagatgatgccgctacacccgatggagctcttcgacggccgccggatcaccggctgcgtctttggtgacgtcaagggcaagtcccagctgccagccatcgtcgacaagtacgtcaacggggacctgaatataaactttgatgggttcataacacacaacatgcccttctcggacatcagcaaggccatccagttgctggaggaaggcaagtcccttaggtgcgtgctccatctctgatgggccaagcatgggagattattgtccttgtag

SEQ ID NO: 382 - DNA, 1423 bp, Sorghum bicolor
agctcctaagctaaaggaaaggtaaccccacccccgcccccaacctccaccatcgcctgatcggccggccgatcgatccccacctccgggcgcttcctcctcctcctcacccccggcgcggcgttctatggcctacacctcctctctccacctccccaagcacctcctccttcccagcccccgccggacaaggcaccgcaggccctcctccttcgtccccgtctccgcggctgccaacaagatcaacggcggcgtgaacggccatcacgcgcccgagaagccggcgttgcccaacggcaaggcgccacagcacatcaacgggcacgtcaacggccacggcaagaagggcgtcaacgggcacgtcaacggccgccatgcgggcaacaaccggatccacctctcggtgagcacgggcggcggcgggggccaggatgggtccgggctccgcgtggcgttccagggcgcgccgggcgcctacagcgagttcgcggccaagacggcgctgcccgggtgcgagacggtcccgtgccgcgccttcgcggacgcgctggcggccgtggagcgcggcgccgccgaccgcgccgtgctccccgtggagtccaccatggaaggcaccgcgctgcggaactacgacctgctcctccggcacggcctggtggtggtgcaggagatcaacctcttcgtgcactactgcctgctggccatgcccggtgtccgcgccgccgaggtgcgccgcgtcatcagccacccgatggcgctggcgcactgcggccgcgcgctggcccggctcggggtggacccggagcccgtggaggacacggcgggcgccgtcgagatgctgcgctcgggacggatgctcgacaccgccgccatcgccagcccgcgcgccgccgacctgtacggcctcgacgtgctcgcgcacgggctccaggacgagtcctggaacgtcacgcgcttcctgctcctctcaaggccgtcggccgtcgccgcgctgcccgtggacgccgccgccggcggtgccaccaagaccagcatggtggtggcgcaccggggcggctccatgatggtggtgctcaaggtgctctccgccttctcctcccgcggcatcaacctcaccaagctggaggtcatcaacaacgacggcgccgcggctgccgacgccggatctggcgcgcgcccgcccgtggtgatcctggacacgagcgccaggggcaagccgacgctgcgcgcgttcccgcacgtcctgtacgtggactgcgagggcgccgcgcacgacccgcgcgtccgcgaggccatccaggagatcgagacgttcgccgtcttcgtgcgcgtgctcggctgctacgccgccgactccaccgtctacgacctgcagtgacgaatttagcttagccagtctgccgtgatttcctcgctgttaatt

SEQ ID NO: 383 - DNA, 2074 bp, Sorghum bicolor
cttgtgactcgatccgatcttctctgttcctccttggccccctccccaaatccaccgccatctccgagccctaaccccaacctcgaccgcccatggccgccaccgcggcctcctcggccgccgccgacgccgcgtcgaactccgatgaggaagcaaactatgaggagtacatcccagtcgccaagcgccgggccatggaggccgagcgcctccgccagctccgcctcaacaagtcggcgccgacctccgccgcctccaccctcccgctgccgcctcctccgcctcttttgccggcgcaggcctccgttcccgacgccgccgcgaagcccagcctcctcgtcaaggccacgcagcttaagcgcgccgccccggaggtgaccgccacggagcagcgcatccagcaggagaaggaagtgattgagaatctctcagacaacaaatccctcaggtcagtccgtgagatcgccaagggcatcatctacacggactcgatccagaccgggtggaagccgcccctccgcctccgccgcatgccgctcgccaaagccaacgagctccgccgcaagtggcatatcatcgtcgatggtgacgatgtcccgccgcctgcgcgtgattttcgggacctccgcctcccggagcccatgctccggaagctgcgcgagaggggcatcgtccagcccacgcccatccaggtgcagggtctgcctgttgtgctctctgggcgtgacatgataggcatcgctttcacggggtcggggaaaactctggtgttcgtgctgccgcttatcatggtggcggtgcaggaggaaatattgatgccgattgtgcctggggagggcccgtttgggatgatcatatgcccgtcgcgggagctggccaagcagacatatgatgtgattgagcagtttctcattccacttaaggaggccgggtacccggagataaggcctttactttgcattgggggtgtggatatgaggacacagctcgatgtgttgaagaagggtgtgcacattgtggtggcaacgcctggtcggctcaaggatttgcttgccaagaagaagatgaaccttgacaactgcaggtacttaaccttagatgaagcagataggctggttgacctaggatttgaggatgacatcaaggaggtttttgaccatttcaaggatcaaagacagacccttcttttttctgctactatgcctcagaagattcaaaattttgcgaagaatgcccttgtgaaaccagttactgtcaatgtgggaagagctggagcagcaaatctagatgtcattcaagaagttgagtatgtcaaggaagatgctagaattatatacctccttgaatgcctccagaagactccacctcctgttctcattttctgtgaaaacaaagctgacgtcgactacatccatgagtaccttcttctaaagggagtggaggctgttgctatccatggaggaaaagatcaagaggagaggcagaatgcaattgactccttcaaaactggaaggaaggatgttctggtggctactgatgttgcatcaaagggtcttgatttccctgacatccagcacgtcattaactatgacatgcctgctgaaattgagaactatgtccaccgaatcggtcgaactggtcgatgtgggaagactggcatagcaactaccttcatcaacaagaatcaaactgagaccacgcttcttgatctcaagcacctgctgaaggaggcaaagcagaggattccaccggtgctggcggagctcaacgatccattggaggatgaggaaataattgccaaggagagtggtgttaaaggttgtgcttattgtggtgggcttggccatcgtgtcagtgactgtccaaagctggagcaccaaaagtccatggcaattgctggctcgagaaaagactactttgggggcgggggttaccgaggagaaatatgattgctctaggttgatgcttgtgtgtggttatcaggagctaagatgctgcaacttcagctcaaacatgttacatgtatcagctagccaaggctcctccctcgatgttgaaggaagacgcatcgtat

SEQ ID NO: 384 - DNA, 2874 bp, Sorghum bicolor
cacaacatactttcctccggtcccgttcggcggcgaggctccgatcgagcaacgtcgtcgcgcctgtccatgccggcgccgcggccgtaagggcggtcgatcgagcgaggaagagagagctagcgcgagcgcgggagcagccatggcggcgtcggcggggaagctggcggcagcgctccaccggaggacgcgcagggtcacgtctgcgctggcgtacgcggccctggagtgggtcctcatcgcgctgctcctcatcaacggcgtgctcgcctacgccatcgccaggttcgcggactacttcggcctcagcccgccgtgcctcctctgctcccgcgtcgaccgcctcttcctccaggcggaaggcggcgatgccgaggctggcgccgcgcggtggctgcgggacgcactctgcggcgaccacgccgcagagatctccgcgctggggtactgcctccgccaccatcggctcgcggaggccggagagatgtgcgacggctgccggtccgagtggaaggagaagacgagcgatgctgcaggtgcgtgtacctgctgcaaagctatcgtacggacttctttgcgcgagcaagaagatacaattacaagggatcaacatgtcttggagaagataaccgaggaagtagaagacgacgatcagggctatgttcttctggctcaagatgatcacgaagaggacgaggaggagccggatgaggtcgagagccaagaacaagaacagcagagcgaggtggaaggccaacagcaagaagacgaggtgatggcttccgttcaggatgaatccttggaattcatggatcaggtcgaagacatcaccgcgatcggggacgaccggttggtgtcggtggtggcgcttgatgagatgacgatcgccgatgattcgggtcttcatcgggatgttgaagaggaggacggagtgaatcgtgtagtagaagatgagcaggattcgagggatgtggatatcggagtggttctggaggagaagaggatgttggattcctcggttgcaacgccggctgatgtgatcgaggactctgtcatgcccatcagccccgtaccttgtcctgagattttaacaaacccatctcatcctgatcataactccatttcccaagatgatggagatgttcctgaagatactgctgaaattggcgattccacggccgaggaagaacacatctttgtgcctcaagaagccaattttgaagatgacaacagaacagctgaggtggacacgaactgcgaagtatcaatcggaagcgatatatgcgaacgggaacaagatgaccatgtcgttccatttcaagatttggcagcatttgaggagccggtttctccattgtcagctgcagatgatctgccattgccattggagattctagacccaactgagcaagaagaagctggtgaagttgagcaggaggaggtgacgacgagcacgggattggacctccaaccaaacgagcagagcgagatcgaagaagacaaagcacctgagacaccgacgaacagcgccgctacacaacgctccgacagaatgtttctgctcgagaggaaacggtcgttgtcgctgtctctggatgggagcgtggcgagcgagatggaaggcggcgagccttccaccgtggaccagctgaaatcggcgctgcaggcggagcggaaggcgctgggcgcgctgtacgccgagctggaggaagagcggaacgccgcggccatcgcgacgaaccagacgatggcgatgatcaaccggctgcaggaagagaaggcggcgatgcagatggaggcgctgcagtaccagcggatgatggaggagcagtccgagtacgaccaggaggcgctgcagctgctgaacgagctggtcaccaagcgggagagggagaagcaggagctggagagggagctcgagctgtacaggcagaaggtgcagcactacgaggacagggagaggaggaggacggcgagcttcaaggccaatggggtaagcgtaagccccagtggcagtggcacttccgtgtcctccagcggcgaggaaagcgacgggcattccgacgactactgcgagctcggcgagtctcccgacgtcggcaacgttcagagctcatcggatgctgcacttggctccatgagggatcaggaaggcaccaagcacctagcggctctggatgattccttgacgtactttgagatggagagactttccatcttggaggaactcaagacgctggaggagaggctcttcacactggaagacgatgataccaacaccggcaaacaagctattggccattcctcgattgatttcgatttgtcggccggtggccttcagtcgcctgattatattctcagcggtgacaaggcaagaatcggaggaagagcctctatcagtagagggaagagccttctgcctctgttcgatgcagtcggcgacgagacctgtgaccaaatgccatctgcaggagtaggagaggcagatcaagacgatgattcggcaacaaagccggtgtcggtgcttgtcaaagagcaggagaggctggcaatcattgaggaagttgatcatgtctatgaaagattgcaggcgctggaggcagacaaggaattcctgaggcactgcatcaaatccctgaagaagggagacaagggcatggaccttctccaggagattttgcagcatcttcgcgatctccgcaatgtggagcttcacgtcaagaatgccggtgatgccatagctgcaaattcagcctagcaagttcgtctataggaggtaatgattaccctagcttggtatcgattgagtagactggattggagtaatccaaggcactgcattggtgatggtccctggaaggtactgcctgatta

SEQ ID NO: 385 - DNA, 2161 bp, Sorghum bicolor
aaaggatccgaggcgactgcgagctcggcggaggcgatggacggggaggaggaaagggaggaaggggaggtgggggagtacaagctgcagagggtggtggggaagggctcgttcgccgaggtgcaccgcgcggcgcaccgccgcacaggcgcgcgcgtggcggtcaaggcgatcgaccgccgccgcgtcgacaagcgcgtccacgacggcatcctgcaggagagggagatcctcaggagcatcgaccaccccaacatcctccgcctcctcgacaccatcgacacgaagaagatgatgtacctggtgctggagtactgcgacggaggcgacctcgatgcgtttctgcacaagcacggccggctgccggaggccatagccaaggacttgatgcggcagcttgcggaagggctgaaggtgctgagggggaggaacatcgtgcaccgggacctcaaaccacagaaccttctcctatcaaccaatggtgatgccatcgtattgaaaattggtgactttgggtttgccagatcactggtgcatgaaaatttagctgccacaatgtgtgggtctccatattatatggcaccagaaatttggcaagggaaagactatgatgcaaagtcggacttgtggagtgttggcgtcattctttttcagctagtcacagggaagctgccattcaccgggagtaatgcttttcagctgcaccaaaatatcctggctgccgatgatcttaacttcccttcagaaattgaagctgatttatgtgctgattgcattgatttgtgcagaagactcctgcaacgtgatccaaaggagagaataagttttgaagaattcttcaatcacaagtttttggcaacaaggaaatgcgatgaatcctgtcaggctatagagttaaggaataactgccagacaatcacctctcctgttgtcctaaaaacaaagtctgaaagcattgaatcaaaaaattcgaaagtttttgattcatgggaatggattgaacgagaatatgtgcttgttccggtaaactgtacttctatggaaatgtcttcactcaacatcaacaagtccacaaaggatgatacagatataagaactgccagctatgataggcccgctgccaaagggtctgctcaaaatcaaatcagagacttaactgatacagctactggtatacaaagccatggatgtgctcctgtgctcatttcccaggagtcagccactgtggactgtagacgagggaagctacctgattatattacaaggtttcattctctgaatcaatatgtgcttgttcttacggaacttgctcgggaaaagctttctaaaggcctgtacttggaggcgctatcaattgaacttgtattattagctatctggaaagaggcacttgatgcatgtagcttactcatggatgcatcagatggtgaaaatttctctaaatcttctcaagaacattcccttcctatgagtggccactcacctctgaatgtagtgcgagggttggatttcactaggacggcttctgttttttcctgggttgaaagtgggttcatgaaggcatatgatcgtgcagagaagatatcgcatgtattgcggaagagtgacgataataccgagatgccagatgcaatggatgtcgtattccaaactgctttggaatatgggaagactggagctgcaaatgaagttttgggacaccaaagcagatccacagcgctatactcaaagtctatcatcttgctcacatttttagtacaggaagcacctatgttgccactaaatccaccgctttccctttcgccgtcagatcagcaacgcatccataggtacatagctaacttgaagagccatctctgctgtgctcaggttgcagggcaacagcagagatcagtttataactgaacatggttgctcaaggattgaaaagattaatttatctgcatctggtgaggttttcttgtgctctggtgcagcgttagtccagcattttatttttttttgggttctataaggaggtggggtgttcaattctttggtgtcatgaacctttgtaaaattgtagttgccgaacaccatgatccttccccctcttttgtatatagataacacctacaagctctatatggtcgtcccttaccatgcatatgttggtaccttt

SEQ ID NO: 386 - DNA, 1141 bp, Sorghum bicolor
ctcctcagctttaagcatcctctgcggcgcaacggccacacctcctcccccgacctccgctctcctcgccgctcgccgccatgaacaacctcctcacggattcctttgagctccctcggcgggactcctcaagagatgcggacattgaaatgggaatgcatcaggctgatgcttcagacaacttaaaggatttcttgaagaaggtcgatgcaattgagagtttaattgcaaagctgacaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaaaagataacttattgaataggcaaaaacctggatgtggaaagggttctgccgtggaccgatcaagagagcagactactggagcagtaaaaaagaaattgaaggagcggatggatgattttcagaccttgagagaagcaatcaggcaagagtatcgggaggttgttgaaagaagggtttttactgtaactggtaatcgtcctgatgaagagacaattgatgatttgatagagactggaaaaagtgagcaaatattcaaagatgctatccaacatcagggaagaggccagatactggacacagttgctgaaatacaggagcgacatgatgctgtaagggatctagagaggaagcttttggagttgcaacagatattcatggacatggcagttcttgttgaggctcaaggagacatgatcaacaacatcgagacacatgtctcgaacgccaccaatcacatacagcaaggtgtgaccgcactccagagcgcgaagaaactgcagaagaattcgaggaagtggatgtgctatgccatcatcctactgctggtgatagtggtggtcattgtcgtcgcggtcatccagccatggaagaagggctagcgtggttccaaacagggaggagggcatggcatgggatataccttgttgccctttttgctgtttgtgtaatatgtgtgcagttttttgtggggtgattcgtgatttattatatcgttgtacctatggtcgacacatcagaagctttggca

SEQ ID NO: 387 - DNA, 1436 bp, Sorghum bicolor
aaaggatcccgtctgaattcgcaaaaccagcgagcagtcagagcgaacgccgccgcggcgcccgtgtctgtgtctggcgggcgccacaccgagccaatggagcccgcgctgcgcgagctgtgggcggagtcccgggacctgctgggcctcccttcctcttctctggacgccgccgccgccgccgccgtgccgcgcgtcgacctgcccccgacaccgctcgcgttcctccgcgaccacgtttccccgggccgcccgctcctcgtctccgccgcggccacccgccactggcccgctgtgtcgctctggcccaccgcctcctacctcaccgacgcactccgctccaccgccgtctccctccacctcacccccgacggccgcgccgacgcgcttgcctcgcacccgcggcgccccggcggccccggaccctcgaggtgctttgcatccgcgcacgtccgccgcgtcgacttccctaccgcggtccggctcatcagggcatccgacccggccgccggcctggtagcgtacgcgcagcagcaggacgactgcctccgcggggagtacgcggcggtcgccggtgacgtggatgcgcacgtgccctgggccagcgaggcgctcggctgcctccccgaggccgtcaacctctggatcggcaacgcccactccgtcacctccttccacaaggaccactacgacaacatttacgtcgttgtctccggcgagaagcacttcctcctgctgcccccgaccgagcaccaccgcctctacgtccgcgagtaccccgccgcccactatgttgccgcagagcaggactccgaaggggagcatcagttgaggcttaagctggagatggaagagcccgagaggatcgtgccgtggagcagcgtcgacccgtgcccggcgtcgccggaggagatggccgtgcaggcgtcgtcgtttccgctctacttcgacgggccggctccgatgcggtgcacggtccgggcaggcgagatgctctacctgccaagcatgtggtttcaccatgtcagccagagcccggggccgaacgggctcaccattgccgtgaactactggtacgacatgcagtttgacatcaagtatgcctacttcaacttcttgaggtcgctggatatcgatggttgttcatcgggcaaagctggtgcgttggaaggtgatctagaggagaagaaagattgagatggcgggcagtcactctgattaccccctggtttctgctgaacatcatggagatcaatggtttctgctgtgtcaggctgagtttcttgcggccattgtcttacagagtaacagatcttcaagcatgagaagatgttgctggacacatggaaaccaattaatcggccatgtatatttgtacaacatttgcaggtgccaattggcatatcaggctcaatatggttgcaactggtaccttt

SEQ ID NO: 388 - DNA, 2287 bp, Sorghum bicolor
ttcttgcgcctagtagcctgggacggaggcatggacagcggcggcggggaggttggctcgaccggcgggaggttccccattctgcaggcgaacagggaccccgagtcgaattgggagctggatgttgccaagagcctcgaggagtacctgctcaagatctgctcaggggaggtctccggcgaggacggggcccactccgtcaactttgccgaagcggcgttattactccaaggatcggttcaagtgtacagtaggaaggtggaatacttgtactcattggtgcttcacgtgttagagttcctctcgcaaaagaagcaggatcaactggaaaatggcttggttcaagctaatcaaaacgaccctagcatgattcccagtgaagaagatgatatatttatggggttagatgatgtcccagtggaaacaaggacatctctggataacaatgtcaatcgagatgatttacaaagaaaaaatgtgaggccaccagcaaatctactggtgtttgaaggggactgtctggatagtgaagcgagtgagctagacacatatttgttagcaacatgtgatttttatggagatttccttctgctggatccttgtgatgcaccagctatttttgactttctgcaaggaaaacattctggtaaagaaaatagtgtggctcatccaggcagttcagcaccttctaaaagccgagccaatgttttcagttccccaaatttaagatcagcgggcacaggtcgtaaatcggccgctggaaaagtcctaggaggtctagatccaacccaggagaatccggaccaatcaactcaaggaaccagtccggataacaaccattggtctgatcctgtcgaacctagctttgctgatgatgttgaaatgcctaacccagattatatagaggatcctgttggagattattctgatgacgaggatccatggaaacctttgaatccacatgaacctggcaacctaaagatccggccttacaggagagtgaaaggttctccacggggggttattggcactcagaaaaagaaaactctcacatttctatttcctatggcaaagatggatggcgtcgtcatacctgaacatgctaaatcttttgaagcacagcagtgtcagcaggaggaacattatgaaaagtttttgagatcatttgaatttggagaagaaaatcccaatgtgtttggagatttgaaagatgacaatggatcaaatactggcattaattttgatgatgatgatccagacatgccaaacgacatagatgttgatcctgatgttccagcatatcctgacgagcctattgctgcaactcccaatggtacacaggatgacatagatacacatgcaagccttgacgacttgtgtcggtcacatctgaatgctctccttgccagcatcgctgaggttgaaaagcagagtgagatggatgctcgagtttcaacatggaaagaaagaattgaggatgccttggaagagcaggataaaaacccaccttttgatatcggttcatatggggagcaaattcttgacacactttcatctagaactgacaatacaggaactgcatcttttagtgagattgttagcggcagaccaaagtatgaggttgccagaacattctctgcccttctccagctggtgaatggcagaagtgttgatctggacaaaggacaagccacaaatgagttggtgtgttacacagcagagaatccattccatgtaaggctcattggtcccaaccggaggccagaaatggaggcacgctttgctcggaagagagtcaagtcgccactgcaaaatacaggcaaaagcggtgggtcctccctggcacagcatgagtgctccaagaagccgttgcataaaaatggcaagattccagtcaagacagcgatcaggcttactccagatgggaagcgaaggcgaaggtcagccactcacctaatgcagccgatcaatctggaatacagcggatgaacgccaatggcagactgactcatgggcatctagagtctgattcttctaattgttgtgacttcagtggcggcttcataggcaggacgagctgtgacctgtaagttatgacataggcgtagctagcaggtgtacatgtacaatagttcattgtgctgttttgtatgtatattggtatcagctctcaagtgtaatgctaacagggcaagaattgttggacggacttgccctttcatagcggtacagacatcgatagattcatttctatttctaattcaataaactagcactatgccgagtc

SEQ ID NO: 389 - DNA, 770 bp, Sorghum bicolor
gctccctagtcgtcgtctaatcaacaatcccgcaatccccattgcactccgtctccgctagggtttttctccgcagccgcaccacgccgccggagcagcgcgagacccgaggcgagccacgcgcgcgcgagagagatgaggctcctgacgcacaacatgctggcgtcgaacgtccggggcgcaaccaccggctacccgctgacgctggaggcgaccaagtggtgcaccaaggaggtggagctcaacgccgacttcatccgcggcctcctccccaagatcgactggcgcgcgctcgtcgacgccacccgcgcgctcggcctccccgagctcctccccgaggagcagccccccgaggaggagatcttcgccgagggcgccgccgacgtcgagggcagcgccatccgccgcatccaccacgcgctcctcgaggtccacgtccaggagggttccctcgtctgccccgacaccagccgatgcttccccatcaacaagggcatccccaacatgatgctccacgaggacgaggtctgatctgtgtgtgtcagtttcgccctggccgcttttgcttgctcacctgctcgtcatggtctgtcgcgaagggtatccacggcttgtgaacttcgtactcagtcagattgtatctgtgaagtatggaatgcagtcttgcagattgtggccttataatatgatagatagccgtgtagtactcggaattcccgttttgtgttggtaatttggtgcacgtcatgctttgttctttactgtgggca

SEQ ID NO: 390 - DNA, 1144 bp, Sorghum bicolor
actttcagccatggccaccaccgcgtccagcctcctcaagtcctccttcgcgggcgccaggctcccggcgtccacgcgcacgccgtcgtcgcccgccgtcgtggccaccccgcgcggcgccggggcgatccgcgcgtcgtccatctcctcctcgaacccgccctacgacctgacgtccttccggttcagccccatcaaggagtcggtcgtctcccgcgagatgacccggcggtacatgacggacatgatcacctacgccgacacggacgtggtcatcgtgggcgccggctccgcggggctctcctgcgcgtacgagctctccaaggacccgtccgtgagcatcgccatcgtggagcagtcggtgtcaccgggcggcggcgcgtggctgggcgggcagctgttctcggccatggtggtgcgcaagccggcgcacctgttccttgacgagctgggcgtcgcctacgacgaggccgaggactacgtggtcatcaagcacgccgcgctcttcacgtccaccgtcatgagccgcctcctggcgcgccccaacgtgaagctgttcaacgccgtcgccgtggaggacctgatcgtcaagggagggcgcgtcggcggcgtcgtcaccaactgggcgctcgtgtccatgaaccacgacacgcagtcgtgcatggacccaaacgtgatggaggccaaggtggtggtcagctcctgcggccacgacgggccgttcggggccaccggcgtcaagaggctgcaggacatcggcatgatcagcgacgtgcccgggatgaaggcactcgacatgaacaccgccgaggacgagatcgtgcgcctcacgcgcgaggtcgtgccaggcatgatcgtcaccggcatggaggtcgccgagattgacggcgccccgaggatgggcccgacgttcggcgccatgatgatctccgggcagaaggcggcgcacctggcgctgaaggcgctggggaggcccaacgccgtggacgggaccatcaaggtggtgtcgccggcgttgcgtcaggagttcgtgattgcgtccaaggacgatgaggtcgtggacgcgtgagcgcggggaggagcttagcgcgcgctctggcttcgttttttggactttgccttgttgatgactttgtccgaatga

SEQ ID NO: 391 - DNA, 1088 bp, Sorghum bicolor
cggatatggggcgccgcggctcctccgaccgcctcgaggcgctctccctcgagatcgagcgcaagctccagaaggctctggtctccaactcccagcgtcttcagatacttcagcaattgtttgctgacattgcattgaaggtcgatgatcgtgctcgagatgcgattatgagtgagaatgatgatggcattgctccagtagatgaacgggaagatggttggctatgcttctatgagattctttccagtcattttgttagagtgcctgaaagtggcaggcgtatactcgagttgatagtgcaactctggagccagtccttcgcgtccaacatatttgcacttctttttcacaaatggttgtttgaagcccctcttgatgaaaaggaaatatcgctacgatatagctctgctcttgttcaaggtgctacaaatgtattttggattgacatacagacaaatacaagacattttctctctttgtatcattacctccttgaggatgttgctctagtccctgaccgacttactaaaatatcattacaggctggtagagaccttttccttctactctctagattcatgttcttctatgatcaagatcacttgctttctagtttcctagagcatttccccacttttccaaattccttcttggttggtggaccagcagattactttgtaattgaactcactgatcagcttcaaaagctaaaaattgagccagtactactgcactacctctcccgcatgagcatacttcaagggttggaactgagattgagtacaagcaccagattaaaggcctgcctgtacagcttcacttctcctggtggccctacttacccaacacgagcggtgcggcatgcagcctggaatacattggatttgctgttccctatcggtcggtacccaaggcatgtgatcagcctgttcttccggctgctgtatccgtggtactggccttcctcttgctggaacttcgtgatgacctgtgccatgactgtctactactacatcctaaacctgctggtgtcaagttgggagaaactgaggcggcccagtcaccagagaaggcatggtgaatgatga

SEQ ID NO: 392 - DNA, 1455 bp, Sorghum bicolor
gacgcgaacccaggatcccgtcgagggcaggcgggaggatcccggcgtgcggcggcgatgggcgaggcggacgcgagcgccggcgggagcggggccggcggagatccgcagcggctgaagcggatcgccgctgcggcgtacgactacgagaacgatgcgcggtgggccgggtactggtccaacgtcctcgtgccgccccacctcgcctcccgccccgacgtcgtcgaccacttcaagcgcaagttctaccagcgatacatcgatcctggtttggttgttgagccaatgtcctccatgacttcaactcagtctagcagaccagcagcaaggtcttcagctacaccgtctggcgagaatgtcagatctcgtgactcagcctctagcacgagatcaactggggcttcccaacagccatcagcagagaggactgcaaattctttacggctagacggacggacaatacatttttctatcaatgcctgggtactggttgtagctagtgttggaatactcccagttctgcccaaccatatctcaagtaaagcatacagactttcattgctaggaacaatatgctcgtctgcatattctttatatagcacttatgggaaaccaagagcatggaatatgcctgcaattcagtcctggctgcaatctattattgtagccaaggactttgttcacttgatgttctctcttatgatgttcacatctaacgtgcactttaagattgctctacttcctgttctttgctgggcacttgatcatgttgctcgattcctaaggcgtaattttacgcattcttctttatacaggaagtacttagaggacccttgcctatgggtagagacaaacaacactacactcagcctactttgttcgaatgctgaaatcaccctggggtttctcatgatcatctcacttttctcgtcaagacgcaatataattcagacatttatgtactttcatctgttgaagttgatgtaccattctcctgtgacatctggttaccaccagagcgtgtgggcaagaataggccgggctgtaaacccgtacatttaccgctacgcgccattcctcaacacacctattttggcagttcagagatggtggctgaggtaggaaagcatggatcccaggtatcatcatcactacagtgagaatttgcctacacagctacagtgagctccgcccctcaattttttttagaagacgtgcttccatagtgttctgttcttgtacacggttgtattcttagttcatgtctgaccgagctactgaaggcataacaccgaatcttttcttacgataagcagtagctcttgagcgaattgtctgacgatttgatgggatacagtttcagacattcagtggtagcacatataattcataaggatgcttgctgcagtcaataggatggtgaacaatgaaatgcagagtggaaccattgattct

SEQ ID NO: 393 - DNA, 1033 bp, Sorghum bicolor
aaaggatccaaggcgagctctatagccaggagcccaggacgccggaccgggaccgccgccgcgaaccgccgtccgactcgctccgcacctccggtcctccaaaccggcgctcctaccctcgctgcaatggagtcgaggaagccggcgccctctcctctcgtcgacaactacgtggtacccggtgacgtcgtcctggacctctccgagatgaacaaccagaccattaagctcggcgcaggcctgcgtcaggagtgtgacaccatccaggctaccagtgctgggaagctgcggctgttgaaacccaacaagtattggattgagaactcccagaagaggtatataccttctgtagaagatacagttcttggtattgtggttgacaccaaaccagataactttttggtagacataaagggtcctaatttggcctttctaccggtgcttgcatttgaaggtggcacaaggagaaacataccaaagtttgagattggtacgttaatatatgctcgagtggtgaaagcaaatagtatcatgaatcccgagctctcatgcatggatgcttctgggaaagctgctgaatttggtcagctgaaagatggttatatgtttgacacatcaactggcatgtcacgaatgttgttaagttcgccaacatgtccagttctggaggcccttgggaaaaaactgtcatttgagattgctgttggactcaatggtcgagtctgggtgaatgctcctgcagcaagtactgtcattcttgtatcaaatgcaattatgaggtcagaatctttgagtggcataaaacaaagagctatggtagaaaatctcttggagagattgtcatgatggcaatgtgtgcttatgccatcaatgtattatggagaattgctttttagatgccacagccgattctgggaacaggaaaaatggtaatccctatcattccaacagggcatgctaaatggatcaaggatgttgcacataaattagatatgacaaaaagaggcttgtgttcttcgatgttgaattcttt

SEQ ID NO: 394 - DNA, 1690 bp, Sorghum bicolor
agagagaaagacaagcggtgggcttgcggtggcgtagctcgcgatccgggcgccgagctggtcccgtacttttacctgggttggtcgcgcggcgcggtcgggaggctaggctagggctcggcgtcggcggtcggtcgcgatggggaagggcgcggtcgtggggacggctgtggtggtgggcgccgcggctgccgcggcggtgggggtggcggtggtgtcgctgtcgcgcaggaggcgtcggcggcgggaggcggaggatgagaggaagaggaaggcggccgcggtgatcgaggaggtggagcagcggttctcgacgcccaccgcgctgctccgcggcatcgcggacgccatggtggaggagatggagcgcggcctccgcgccgagccccacgcgccgctcaagatgctcatcagctacgtcgacaacctcccaaccggtgatgaacaaggactgttttatgcactggaccttggcgggaccaactttcgtgtcatacgggttcaacttggaggaagggataaacgtgtcgtgaagcaacaatatgaagaggtctccattccgcctcatcttatggttggaacttctacggaactgtttgatttcattgctgctgagctggaaaaattcgtgcggactgaaggagaagatttccacctaccaaatggcaagcatagagaactgggtttcactttttctttcccagtgcaccaaacatctatatcatcagggactctaattaagtggaccaaaggcttttccatcaatggcacggttggagaagatgttgtggctgaattgagtagagccatggaaaggcagggtcttgatatgaaagttgcagctctggttaatgataccgtaggcacattggctggtgggagatatgctgataatgatgttgttactgctgtaatattgggcactggcacaaatgcagcttatgtggaacatgcaaatgcgattcctaaatggaccggactactgcctagatcagggaatatggtaatcaacatggaatggggaaacttcaggtcagataaacttccaatgtcagagtatgataaatccttggactttgaaagtttgaaccctggtgagcagatatatgaaaagatgatttctggaatgtatcttggagaaattgtgcggaggatcctgctgaaactggctcatgatgcttcattgtttggggatgttgttcctccgaaattggaacagctatttatactgaggacgccagatatgtcagccatgcatcatgacacctcacatgatctcaagcacctgggagctaagctgaaggatattctgggggttcctgatacttctctcgaagcaagatacattactcttcatgtgtgcgacctcgtcgcagagagaggtgcacgcttggctgctgctggtatatatggtattctgaagaagcttggcaaagacaaattgcttagtgacttcagtcaacaaaggactgtagttgctattgatggtggcttatacgagcattacaagaagttcagtgcctgcctagaagcgacgctgacagacctgctcggcgaggaggttgcctcatcggttgttgtcaagttggccaacgacggctcaggaatcggagctgctcttcttgcagcctcacactcccagtatgctgaagttgcatagttctaggagctcggctcctagtgtaacctt

SEQ ID NO: 395 - DNA, 1616 bp, Sorghum bicolor
aagggaatcgccatcagcgtgtgaccccataaaaagcagggcgtgggcaggggacgggcagagcagagcgcgggctgcctccagctccaacccaccaccagacgagccgtctagccgagaggaggacgcggcaccgctcggtagcagccagggttgtcgcgctgagcacttgagcgcagtggccgcttgtctgttgtctccccgctgcccagtctcactctcccacttccccgtctcgcgcccccccttcgcccgtccggctgtcccggcgtcccctgcagcttgtgctctgggtcggagggagctgagctgcgagggagcgcggaggggagggtttaggagatggagccagattcggcgaggaagaggctcgcattgctggctctgcttctcctcctggcggcgcccgcccggccggcctcggcggctccggtggaggatggcctgctcagcaatggcgactttgagacagcaccagccggtggttttgtaaaatctgcgtctgttgctgagggtgcatcgtcaatccctggttggacgatcaatggcacggttgagctcatttcagcaggccagcaccagggtggcatgatcctgattgttccacagggggaccatgctgtaaggctagggaatgatgctagtgttggtcaggtggtggacgttgagaagggctcggaatatgctatcacattcagcgctgcccggacatgtgcgcaactggagtcactgaatgtttctgtgctaggtggcatatcccagacagtagacttgcagacattgtacaacatagaaggctgggacgcgtatgcactggcttttcaggcgacggaagagcaggcacatcttcaattcatgaaccctggcatggaggatgatccaacttgtggtcctatcctagacaacgttgccgtcaagaagctcttcactccggacaaaccgaaggataacgtggtgctgaatggagactttgaggagggtccatggatgttcccgaacacgagctttggcgtgctgctcccaactaaccttgacgagcagacatctgccatacctggttggatgatcgagtcaaaccgcgccgtccgctacattgactctgatgagtacaaggttccccaggggaagcgtgccattgagcttctgtcaggcaaggagggtatcatctcccagatggttgagacgacccctcagaaggtttacagcctgacgttcacactgggcacggcaggggactcgtgccaaccaccaatggccatcatggcgttcgccggggatcaggcccagaacttccactactccccaataggcaacgccaccagccaggctgcgaatgtgacgttcactgcacgtgctgagagaacacgtgtggcattctacagcgtgtactacaacacgaggagtgacgaccacagctctctgtgtgggccggtgatcgacgatgtccgggtatggggcttgaatgcagcggctgggttgaaggcaagtattggactcgttcttggcattgttggtctcgctggcatggtgctcttctgaaatctgaatgcctcagtgcctgtggtcttgggaagtatggatgtataactattctgttagttggaggtggctgctag

SEQ ID NO: 396 - DNA, 1115 bp, Sorghum bicolor
cgaccatggccgccgcggcgcacgaggtctccgccgtgatctttgatctcgacggcaccctccttgacacagagagggcgacaagggacgtcctcaacgaattcctggcggcgtacgggaaggtccctgatgcgcagaaagaggagaagaggctgggccagatgtatctggagtccaccactggaatcatcagagattacgggctgccgctcacggtcgaggagtactccaaggcgatgcatccgctctacctgagaaggtggcaaaaggcgaaaccgcttccaggagtgaagaggcttgtcaagcatcttcacaagaacggagtgccactcgcaattgcttctaactccgttaggagaaatattgatcacaaacttccgaaactagaagattggggagagtgtttttctgttattcttggtggagatcaagtccctaatgggaaaccttcccctgacatatttttggaggctgcaaagaggcttggtgtaaatccatcgtcgtgcttggtcatagaagattctgttgttggcgtcaagggtgccaaggcttctggggcaaaggcggttgcagtaccatcacttcaaagtcagaggaaacactattatattgctgatgtcatcatctattcacttttggactttgatcctgagctatgggctcttcctccatttgaagatcgcattcaaggtgtactgccgattgatcccttactttcaaatgccaggataggtgataaaattgtaaacaatcttcattgggtaatttcagatgactgtacctacgagtgtattcctgaccaaatatcaggaatttatttgggttgggccgagtccaaagtgcatggactctccaaggttatcataggtactgggtgggacttctcacagcagactgtcgaaagagtgatgcaagtagattttcttgattcctctggcaggattgaaacagagcctgtgaagctgcttgtaattggctacatccggaagctccaaagtgcggatgatatattgcaagctttaagtataaccgacgaagacaggagcattgcaagggaagcattggacctcccaactttctctgaatatgctaatgaccttcatcttgcctaataa

SEQ ID NO: 397 - DNA, 1121 bp, Sorghum bicolor
gacaccggtgattccgtgcgccggcaggcgggcaggccaggccaccaacgccggcgcaacgaaatggcggcagccggggacgccggcggcctcctcgtctgcgtgacgggcgccagcggcttcattggctcctggctcgtccgctgcctccttgaccgcggctacaccgtccacgccaccgtcaagaacctccaagatgagggcgagacgaagcacttgcaggccatgggcggcgccgacgcgcgtctccggctgttccagatggacctcgtcgaccctgcttccgttcagccagcgatcgaaggcgcccacggcgtcttccacctggcgtcgcctatgatactgcaggcagaagatccggagaaggagctgctggaacctgcggtgaagggcacgctcaacgtgctgcgagcagcgaaagattgtggagtcggccgcgttgtgctcatgtcgtcacaggcggccatggtgcccaatcccaactggcctccgggtaaggtcatagatgatgactgttgggcagacgttgagctgctcaagaagcttcagctctggtacagcgtttctaaaacactggcagagaaggctgcatgggattttgccgaaaaggaggagttgcagatagctgtgctcaatccagggatggtattgggcccaatgttaacaccatcagtgaacgccagcctgcgtctcttgctgcaaattctgggaggcgagaggattgacttggacgacatctacatgggttgtgttgatgtgagagacgtcgcgcactctctgataatgttgtacgagaacccatcagcacaaggacgccacttatgcatggaatccgctgaacgcctggttgatttggccaataagattgctgatctttaccctgaacacccagttcagagaatccgggaggacaagcaagggtgggtggtgagagcaaaggacccttccaagaaattgatcaaattgggtgttcgtttcactccactggacaaaaccatcagggacaccgtggattgttttaggagcaaaggactcatctagcttgtgagtgtgcttcaagaaaaacttttgtaaactatgtggtcaaataaatcacccgaaatgtggcaaagtaatatctg

SEQ ID NO: 398 - DNA, 1272 bp, Sorghum bicolor
agctgcgacgtctccctcccttccccgcaccgggcccgtgtccacagatattttactcggaaatcaaatcccccaccccgcagctttcttccccttccgtcgcgcgcgactcgttcgcctgtccacgccgccggacgagaggagatgtgcgaggcaccgcgactcggctaccgcgccgccggcgccggcgacgcggacgccgctgacgtcgacgtcgtcaccaccggcggacgccggaggatccccgcgcattcctctgttctggcctcggcgtcgccggtgctcgggagcatcctggagcggcgcctccagaaggacagggagagcggcaagcccggcaggtccgtcgtccggatccgcggcgtcaccgacgacgccgcggccgccttcgtccgcctcctctacgccggcaggtgcggcgacggcggcgaggaggaggaggaggatgacgccatggagaagcacgcggtgcaggtgctggtgctggcgcacgcgtaccaggtgccgtggctgaagcgtgcgtgcgagggcgccatcggcgcgcgcctcaccgcggactcggtggtggacgtgctgcagctggccgacctctgcgacgcgccgcgcctgcacctccgctgcaccaggctgctggccaaggagttcgccgccgtcgagcgcaccgaggcctggcgcttcctgcaggagaacgacccctggcaggagctccacgtcctgcagcgcctgcacgaggccgacatgcggcggcgcaagtggcggcggaagcgcgcggagcagcgcgtgtacgtggagctgagcgaggccatggactgccttgaccacatctgcacggagggctgcacggaggtcggcccggcgaggcgggcgccggcgccggcgccgtgcgcgcgctacgccacgtgccggggcctgcagctgctcatccgccacttctcccagtgccaccgcaagagctgcgcgcggtgccagcgcatgtggcagctgctccgcctccactccgcgctctgcgaccgccccgaccgctgcaacaccccgctctgcatgaggtttaagcagaaggagcaggagaaggtggctgccaaggccggcgatgacgacgacaaatgggggcttctggtgaagaaggtgaaggctgccagggtcttctcttctctagccaacaggaagcagacgagcacctccacccagtgctgagcaaacacaggagcagcctgggatggttagaggtaggtagattagtgagtatgagtgagaggttggagtgagcagttt

SEQ ID NO: 399 - DNA, 1104 bp, Sorghum bicolor
aatggatccggcatttcctcgaacgccccgcgcgtgccgcgcccctcgccgcccatgggctccctcccggtgccagcctcggcggaatgcgccccgcaggggcgcgccacggtgtcggcgtcggacctggcgccgctcttctccgcgcagcgccggcacctggaccacttcttcgacagcctcgacatgtcgcaggcggcggcgttcgcgcaggcgctgatcgacgcgccgggcgccgtcttcttcacgggcgtcggcaagtcgggcatcgtggcgtgcaagatcgcgcagacgctggcgtcgctgggcttcgcgagggcggggttcctggcccccgtcgacgcgctccacggcgacatcggcgcgctcttccccggggacgtcctcgtgctcatctccaagtccggagcctccgacgagctgctcgcgctcgcgccctgcgcgcgcgccaagggcgcctacctcatctcgctcacctccgcggcctcgggggctgaatgcccgctcgccgcggcctgcgacctcaacgtccacctgccgctgcagggagaggtgtgccccttcggcctcgcgcccgtcacctccaccgccatccagatggtgtttggggacaccgtcatcgccgccatcatggaggcaaggcgactctccagggaccagtacgcctccaaccatcccgctggcaagatcggcaagaccctcatcttcaaggttaaggatgttatgaagaaacagaatgaacttcctctgtgcaaggagggagatatgataatggagcaactcactgagctcaccagtaaaggttgtggttgtttgcttgtggttgatgaagagcatcatttgattgggaccttcactgatggtgatctccggcggacattgaaggcaagcgggccagctatcttcagtctcacagttggagagatgtgcaacaggaatccaagaacaataactgcggaggcaatggcagttgaagccatggagaagatggagtcacctccttcacctgtacagttcttgcctgttatcaacgataacaacatcgtgtgtgggatcatcacattgcatggattggtctctgccggattgtagtagggtaccaaa

SEQ ID NO: 400 - DNA, 1478 bp, Sorghum bicolor
cgattcctctccagtctcgtctccagcagtccagctcgatcgcgatcggcgaccagcagtaatccatggccgcccccactgccgcgccgctcgacgagggcaaggcgaagaaagtccttcgccaggtggagttctacttcagcgacagcaacctcccccgcgacaagttcctgcgggagacggtcgagcagagcgacgacggattggtgagcttgcccttgatatgctccttctcgcggatgaagtcccacctggggctggatgcagatgtgaaggccgagactctcccagaggagaccgtgcttgcggttgctgaggtgctccgccgttctccggtcctccgtgtatcggaggatggaaagaagattggtagagctagtgaactcttgaagccagatgagatcatagaacaagtagactctaggaccattgctgtatctccacttccttacaatgtaaagctggaagacgtccaatcttttttcacaaattatgcaaaggtaaacagcgtgagacttccacgcaatattgtcaacaaaaaacacttctgcgggacagctttggttgagttttctgaagaagaggaagcaaaaagtattatggacagttctttagtatttgcaggggcaaatctggaaataaggccaaagaaggagtttgatgccgaacaggagtccaaaaaagaagcatatgaaaaggaacgccctagaaaggacaaccaggatgaaggctatccaaaaggtctaattgtggccttcaaattgaagaagaccacggttgattctgtggtgcagcaagataacatagatgaacggaatgactctgccacgaaattagaagattccagttccatggaaaaactctctggccaggtgccagagtccacccttgagagcgatggtactaagcaagggaagtcctcagatgaaattaccaaagagaaagaactaaacactgcagaagctacagaatctgagaagtgtattggtgatgccccggtagaaagtgagaaacatggtgatagtgaatcattgagcagggatggcaaaagcatttctggcaatgtgaatgcgaagaaccaaatatcaagggaggatctaaaagaagcattcaaaaaatttggaactgttcggtatgtggacttcagcatcggggatgattcaggataccttcgctttgaagattctaaggcagctgaaaaggcccgcatgtctgctgtacttgctgatgaaggtggcttcataattaaagaccacattgttactttggagcccgtgactggtgaagctgagaaggattattggaacagaattcgcggtattcaaggaaagtacaaggatagtagaagctacaagggaagggctttaaagaaccagagaggaggaaagcatttcaatgggaagcgagatagaaaccccgattcggagaagaattctaacaaggcccagaaggttgaagctgctgcgtgaagttaactt

SEQ ID NO: 401 - DNA, 1097 bp, Sorghum bicolor
atagctgattggtgagggtctggacctagcaatggcggaaaatactcatggtagtggccgatgcgcgcttggggacttgacgaatgtcctttgcaagcgaccagccacatcagatctggagaagagtacaggtgggataaagatcagacggattgaaaaggacactgggactgggaaagggtttgatgaaaatgcaaaaaccagcagtagagggaagggaattgtatttgggcatttgtttgatggtgttgccaaagagaatttcgaaaggccttctatctttcagaacactagggttcaacacatggctgccgaagcagctgggctgttatccaaggaggccagtgacttgaagaaccattatgcatcaattgattcatttgatctcagtgataaggagcaggattcttcgctggaatctgaaggtgactacgatgatgaagataatgatgagatgaatggtgaactgccacaccatttttgcacctcagagctagctaataaaacatcaacaaatgacgacgagtgcttgactcaggaggagatagttggttcatcaggaaatcagaagcctctgtcttcattggatgctatggcaggtggtgacatgccaagttctagtattcagcacgcttctatgagaactgggggtttggaagaagctgtcgccacaaaatcttgtgcttgttctttctgtcttaaggctgcttttatgtggatggatctccattatcaggatgcaagaagccggctttctgtattgaagaaaaacatcaagtttgccaggttgttggaggaaagaagtagaggaagtgaatatgctgccaatgtagccggatataactcaaagcgagctgtgggaatggagttcgaactatctcaacaacagagatcactctttctttatacagaaaatgcccttgtccgcgagtcaacacagcttcattctacttttgtgaagttgaaagaattgagagagaactgcaagacaaatcttgagacgatcagcaagtcttcaatgagaaaatgagtgctgcatgttgcgctgctgaactgttagttttcctgagacttagtatgatcagctggcttggttt

SEQ ID NO: 402 - DNA, 4191 bp, Sorghum bicolor
aaacccggggccatttcgctcgtctctctctctcctcgaggggcgatcgatccccaactcgccgcatcccgaacccgcaatccacgcgcagcttgccgttgtatgttgcagggcgtcgccaatccggtccgatccgccggtttgagggttccgatggagacctcggaggcggcggccgcgcatccgcagaaggatagcgtgaaggtggccgtcaacataaggccgctcatcacggctgagctgcaggagggctgcacggattgcgtcaccgtcacgcccggcgaaccgcaggttcaaattgggccccatgtcttcacctttgaccacgtctatggcagctcgggtccttcatcatcattaatatttgagcaatgcgtgcacccgttgattgatgcattgttcagcggatacaacgccactgtcctagcatatggccagactggttctggcaagacatacacaatgggtactgactacagttgtgaaggcaactctggagggataattcctcaagttatggatacaatatttagaaaagttgatacctcaaaggatggctccgagtttttaattagagtgtcttttattgagatattcaaggaagatgtttttgatttgcttgatgcaaatcaagctgctgcaagacctgatgcaggttctatggcaaaagcatcagcacctggcagagtgccgattcaaattcgagagactgcaactggaggcataacccttgctggtgtcacagaggctgaggtgaagtcaaaagaagaaatggcatcatatttgacacgtgggtcctcgtcacgtgcaacagcaagcacaaacatgaataggcagtcgagtcgctctcatgccatctttacaatatgcgtcgaacaaaagagaatatctggtacatctgacaagtcagccagcagtgattatgacataatatcatcgaagtttcaccttgttgatcttgctggttctgaaagggctaaacgtactggagcagatggacttaggcttaaagaagggatacacataaataaaggccttctagctcttggcaatgttataagtgcactaggcgatgaaaagaaaaggaaagaaggagcatttgtaccataccgggatagcaaattaacccgtcttttacaggattctctaggaggaaatagcaaaactgtcatgattgcatgcattagccctgctgatataaatgcagaagaaaccataaatacactcaaatatgccaatcgcgcacggaacattcaaaacaaagcagtggtaaaccgtgatccagctacagcagagatgcaaaaattgaggagccagctggagcagctgcaaactgagcttttgttttcccgcagtgggagtgcagcgttagaagaacttcagttgctgcagaaaaaggtctctcttcttgagctaaagaattctgagcttaacaatgaactcaaggaaagggaattgtcatgtgagcagttggcagagcgggcacgggctgctcagttggaaagggatcagttgatgctgaagattgaatccgcgaggaatggaaaatcatgggatgatattgaaaatgctgataatgaccaagacatggacctcttgaagggctacatatcgaaagtacagcagttggagagtgaactgatgcggcaaaacttctccaatgcttgcagacatggcttaaatgatcaacttgccatggagcgggacattttactaaatgaattgggttctggatgtgaagtaggaacacctgatgcttcaagtgaagttgatgaagaagaaaaggagagagaacattcatccatgcaagaccaacttgacaaagagctgcaggaactagataaacgtcttcagcaaaaggaggaagagatgaaacaatttgccaagagtgatacttctgttctcaagcaacattatgaaaagaagttaaatgagttggagcaagaaaagaaagctcttcagaaagaaatagagaatcttcgccatgctttaaccaatatatcttcttctacggatgacaatgctcaaaaactgaaagaaaactatcttcagaagctgaatgcacttgaatcccaggtccatgagctcaagaaaaagcaggaagctcaacaacagcttctaaggcagaaacagaaaagtgacgaggcagcaaaacgtttacaagaagatattcatcgtataaaatctcagaaggttcaacttcaacaaaagatcaagcaagaatctgaacaatttaggtcttggaaggctgcccgtgaaaaggaagtacttcagctcaagaaggaagggagacgaaatgaatatgagatgcacaagctcttggccttaaatcagaggcagaaaatggtcctacagaggaaaactgaggaagcagcagctgctacaaaaagattgaaggagttactggaagcaaagaagtcatcacgtgaaacatatggaggtgcaaatggttctgggatgcaggccttaatacgagctattgatgatgaactggaagtcactgtaagagcacacgaattacgctcatattacgagcgacaaatgcaggagagagcagcaatatccaaggaaatagcaaagctgaaggaggaatcaaagcacaagatgagtgattgtcctcaagctatgtctcctagtgctagaagttctaggatatcagcattagagaacatgttatcctcatcatctagtgccatggtgtctatggcttctcaactgtcagaagcagaggagcgggagcgtgtattcaatggtaaaggtagatggtaccatgtcaggtccctcccagaggcaaagaacataatgaactaccttttccagtcagcatcatccgcaaggtgtcaagtactggataaagaggtgatttgtaatgaaaaagaacacaccattagtgaattgaaggaaaaggtggttgtgcttaatagtggaatgaggcagttagaaacacaactgatggatctaaggagccaaaatacacagcttttcactgcattgaataatgcaaagaaatctgctaggtcaaatggcactggatttgctcagcgtaagagcgttcgatcttcccagcattttggttgtagtaaggacaacttcatcaattgggtggacgatatggacatttcagatggtgagcactcagacgagttagagagtatgagtgatggatctgattcagactgggtacagtcgaacaggaaagcgaaaaaacatcagagaagagtgtctagcaattcaaatcataagctggattgtcaaaatacacaagacaatgcagaaccagagaagccctcagatgaaaagtgcattctgccaaaaaatcttccatcagacggctgttcatgctcaaaatcctcatcatgcaagaccaacaagtgcgagtgcagaggctcaggtgcacaatgtggtgcaggctgtggttgtaaggactccaaatgttctaacagggattcttcttctactaaagaaaaggccaatcagggagccatgcttcttcagaacgcgttttctgagaaggaagcccaagatgcaaagccaagaaagcctttggctaacattggtaataatgtggttaaccaaactgccgagacagagaagaagcccaggaaaaactggcgcaagtcgacagttcaactcgtcccagggcctctcctgccgtcggagccagagaccaccgaagctgctcctcgggacagagccgatattcctctcaagctaccgagagccatgtcctcagggactcctgcggagagcaaccctccccccctcacggaccgcaatgctgccaagccccaccaatccgtgagcacaggcaacaaggatagcaccggaactgccgccacgaggccaccgtctcagctgagaaaaaacgcagccaccgagaaggagaaccagttgcgataattcaattgctgagtatccgtgtcggggaagtcttttgtcttaacagcggtggaggctgcctcggcgtcctatggagaggcaggtagaccctggaagggctcgcgctctctcgggttcctgagggatgatgactgcgaaggcaatggcgtgttctgttgcaatgttgtgccttgtgccgttgtacgcgccgccttagctctgctttggctggaacgcaaccatcttgtagtgaacaaaacatggtggattaagttatatatcagtctcgttaatggtctccgtggatccttt

SEQ ID NO: 403 - DNA, 617 bp, Sorghum bicolor
aaaggatccatcgccatggccaccaccacgctcttcctcctcctctgcgccgccgcggcactcgcatcagcggcagccgccgccgacgacaccgggttcacgaccttcaagctctacttccacgacatcgtggcggggacgtcgtccccaaccgcggtgcggatcgcgcaggcggcgtcgtccaacacctcctccacctccttcggcgccgtggtggccatcgacgaccctctcaccacggggcccacgcggtcgtccggcaccgagatcggccgcgcccagggcacctacacgttcgcggaccagaccacgttcggcctcctcatggtgatgaacttcgtgttcaccgccggcgaccacaacggcagcacgctctccatcctcggccggaacgaggtgctcaccgacgtccgcgagatgagcatcgtcggcggcagcggaaagttccgcatggccaagggctatgtccaggcgcacaccattgattccggcgccaccaccggggagaccgtcgtccagtacaccgtcaacgtcaagacgccctagctagcttagttggtttcttgctccggctggccgggggcctgctggtgctgccatggcttgttggtaccaaa

SEQ ID NO: 404 - DNA, 1765 bp, Sorghum bicolor
actcgctcttcttcctccaaaccccaaaccctcgtcgctttccccacctgcggcggcggcggcggcggcacggccatggccttccggctccaggcacggccaggcttcagggaccgcagcatccagggcctagctcaccgcggaggcagggacccacaggagctggaagcgcttttcggccgcgtgctctcctacatccaccatgcgctccctaccccgcccgtctccgtcgacggtgacctctgcatcctcttcgacgccgacggtgggggtgtcgaccgcctcagccgcctccccgacaagctcctatgcgacatcgtctctcgcctccccatcaaggaagccgcgcgcacggcggtgctctcccgccgttggagccccatctggcgcgccgccccgctcgtcctcgtcgacactcacctcctcccggccggcgacgacgagatccccatcgacctcgaccacgcccactctgacgccgtggccgccgcggtctcccgcatcctggtcgcgcacccgggcccgttccgctgcgtccgcatcacctgctgctacatggaggaggaccgcgcccgggtcgaacgctggctcaagctcctcgcttccaagggcgtccaggagctcttcctcatcaaccgcccgtttccgctcaccatcgacaagcatctccccgccaccttcttcagcatgaccacgctcacccgcctctacctcggcttctggaggttcccggacacgaccaccctgccacggagcgccgccttcccctgcctccgcgagctcggcctctgcggcaccgtcatggacagccacgacatggacttcgtcctcgccaggagccccgtgctggagatcctcaacattgagggccacctgctgccaccgctgcgtctccgcatcatcagccgcagtctccggtgcgtgcagatcaacgggtccagagtggacagcatcacagtggtagacgcccagcgcctcgagcggatcctcctggggtatgggagaaatgaggattcgtgcttcaagatcaagattacacatgccccagctctgcgcatgtttggaaaaattgagctggcaaaggacgagctgcaggtcggcaacaccatcatcaaggctgggacaatggtgaacccaagtgtcatgttgtcagctgtcacgatcctggacctccatgtccgttttggggtccgcaatgattccaagatgctgcccacaatcctcagatgttttcccaacatcgagacgctgcatatccattccaagaaaactactgaatccactggcaggctcagcaacaagttctggaaggagtctggtgccatcaaatgcgtcatgtcgagcattaacatgctgcaagtccatgatttccgaggggagcggagtgagcttgccttcctcaagttctttattgagagtgcacagatgctgaatgtgcttgtggttgtgtatgccaatgggttcttcagttcaaggggtgaggccaattccaaagtgaaggctctgtttgctgggagaaaggccacacaaagctgtaaagtggtggtctgtgagagtaggttttctgaaggtggtagccgttgggacttcgaacaaggctctgatttctcttttgatgatcctttcggaatcatcgggtgtagttcctttggagttagtcagtggtttgtttaagtattcagatgcaggtattgttctgggtcgtttgagtttctttgcctttttccttaagaaccttaagccagtctcttactagcaattcaag

SEQ ID NO: 405 - DNA, 508 bp, Sorghum bicolor
tgcctcccctctcctcaccgcccggcgcgccaccaccatggacccggaagcggtgcggaaaagcctggagcccaccgcaaccgcagagaaaatcacgggctccacccctgcgcggctccacttctacgaccccttcgtcctcagcggcgtcagcatcgaagccgccgagcacggccgcctcctctgctccttcgtcgtgacacctcgccttgcgagtcccgtggggtacctccgcagcggtgtcacagcgacgctcgccgaccagctgggatcggccgtgttcttctgcagcgggctccccagcagcggggtctccatcgagatcagcgtctcctttgtcgacgcggctgcagtcggggaggaaatagaggttgaggggaagttgttgcgtgctggaaagtcagttggtgttgtctctgtcgatttcaggaagaaaaagacaggaaaattgatggcacaggcccgtcatacaaagtatcttgtggcatcaagcaaattgtgaggttga

SEQ ID NO: 406 - DNA, 693 bp, Sorghum bicolor
aaaggatccagtatccgttcatcagcgtgagggctgagggagagttgccttttctctctcccgtcatcccgtctcctcttcttcgtgaactctcttttccagatcagaagaagctcggaccggcggcggcgggtgacgcaggatctgttctggtggcgacgtcgaacagcacgcggatggacggcggcggcggcggcgacctgcggagcgccatcaagaagtggaacgtcatctaccctgtctacctcaactccaagaagacggtcgccgagggccgccgcatcgccgccgccaaggcctgcccggaccccacctgcgtcgagatcgccgactgctgttcgcacctcaagatcccccacgccatcgagttggataaggcgtacccaagggatttcttccaggtggggagggtcagggtgcagctcaagaaagatgacggctcccccgtcaatcctgctattaaaacaaagaagcagctgatgatccaaatagcagagctagttcccaagcaccacggaaggacaaagaagcaggaggcagcaaccagttcttcagccggtggcagttcaaagaacacaaaaggcgggaaaaagaaaaagtgatggcagtatcattttgtgttttttttttccttctgttcgtcctcatactaagcgtctgtggaagttgtctttctgaggcctgggtaccttt

SEQ ID NO: 407 - DNA, 1130 bp, Sorghum bicolor
ggtggatggtcatgggagccagcggctccaagcttgagaaggccctcggtgaccagttcccggaaggcgagcgctacttcggcctcgagaacttcggcaacacctgctactgcaacagtgtccttcaggcactctatttttgcattccatttagggagcagttactggaatattatgcaaataacaaaactccaggtgacgctgaagaaaatcttttgacctgtttggccgacctttttatgcagataagccaagcaaagaaaaagactggcgttattgctccaaaacgttttgttcagagagtgaagaaacagaatgagttgtttcgcagctacatgcaccaggatgcacacgagttcttaaatttccttttgaatgaacttgttgatattctggaaaaagagtcaagtgctgccaaggattcaccccaattgtcatctcctgaaaaagctccaaatggcccagttcaacctttagccaatggagttaaaaaagaacctccagttactctggtccataaaaatttccagggcatattgaccaacgaaacaagatgcttaagatgtgaaacagtaactgcaagggatgaaacatttcttgatcttagtgttgacattgaacaaaatagttctatcacaagctgcctgaaaaatttctgttctactgagactttaaatgcagaggataaattcttctgcgacaaatgctgcagtttgcaagaagcacagaagagaatgaagatcaagaaggctccccacatattggtgatccatctaaagcgtttcaagtacattgagcagcttggccggtataagaagctttcataccgggttgtattccccatggaactgaagctcagtaatacatccgacgatgtagacactgagtactccctctttgctgtcgtggtccatgtcggaagtggccccaaccatgggcattatgtaagccttgtcaaaagccacaaccactggttgttcttcgacgacgaaaacgtcgagatggttgaagagcagaccctacaaacattcttcggttcctcacatgaatactcaggaaacacagaccatgggtatatcttattttacgaggggcttggcgggaagagttagatggggtttattcactga

SEQ ID NO: 408 - DNA, 1367 bp, Sorghum bicolor
aaaggatccgaaatagcgaggaagggacgggctcggcctctctgcccgattccgcctccgacgactccgagatcccgtcaggcatggacgggctcctgtcgaagctccgcagcctggacgcgtaccccaaggtgaacgaggacttctacagccgcaccctctccggcggcgtcatcacgctcgcctcctccgttatcatgctcctcctcttcgtctccgagctccgattatatctccatgcagttactgagacaacactaagggttgatacttcaaggggagaaacacttcgcataaattttgatgtcacctttccagcccttcaatgttctataattagcctggatgcaatggacatcagtggacaggagcacctagatgtgaaacatgatgtattcaagcagcgaattgatgcccatggcaatgttattgcgactaggcaagatgcagttggtgggatgaagatggaagcacctctacaacatcatggtggaaggcttgaacacaatgaaacctattgtggctcatgttatggtgcacaagaatctgatggtcaatgttgtaactcatgtgaagatgttcgtgaagcctataggaaaaaaggttggggtgtatcaaatccagatttgcttgaccagtgcaaaagggagggctttcttcaaagtataaaggatgaagaaggcgaaggatgcaatatttatggcttcattgaagttaataaggttgctgggaatttccattttgctccagggaaaagtttccagcagtcaaatgtgcacgtccatgacttgcttccgttccagaaggacagcttcaatgtcagccataaaataaacagactaagttttggagaatactttcctggtgttgttaatccacttgacggggcaagttgggtacagcattcatcatatggaatgtaccaatacttcatcaaggttgtccctacagtctacactgacataaatgaacacattattctctctaatcagttctctgtaacggaacattttagaagtggtgagagtggtcggatgcaggctcttccgggtgtgttcttcttttatgacctttcaccaatcaaggtcacattcacggaacaacatgtgtcatttttacactttttaactaatgtttgcgctattgttggaggtgtgttcaccgtttctggaatcatagattcatttgtataccatagtcaaagagcaatcaagaagaagatggaaatcggcaaattcaactgatgttgctttcccgattgctgcaattaagtagctccttttgcagctccaagttccagaaatgggtgaatcaatgcacagtggcttttgctctggaactcttggcacactagcataggtaccttt

SEQ ID NO: 409 - DNA, 1088 bp, Sorghum bicolor
catttcgctccgcataggcgtagcatccgcaatctcccatggcggcgtcgcccgccctcctctcgctgacccccgccgtctccaggcacccccacctcctcttctccccttgccctccgccgcgccacgtccgcctcgccccccctctagccgccgccacaccctccccgggcgggaacggccctggccctggccccggcgtcttcctgtcgccgcgcgcgctctcgcagctcgacgagctcgcggcgttccgctacgagcacgccttcccgcacggcctcctcaccgtgcgcgccctcacgcgtggccccgacgacgacgccgtggccgaggcgctcgtccgcctcctcgcctcctccttctccgagaccgtgcgctgggccccggcgcagcggtacgcgcagctcctcacgttcgtcatccgcaggtacctccacgaccgccgcgggctcgcgccgcacgccgcggtgctcgtggggttctaccgccccgctgacgccggcagcgacgacagcgccgcctcggaggagggcggccgggatgatgagggcggcgaaggggagggtggagatgaaggggagatggcgtgcaccgcggaggtgtcgtttgacgcggtgggcgcgcccggggccccgcccacgcccactccgccgctcgacttcccctacatctgcaacatgactgtgaagacgccactgagaaggagaggaattggaaagcaacttcttaaggcatgcgaggatctggttttcaagatgaatgccagaagacgtgtgtatcttcattgtagaataatcgaccaagtcccattcaacatgtacaggaaagctggatatattattgtccagactgacagtattttggtctggctgagccttcaaaagcggaagtacttgatgagcaaggaattaccccaagcttctgttgttagtgagacttcaaccaaaaactttgatgataatattgacaagctgaatgtgctacgggactaacaggtacacataagaatggtttttgtgtataaatgggttctgtttacctcacatttccactattgtgtaacttgtgatgaaatcaactgccattag

SEQ ID NO: 410 - DNA, 296 bp, Sorghum bicolor
tccagagagacgccatgtgcaagctcaagttcagcaaggagcatgtggggtgctacctgctggtgatcctggtgatctgcctcctcgtcggcgtcctcttcggcctcggcatcttcaggcacggctacgacaggatcaaggacctcggccgcaaccacacctgcttcgactgcaacacaacagccaggtaccaactgactaattaactgactgagccacctggggatcttggtctgcgctggccgccgctgcaggcgtgcaacctcctccgtggaggcagcagagtagcagtatag

SEQ ID NO: 411 - DNA, 1238 bp, Sorghum bicolor
ggatccgagagcagttgcgcactagcaaaggatcctagcagcagcagcagcacccgctgatgggacgcgcggcaatggcggcctcttccgggacgacgacgcgctccgtgcgcctgctgctgctctccctgctcggcttctgcgtcgcgctgagccaccaggagtcgtcgtcgtcgtccacggactcgtgcgccacggccaaggtcgccgtcgccagcctcgtgcccttcgactccacctccttccgctgcaccgccgcctggaagcagcaggacttcgtcctcaggtacaagaacacggggcccagcgagtggagcttcatcctctcggcgccggacaagggctcgtacgtggcggtcggcttctcgggcaagggcgccatggtcgggagcagcgccgtcgtcgggtgggcgtccaacggcaagggcaccgtcaagcagtactacctcggcggcaagagccccgaggactgcgccccgaacaagggactcctcaagctcgtcaagaacaggtccgtcgtcgtctcgcgctcggggcgcctctacgtcgccttccagctcagcaccgactacccgcagccgtacctgatcttcgccgtcgggcccgacggcaacctgccgcagtccgactccctgcggctgccgatgcaccagaacatggcctcccgctccttcaactacacctccgggatgtcttacaacaccgccggctcgtccggcgaccaggcggcgttcccgacggagaggaagcacgggctgctgggcatgatggggtggggcgtgctgatgcccatcggcatgatcaccgcgcgctacttccggcagctggacccgtgctggttctacacccacatggccatccaggtgtgcggctacgccatcggcatcgcgggcatcgtcctcggcttccgcatcaacgaggacgggctcaagaacgtggacgtgcacaaggcgctcggcatcgccgtcttggccatggcgtctcttcaggtgctggcgatcctggcgcggccggacaagacgtccaaggtgcggcggttctggaactggtaccaccacaacatcggccgcgcgacgatcctgctggccatcggcaacatcttcctgggcctgtccatcgcgcaggaggtcagcgcctacgtcgtctcctacggcgtgttcgtcgccgtgtgggtggtcgccgtcgccgccttcgagatgaagcggtgctacgccgacgacgactgacgttgagaattc

SEQ ID NO: 412 - DNA, 1232 bp, Sorghum bicolor
cagatctatgagtgagcaactgaagcgcgactacgagatcggcgaggagatcggccgcgggcggttcggcgtggtccaccgctgcgtctcccgcgccacgggtgagcccttcgccgtcaagtccgtggaccgctccctcctcgccgacgacctggaccgcgcgctggccgagctggagcccaagctggcgcggctggccggcggagagggcgacgagaacccgggcgtcgtgcaggtgcgcgccgtgtacgaggacgacgcctggacgcacaccgtcatggacctctgcacggggcccgacctgctggactgggtccgcctccgtcgcggcgcgcccgtgccggagcccgacgccgcgcgcgtcgtcgcgcagctcgccgaggcgctcgcgggctgccaccgccgcggcgtcgtccaccgcgacgtcaagcccgacaacgtgctcctggacctggaccccgcaggcgagacacccccgcgggtgcggctcgcggacttcggctccgccgcgtggctcggcggcggcgagggcggcggccgccgccgcggcgccgaggggctggtgggcaccccgcactacgtggcgcccgaggtggtggccggcggcgagtacggggagaaggtggacgtgtggagcgccggggtggtgatgtacgcgctgctctcgggcggcgcgctgcccttcggcggcgagacgcccgcggacgtgttcgcggccgtgcttcggggcagcctcaggttcccgcccgcgctgttcgcgggggtgtcgccggcggccaaggacctgatgcggcggatgatgtgccgcgacgtctcgagaaggttctccgccgagcaagtcctccggcacccgtggatccagagcggagggggagtccgagaggtggttcggccaacgccaacctgaggagcccacggggctcctcaggtttggaacgagaccggaaccgatcgtgtatcatcgtagcgatgcggtgtgttgtccccgacgagttttgtgcagacgcctctgtatatccagcaagtaggcggcggcggcggcggcggcggcggcgaggagtgtgagacactgagactggagatcgtcgctccgccgcgcggcggcggcgcccgggtgtgtgtgtgtgacggtgacctgggccgttttcctcttttcctttttgggcttttttttttcccggccgccctgtgtgcttttgggagtataaaagtgtagtgcgacggtgatgtat

SEQ ID NO: 413 - DNA, 1647 bp, Sorghum bicolor
atccaccttccgtcagagctcaagatcggccatggactcgccaccgcttagccccgctctgctcgcgctgtccctgctcctcctcctagcgctctacatcgctcgccggcgccgcggcggaggcaggaaccggaactacccgcccgtggcgggcaccgtgttccaccagctgctcaatttcggccggctgatggagtaccagacggagctcgcccagaggtaccgcaccttccgcatgctcaccccgacctgcaactacgtgtacaccgtcgagcccgccaacgtggagtacatgctcaagaccaacttcgccaactacggcaagggggtgatgacccacgacgtgctggaggacctcctcggcgacggcatcttcaacgtggacggcgccaagtggcggcaccagcggaaggtcgccagccacgagttctccacgcgagtgctgcgcgactacagcagcggcgtgttccgcgacacggccgcggagctcgcgggcatcgtggccatggccgctggcgccggggagaggctggatgtcgccgacctgctgttgcggtcgacgctggactccatgttcaaggtcgggttcggggtcaacctgggctcgctgtccggctgcagcgacgagggcgcggcggcgttcgccagggcgttcgacgacgccagcgagcaggtcctgtaccgcttcttcgacgtgtcctggaagctcaagaggctcctcaacatctcgtcggaggcggccatgaaggggtcgatccgcaccattgatggattcgtgtacggcgtcatcgacaggaagatcgagcagatgggcagagaccaacaggaattcgccaagaaagaggacatcttgtcgaggttcctgatggagcgggagagcgatcccggctgcttcgacaacaagtacctgcgggacatcatcctcaacttcgtgatcgccggccgcgacaccacggcggggacgctgtcgtggttcctctacatgctctgcaggaaccagcacatccaggacaaggtcgcgcgggaggtccgtgccgccaccacgggcgaccgcgacgtcggcgtccaggagttcgtcgcgttcttaaccgaggacgccatcagcagaatgcagtacctgcacgccgtgctgacggagacgcttcggctgtacccggctgtgcccatcgatgtgaagtattgcttttcggatgacacgttaccggacggctacgctgtcaagaaaggtgacatggtgaactaccagccgtaccaaatgggcaggatgaagttcctgtggggcgcggacgccgaggagttcaggccggagaggtggctcggcgacgacggcgtgttcgtccccgagagccccttcaagttcacggctttccaggcggggcctcgcgtctgcttgggaaaggagttcgcgtacaggcagatgaagatcttcgcggcggtgctgctctacctcttcagatttgagatgtgggaagccaatgctaccgtgggtttccggcccatgctcacgctcaaaatggatggcccgctgtatgttcgtgcaacgctccggcaatgaggtgggcggcggtgtatgcccccatcgttctagcagcagcactttgaaagtagaattgcgctatttccatctgatgccatcttggataacgt

SEQ ID NO: 414 - DNA, 1580 bp, Sorghum bicolor
ggacaatgaagggaggagggggcgggaaggagacgctcaccgcctccttcctccgcttcctcctcctgctcctcctccccctcaccgccctctacttcttctacacgctgcacctcctcctcacctccgcgtcgtcggccgcctccaactgcgcgcctgacgccgcgtcggtctcccgggtgtccgccaacctcacggcggcgacggcgtcggcgtcgacggcggcggcggagaagcagctgcccccttcccccttggctgtgccctcggcgacgacgctgcagcacgtggtgttcggcatcgccgcgtcgtcgcggttctgggacaagcgtaaggagtacatcaaggtgtggtggcgcccgcgcggcgccatgcggggctacgtgtggctggaccgcgaggtgcgcgagtccaacatgtccacggcgcgcacggggctcccggccatcaggatctcgtccgacacctccgcgttcccctacacgcaccgccgcggccaccggtccgccatccgcatctcccgcatcgtctccgagacgttccgcctgggcctccccggcgtgcgctggttcgtaatgggcgacgacgacaccgtcttcttcccggacaacctcctcaccgtgctcaacaagttcgaccaccgccagccctactacatcggctccctctccgagagccacctgcagaacatctacttctcctacgggatggcgtacggcggcggcggcttcgccatcagccggcccctggccgaggcgctggcgcggatgcaggacggctgcctccgccggtacccagcgctgtacggcagcgacgaccggatccaggcgtgcatggcggagctgggcgtgccgctcaccaaacacccggggttccaccagtacgacgtgtacggcgacctcctgggcctgctcgcgtcccacccggtggcgccgatcgtgacgctgcaccacctggacgtcgtgaagccgctgttcccggacgcgaggtcgcgcccggcggcggtgcggcggctgttcgacgggccggtgaagctggacacggcggggctgatgcagcagtccatctgctacgacggcgccaaccgttggacggtgtccgtggcgtgggggttcacggtgctggtggccaggggcataatgtcgcctcgggagatggagatgccggcgcgcacgttcctcaactggtaccgccgcgccgactacacggcgtacgcgttcaacacgaggccgatggcgcgcagcccgtgccagaagcccgccgtgtactacatgtcgtcggcgcggcgccaggccgggcgcggcggggagaccacggtgacgcggtacgagcggtggcgccacccgaacgagacgcggcccgcgtgccggtgggacatagccgacccggacgcgcatctcgatcacatcgtcgtcctcaagaagcctgaccccgggctctgggacaggtcccccaggcgaaattgctgcagagtggtgtcttcgcccaaggatggtggggagaacggggagaagacgatgaccatcgatgtaggcgtatgcagggaaggcgagttcagccaagtagcaggagcgtgatga

SEQ ID NO: 415 - DNA, 1358 bp, Sorghum bicolor
ggttcagcgggtattcttaccattttcagattcagctggttgaacaaaactcgtaaagatggcatcagaagggaacaaagatgtacctaatgaaactttgtctgtggaccagtcatcgatttctggtgtaaagcgcaagcgtggccgcccaaggaaatacgagtatcctgtatatgaactaccacagaaggtacagcccctccagagcgccccacctcttcttcactgcacacaagatggctcaagtatggccagccatacatcaggtggcagtgttcatggtaattggtctgctcaacctagaaattcggctaatgtttctcttcaaggtaattctggcaaggataacgttcttggcaagcattttgttggcaagctgaccaagaaagttcctgggttttccctcattacggtaaaagtgaaggacaatcaggtgctcaaaggttgggttccagatgaaattaatctccgtccaataacacctaaggatgaccttgccccagagctacccatgcttcgaccgagtcaagttcgaaagcgagcatcagcaattcatatgcaacctgctcttcctgtgccaatgcacctggaggatgttacgcttgcaaagcctctgcagatgaggagacctgttgagaaaactattgctaagcatgctgtgcctcttgctcctaggccttacattggttctggtgttgttgcagcagtacctatatcagttgctcccagtaatcctgaaatgagaactttggccaggcaggatgctgaacttgtgatcccacaatcatcagttgctgcggtgccaattaaatctgtttgtcctgtctcggtaccatgcaagcaaccggctaatcaaaaagagtttactggaaagaagtctgttgatgaggttcagaaagattcagaacctccaaatgtgaccaaggaatcaccagtgaaagctgagaaaccaaacattgctcttgtggatgtagtggtcaaggattctccaggggaaaggcaacagcttaatgatcaagtaacagatgtgattagggaatcttctggtcaaactcagaatgttgatgtgacaatgtctgatgagatcaagatagcatcaggcgccagagatcagccaaattctgcaaatagtgaacagcagagttctaaggaagcatcagacatcacagaacaatctgagcagctgaagacagagaccgatgtcaataaaggagtcgatgcctcaaagtcaaatgcctcagatgacattcagcctgcgcatgatgaacaagaaatgaaggttggcggtaaatgaaagtagagatcaagattcaatgaacacaacacagatcctgatgtttagtgaaagtttgctgcct

SEQ ID NO: 416 - DNA, 1113 bp, Sorghum bicolor
gtgcctactccactgtccactccgctccatcctcccttcctccttcccgatgcctccgactacgatgccttccacttccctcgccctccccaccgccgcccgcgccggcgctcgccgccatgccttcttcagcaaccgatcaccctcaagcgtccccatcgcgcggcggaggcgcgcgccccggttcgtcatggtctccgcctcggcgtctctggaggcactcatctttgattgcgacggcgtcatactggagtcagagaacctccatcgccaggcctacaacgacgcgttcgcgaactttggggtgcgctgcccgccggcctccgccgacccgctgtactgggacgaggctttctacgacgaactacagaaccgcatcggcggagggaagcccaagatgcggtggtactttggagaaaatgggtggccttcttcagagctctttgagacaccaccttcgactgacaccgacaaggagaagttggttgacataattcaggattggaaaacagagagatacaaagaaataataaaatctggaactgtgaagcctagacctggtgtgttgcggttgatggatgaagtaaagaatgcgggtatcaagcttgctgtttgctctgcagcaactaaaagttcagtcataatgtgccttgaaaaccttattgggcttgagcgatttaatggtctggattgcttccttgctggtgatgatgttaaactaaagaagcctgatccaacaatatatataacagcatcagagaaattaggtgtcggaagcaagaactgccttgtggttgaggatagtgttattggattactagctgcaaaaggagcagggatgtcatgtataataacatatacaccttcaactgctagccaagatttcaaggatgcaattgctacctatcctgaccttagtaatgtcaggcttgaagacctcaagctattactccagaaaactcttgttactggataatacatgcgattattccctggatgttgaacatttggtgctggatgttgagcaataggtgaatccaagatatacatcttgttgaatagttggtgttatatgttggaagacatgattactcaaatggaagtgaagatccg

SEQ ID NO: 417 - DNA, 722 bp, Sorghum bicolor
ggctgatagaatctttggcagccacatccatggatatactgctaggttccgggagattcttggcgcgacggcttcctcccctcgcgctcgtccctcgctgctctcgaggctccccggacaaaagcggcagcgacaaaggtgaaacctctactgactgggacaaggcatgggctagctttaagaataaagggaagaggaccctcttttctgatttctcaccaaacaagtacgtgacctggaacccacggcgcagcgagtatccattgtcagaagaggttgatccaatcaagagaactgaaagatctaacttgatgctgtggacaagtccccagtttaccttggtgggggcaattatcatcgtcttgacattactaatctatacactagttgttcctcccaagtaactgcagaggtgacagctaggaggtgagctgtaaactaatatttctactgggaagtatgtattgtacatttttacatgtattaaaccaactatagcagtattgcttcaattgcaatcaagtagatataacaccacgtccattccattctggaggttttcttcaattgtatactaaatggctgctctccgagtctttattcctccattataacgaagaaatatttgggatgggtagaataatatgttggtcggttttctataatcacaatacatgttgatgctcctgatgcaacttttgtgcatgttatcacttctcagc

SEQ ID NO: 418 - DNA, 2362 bp, Sorghum bicolor
ttctccacccactgactgaccccaatggcgacgccggtcccggcggaggcggacgcgggggaggcgcgggagctcctctacgaggcgtacaacgagctgcaggcgctggcgtccgagctgggcggtgcggcggtggcgccggcggtcgtggtcgtcggccaccagacggacggcaagagcgcgctggtcgaggcgctcatggggttccagttcaaccacgtcggcggcggcaccaagacgcgccgccccgtcgcgctccacctccgcttcaacccgcgctgcgacgagccccagtgccgcctgctctctgcaacaggggacgccgacgagcatgatgaagccggggttgccgcgcgccccatgccgctcgccgacatccaggcatatattgaagctgaaaacttgaggttggagaatgatccatgccaattttcagagaaggaaatcataattaaggtagaatacaagcattcccccaatctcaccattattgacactccaggcctcatccttccagctcctggccgtaaaaacagagttttgcagagccaggcttctgctgttgagaggcttgttcgtgctaaaatccagcataaagagaccatcatactgtgccttgaagactgtagtgattggagtaatgcaactacacggagagtagtaatgcaggtcgaccctgatctcgccaggactgttctagtctctacaaaactggacactaaaataccacaatttgctcgcccctctgatgttgaagtgtttcttcacccaccaacatgtgtgctagatgtttccttattgggagattctccctttttcacatcagtaccctctggtagagttggttcttgccatgaagctgtgttcagatcaaatgaagagtttaagaaggccatcttatcaagagagatggaagatattgcatctattgaagataagttaggaaggtcacttacaaccaaggagagagatagaattggagtgggtaatttaagattatatttggaagagttgctgcagaagaggtatgttgagagtgttccattaatcattccacttcttgagaagcaacatcgaaatacaacaagtaaattgcgtgaagtcagtcatgaactcagtgatctgaacgaagccaaactgaaggagaaagctcagctattccatgactcatttttgaccaagttatctttgctattgaaaggcatggtggtggcaccccctgataaatttggagaaactttagttaatgagaggattaatggaggaacatttacaggaagtgagaatttccagctcccgaacaagatgatgccaaatggtggaatgcgtctttatggtggtgcacaataccatcgggcaatggctgaatttcgtctggtagttggtagtatcaggtgccctccaataactagggaggaaattgtcaatgcttgtggtgttgaggatattcatgatgggacaaactactccaggactgcttgtgtaattgctgtggcaaaggcacgtgacacatttgagccattccttcatcagctgggttttaggcttttatacatactgaagaggctgatcccaatctgtgtttatctgctggagaaagatggtgagggctttagtagccatgaagtgcttgtaaggcgtgtccaggaagctttcaagaggtttgctgaatccactgagcaatcatgtcgtcaaaggtgtatggaagatctggagagtaccactcgttatgtcacttggtcccttcacaacaagaaccgtgctggattgagacacttcctcgattcatttgttgcaccggagcaactatcagtgaatacactgaacgagcagttttctggcttgaatgacaacaaacaggacagggcaaagggtgactcgaagtcaaaccattcagacacaaattcgtctagtgctgtgccagagacaagactagttgatctattggatagcacactctggaacagacgtctggtgccctcatctgaaagacttgtttatgcgctggttcaccagatttttcttggaatcaaagagcattttcttgtcaccactgaactgaagttcaattgctttctcctcatgccgattgttgacaaattaccagcacttctaagacaagaccttgaatcagcttttgaagaggaacttgatagcatctttgatgtcactcagctgcgccagtcacttgggcagaagaagcgagagctggagatcgaactgaagcggatcaagcgcttaaaggataagtttggggagataaacaagaagctcaattctcttcaggttaggcagtagccagtaggtcagcccaaaatttagcagtagcttggtagacagtctaggtagtgtttcaatgctg

SEQ ID NO: 419 - DNA, 713 bp, Sorghum bicolor
aaggacaagtaagcaaagcacctaaaactagccgccagctcggaatcgtcgtcggagccactccacccacctgctctgctcctcatggccagcaccagcagcagctaccccctgctgctgctgctcctgctgctggcggccccggccgcagccgccgccgaggcgtccgtcggcgtcggcatcgtcggcggcggcaacgcgaccaccacgacgtcgtcgtcgccgacggcgtacgagatgctggagcggtacgacttcccgcgggggatcctgccggcgggggtgtccgggtacgagctccgcggggacggcagcttcgaggtgtacttcccgcgccgctgcgagttcctgctggcggggacgtggctggtccggtacgagccccgcgtgcggggctccgtcgcggccggctccctcacggcgctggacgggatcagcgtcaaggtgctcttcctgtggctcggcgtcggcgaggtggaccgcgccggcgacacgctcagcttctacatcggccccgtcgccacctccttccctctcgacgacttcgccgagagcccgcgctgccgcggctatgactatgatggcgatggtgatggcgctgctgccggcgacgacttattcccggcggcggcggtggcggcctcgtcgtgacccggcgcgatgattagtatttgtacaattgtatgtatgtacctgccgccttgatgatttag

SEQ ID NO: 420 - DNA, 886 bp, Sorghum bicolor
cctctgtaggcagatcagtgtgtcgttgcagaggagggaagaggaccagccatggcgacctccttccaggggacgaccaccaagtgcaccgcctgcgacaagacggtgtacctcgtcgacaagctcaccgccgacaaccgcatctaccacaaggcctgcttccgctgccaccactgcaagggcaccctcaagcttgccaactacaactccttcgagggagtgctctactgcaggcctcacttcgaccagctgttcaagaggaccgggagtttggacaagagcttcgaaggaactccaaaggttgtcaagccagaaagaaacgttgggaatgagaatgctgttaaagtctcaagcgcctttgctggcaccagagagaaatgtgttggatgcagcaagacagtctatccaattgagagggttactgtcaacaacactatgtatcacaagagctgcttcaagtgctgccatggaggatgcaccatcagcccttctaactacattgcgcacgaggggaagctctactgcaagcaccaccacattcagctgatcaaagagaagggaaacttcagccagcttgagaatgatcacgagaagacgtcacaggctgggtcactggaggatgaagaagagtattaatcactgagcactatcacagatgaataattaatcttcttgcatttgcttagagcactatatatttctgtggcatggttcgatttcaattttaccaatggagctcatgtgcgttcagagaacaatgaaattatcgtcttgtatctgcatgtaaacctttgttatctttgagtcaaatactctacctgtttcaccattttcattgatcagaagatgcctctgcagtctgcaccaagaagacacagaactgcaa

SEQ ID NO: 421 - DNA, 815 bp, Sorghum bicolor
caaccaatcttcctcgttccgccgctcccactccagcggcgccggcggcgaggcgaggatctccacagcggccgcacctaccaacgtccaggagcaatggctctgtctgcgcctatacggatttctctcatcgtctcgttctttgggattctgtcgttcatacttggtgtcatcgccgaaaacaaaaagcctgcttctggaactcctatcccaggaaaggatgtggtcatctgcaagtttccaagtgatccaactcttgcaatgggaagcctgtccattgtggcacttgttgtagctgccattgtaggccatgttgctatctttttcccatactcggacaagtcagttcctcgcggagcactgtttcaaagcaccagcttgacagtgttctttgttgttgctgagctcgtctcagccctggcttttgcaatgttgttgtgggcaactatcactgagggacttcaccgcagcaagaacatccaccacgacatgaattaccagtgccctactgcaaagaccggcctgtttggtggtgctgctttccttgcccttgacgctgctctcttctggcttgtttgccagatgctggccctcaatgcaagggctgactacctggacgaggatgacaacaagggcgaatatggccaggtttatgccgatgaagtcgatggctcgaaggtctgagcctatgcagtcatgcttgtcagggttttatgattagtgtcacttaactatattgtgtcatcaacaaagtcgctttagctctcgtaaatttgtatataagttggaaagtcttgcataaggctggtggttat

SEQ ID NO: 422 - DNA, 1227 bp, Sorghum bicolor
gccaactggagtagtagccaaccgccctcctctcccttccctccctcacgcacaaagcagagcaggcaacggcacagcacagcacagcacaggtagagagagaaagaggagcgcagagccaaagaagcagagcaacagcagcaggtcgaggaagaagagaagggaagaggaagaggagagaaggccaggaggcagcagcaaccaagaagggggaagagagcaagatgctgcgcgggggcacgagcgtgctggggatcatcaacttcatcaccttcctgatctcgatcccgatcctaggcggcggcatctggctagcctcgcgtgccaactccaccgactgcatccgcttcctgcagtggcccatcatcgtcgtgggtctcgtcctcatggtcatctccctcatgggcttcgccggcgcctgctaccgccagacctggctcctccgcctctacctcttcgccatgttcttcgtcgtcctcgccctcctcttcttcatcgtcttcgccttcgccgtcaccgaccgcggcgacggacaggtcgtcatgaaccgccggttccccgagtaccagctctccgactacagcggctggctccgcgaccgcgtcgctgacccggagtactgggccaccatcagcgcttgcctccgcgacggccacgcctgcgccggcatgaggcgcctcgcaagggaccccaacaccggcatgctcgtgccggagacgcctgccatgttctacggccgcaacctctccccgattcagtctggatgctgcaagccaccgacatcatgtgcattcacctatatgaacgagacgtactggacacaaaaccctggtgtgccgactgtgatgaatgaccctgactgcagcaggtggagcaacgaccagcagatgctgtgcttccagtgcgactcatgcaaggctggcgtcctagcgggcatcaagaagagctggcgcaaggtggccatcctgaacatcgtggtgttgatcatccttgtgattgtctatgtcgcgggctgtgccgcattccgcaatgccaagaggatcgagaatgacgagccgatcggcatggcacggatgaccaagtcccatcctagcaggttccagttctaggcagctgctgctgcgggtttggaagcttttgccttgtacaaatgatcacaatgggtggtgctaaggcttaggctttgttatatcttactgaaatgtggattctactgcatttggtggt

SEQ ID NO: 423 - DNA, 1192 bp, Sorghum bicolor
catccagatcactaaacggcagcagcagcaacagcacgagctccctgcagtagccatgacgactaagcgctgctgcctgctcgtcgccacgctcctcgcggcgctgctggtctcggtcacagcccgcctcgacgtcggcttctacaacaagacgtgcccctccgccgagagcatcgtgcagcagaccgtggccgccgcgttcggcaacagctccggcgtcgctcccgcgctcatccgcatgcacttccatgactgcttcgtcagaggctgcgacggctcggtgctgatcgactccacggccaacaacacggctgagaaggattcgcccgccaacaacccgagcctcaggttcttcgacgtggtcgaccgcgccaaggcgtccctggaggcgcagtgccccggcgtggtctcttgcgccgacatcctcgccttcgcggcgagggacagcgtcgtgctcaccggtggcctcggctaccaggtgccgtccggacgccgtgacggcagggtatccaatgccacccaggccacgaacaacctgcctccgccgtttttcaatgccacccaactggtagaccgcttcgcctccaagaacctcacccttgaggacatggttgtcctctccggtgcacacaccctcggtgtctcccactgcagcagcttcgccggacctgccaacctgggcgaccggctctacaacttcagcggctcagctgacgggattgatccggcgctgagcaaagcctacgcatttctcctcaagagcatctgcccgtccaacagcagccagttcttcccgaacacgacaacgttcatggacatcatcacacccgacaagttcgacaacaagtactacgtcggcctgaccaacaacctcggcctctttgagtcggacgctgcgctgctaaccaacgcaaccatgaaggcgctggtggactcctttgtgcgcaacgagaccacatggaagaggaagtttgccaagtccatggtcaagatggggaagatcgaggtgctcaccgggacgcagggcgagatcaggcgcaactgcagggttatcaaccctgctagcgccaccgatgttcttgccagtcagtcaggttcttcaggattcactggagtggctgcaagttaaccataccggttgtcagttcatgtgcgtgcagtgtgtttggtgtgggatgtgatcgatatttag

SEQ ID NO: 424 - DNA, 1685 bp, Sorghum bicolor
caaagcttgaccaaccatggcgtcggtcaggtcgtgcgtgtccgtgaagtccgccgtgagcccggtcaggtacagatccacgagggccagggcggccggtctgggggctccgggaaggctgcgcgtacggtccccgtccctggcgctcggcggcgacggtggctgcgccagcgccagcagcagcgggaggggtagcgtcgtcgtcagtggcggcggtctcggcgtgctcggcggcgatggaccgaggatcatccggcggggcggcgggcgggaggtcctcgccatgtgcagcgcgagcttcgacggggtccgtcccgccgccggcgccggcgctgccgtggccagcgccgtgcagcccgtgccggcggcgttccccgagcgcgtcaaggtggtggcgctggtggcggccatcatgctgctctgcaacgccgaccgggtcgtcatgtccgtcgccgtcgtgccgctcgccgcgcagtacgggtggtccagctccttcgtcggcatcgtccagtcgtcgtttttatggggatatgttttctcatccatggttggaggagctttggcagacaaatatggcgggaagaaggtgatggcaggtgctgctgcactctggtccttggctacaattctcactccttgggccgcctcccgctccaccatcatgttgcttgctgtacgtgcactctttggccttgcagaaggtgttgcatttccgacaatgagcaccttcttaccaaagtggttcccaacacatgagcgttccactgctgttggcatttccatgggtggattccatcttggaaatgtcataagcttcctagcaacaccgatcatcatgtcacacataggcctctcgggaacatttgccttcttcgcgtcgcttggttacgtgtggctctttgtatggatgttaaatgtagaaagtgatcctcttgacagccgtactataagcaaatctgaattggaattaattctagctggaagaactggatctaaagtccaaggcagtaaattcccatccctaagggaattgttctcaaggactgaattcttagctgtcactttggccaatgtggtcaacaactggggctattttgtcctattgtcgtggatgcctgtgtacttcaaaacggtttataacgtcaatctgaaacaagcagcatggttcagcgccataccttgggcagtcatggcgatgtccggttatgttgcaggagcctctgcagatttcctgatcaaatctggttactctattggactagttcggaaaattatgcagtccattggtttcatggggccttgtgtgtcattactatgtttaagatttgcccaaactccatcagttgctgcagttctcatgaccactgccctgagcttgagttctttttgccaagccggatacttttgcaatatacaggacattgctccaaaatatgctggatccttgcacgggttgacgaacggcatagggacggtggccgccatagttagcaccatcgggaccggctacttcgtccagtggctagggtccttccaggccttcctcaccctcacggcggcgctctacttcagcgccaccgtcttctacaacatctacgcaaccggcgacctgatttttgactgagacgaacttgctaaatgccagtaatgattcttttgtgcagacgcagaatcccaaagtgtac

SEQ ID NO: 425 - DNA, 840 bp, Sorghum bicolor
atgtcatgtggcccctctgcgtcatctccgagaagctcttcaagatggcgggcgacgacgccgtgcagggcgcggcgggctcgccgtccctcgacggacagattccactagcacgccgatcgtactacgtcgatgttccgcatgtgcagcaggccttcacctgggactgcggcctcgcttgcgtgctcatggtgcttaggacgctcgggattgattgctgcgacggcattgcccatctcgagaggctctgccgcaccacgagcatttggacggttgacttagcatatctgttaaacaagttttcagtcagtttttctttctttacggtgactcttggagcaaatccacaatattctgctgaatccttttatagggagcaattgcaagaagacatcaatcgtgtggatgagctatttgggaaggcacttgatgctggaattagtattcaatgcaggtccatcaccgcatatgacattgcttttctactgctatctgggcactgcattgctattgctttagtggacaaatcgaagctaaatttgccgtgcatgagtgatcatgatgtgcaacagttcaacgaggagtcagactacatggggcattatgtcataatatgtgggtatgacgctgatgattgtgaatttgagataagagatcctgctagttccaggaaacgcgaacgggtgacaatgaagagcttagacgaggcccgcaaatcctttggaacagatgaggatattctcttggtttccttaacgggaaagagtggaatgaagctctcacgtaaactacttgcctgctccatgtaaataggtcactagcaagcaaccaaccaccttg

SEQ ID NO: 426 - DNA, 3202 bp, Sorghum bicolor
aaagagctcccgccatggataccctcaagcgcaaggccccggacggccccgaagctgccgaccaggcctctcctctgaaagcaccgcgcgtcgtcgcccccacctcggagcctcccgctcccaccgccctcgcgaccgcggaaccagtcgcctgcgtgcacgacgtctcctaccccgagggctacgacgcgtctgcctctacgtcccgcgccattgccggcggcgctgacgcctctgagccagcaaggaagttccccttccagctcgaccccttccagtccgaggccatacgctgcgtcgacaatggcgaatccgtcatggtttcagctcatacgtctgccggaaagacagtggttgcgttgtatgcaatagcaatgtctttgcgcaaccaacagcgggtcatctacacgtctccaatcaaggcactgagcaaccaaaagtacagggagttcaaagaagagttctctgatgttggtctcatgacaggggatgtcacgattgagcctaatgcctcttgtctggtcatgactacagaaatttggcggagcatgcaatacaagggatctgaggtcatgagggaagttgcttggattatttttgatgaggtgcattacatgcgggatagagagagaggagtggtctgggaggagagtatagtgatggctcccaagaactcacgctttgtcttcctctcagcaactgtacctaatgccaaggagtttgctgattgggtagctaaggtacataagcaaccctgtcatatagtatacactgactatagacctacacctcttcagcactatgtatttccttctggaggggatggattataccttgtagtggatgagaagggcaagttcagagaggacagttttcagaaagcattgaatgcccttgtccctgctagcgacagtgccaagaagaaggagaatgggaagtggcagaaagttatcatggcagggaaatctagcgaggaaagcgacatattcaagatggtgaaaatgataattcagcgccaatatgatcctgtaatacttttcagctttagcaaaagggaatgcgaatttcttgctatgcagatggctaagatggacttgaatgaggatgacgagaaggcaaacatcgaaacaattttttggagtgctatggatatgctttctgatgatgacaaaaaacttcctcaggtttcaaacatgctccccttactgaaacgcggcattggcgtgcatcattctggtctgttgcccattttaaaggaagtcattgagatactcttccaggagggcctcattaagtgtttgtttgccacagaaacattcagtattggtctgaacatgcctgcaaagactgttgtgtttaccaatgtgcgaaaatttgatggagaccgattcagatggttgtcaagtggagagtacatccaaatgagtggccgtgctggtcgtcgaggtattgatcagcgtggtatctgtatactgatggtagatgagaaaatggaaccttcaactgccaaaatgatgctgaaaggaagtgctgatagtttgaacagtgcctttcatctgagctacaacatgctgttaaatcaaatgcgatctgaggatggggatccagaaaagctcctccggcattcattttatcaatttcaggctgatcgttctctccctgatcttgagaagcaaatcaaggaactggaatcagagagaaattcgatggtcattgaggaagaggagagcttgaaggattattatgatctcttacagcagcacaggagtttaaagaaggatgtccatgatattgtcctctctccaaaacatgttctgcctttcttgcaacctggaaggcttgtccgcattgaatatagtacagatgagccagccaacttttccattgatgaaaatgtcacatggggaattataataaactttgaaaaagtgaaatcccatggtgaagataggagacctgaggattctgattacacggttgatgtccttaccagatgttctgtaactaaggacaacaatggtaagaaaacaatgaaggttgttcctctgaaagcgcgtggagaaccagttgtagtttcattgccactttcacagattgatggactaagcagcatacggatgtacatacctaaggatcttttgcctgtagaagctcgagaaaacaccttgaggaaagttgaagaagtcctttcaaggtttgctaaagatggggtgcctctattggatccagaagaagatatgaaagtacaatcgaaatcatttcggaaagctaccagacgaatagaagctctggagagcttgtttgagaagcacgatatccgtaactctccacatatccagcaaaagctgaaagtctttcatgctaagcaagaactatcagccaaaataaagtccataaagaaaacaatgcgatcttccactgctttagctttcaaggatgaactcaaggcccggaaacgtgttcttcgcaggctgggatatgttacgagtgatgatgttgtggaagtgaagggcaaagtggcctgtgagataagttcagctgatgagcttacattgacggagcttatgtttagtggtgctctgaaggatgctacagtagagcagatggtggcactgctttcttgctttgtttggcaggagaagctccaggatgccccaaagccaagagaggagcttgatttgctcttctaccagctgcaggagacagcaagaagggttgctaaccttcagcttgaatgcaagatccaaattgatgtggaaagttttgtgaattctttccgacctgacataatggaagcggtgtattcatgggccagagggtcgaagttctaccaaatcatggagatgacccaagtgtttgaaggaagcttgatcagggccatcaggaggctggaggaggttctgcagcagctgattctggcatccaagtctattggggaaaccgagttagaagcaaaactcgaggaggcagtcaacaagatcaagagggacatagtgtttgcagcatctttgtacttgtaatgtctagatgggtcaggggctaggtcaaaagctcatagggaattaagcgctcttaatttgctgctgttgtcagagtgctgttggcatgatgaagctgcctgatttgctgttagcagtaatgtggcagtgaaattttgttagggttaaccatgcagggtctatttgaaggtcaaggtaccttt

SEQ ID NO: 427 - DNA, 595 bp, Sorghum bicolor
ctccccagtctccacctcgatcgccatggcgacgacgccgccgcctccgcctgctcccgccgccgcgcacacggtcttcgtctacgggagcctgatggcggacgaggtggtccgcaccatcctcaagcgcgtcccgcccgccgccccggcgctcctcccgaactaccaccggttcaacatcaagggccgcatttacccggccatcctgccagttgaaagcaagaaagttgctgggatggttatcacgggtgttactgacgaagagctccaacttctggatgcttttgaagatgtggagtacacgaggacaagagttgagatatcgttgactgactctttggagaaaatactggctgacgcttatgtatggagtgatgcagaggaccccaatctttatggcgaatgggattttgaggagtggaagaaactgcatatgaaggatttccttgcgatgacaaatggtttcatgcatgaactcgaacagcctgaatcgaagaccagggtggagacctacgagtcattcatgcaacaacaggaacagcctgtgccggggacccaggttgagggttgagagttgcaatctgctgactgctga

SEQ ID NO: 428 - DNA, 1959 bp, Sorghum bicolor
aggtggtcgctgtagagaatggggaaggggaagaagtcgaaggagaaggagatggagaagaaaccggtggacatcctcgcggggtccgacgaggactccgatggcggggaggatctctccaaggtccagatcaacgaggagtacgcgcgccgcttcgagcacaacaagcggcgggaggcgctgcagcgcctcgaggagcgcaggaagcagggcctcgtccccgcctctgacgacggcgagtcggattccgagtccgagtcgactgaggaggaggacgaggaggccgccattgcctcgcgcctcgtcgaccgccgcgtgttcgaggtgatccgccgcatccgcagcggcgacccccgcatcctagacaaggacgccaaggtctactcggagtcagaggaggaagagggcggcgaagaaggtgaggacgccgagaaggaagaagagtccaagcaggggaagaaaaagaccaagaaggagaagcctctatacctcaaggacgtcaatgcccgccacctgctcgaggagggcccggagttcgcagcgcaggccagccggagcagcagcaagttcgagaggatcgcctatgatgagcagcagaagaagggtttggaggctttccttgaggcacagaaagaagtattaggagacgacgacgacgacaatttgttccaggtgaagcccaaggttagagcaggggctgatgatgaagtggaggaggatgaggaggagaagcagaccaaggagcttgctggtgaggtctttgggaacgatgaggagctggatgagaatgagaagttcttgaaggaatttttccttaagaggccgtaccttgaggcagagaagaggaagtcctatctggatgatatccaggaattgtcagatgatgaagaagagctcgagattcaggaagaatatgagcatggttataattaccggcatgaggaggccatggcatcaggggcagtggtggcggaccgggtaatgggacattcaagggttgttgaagggtcagtaaggaagaaggagagcagcaggaagcagcagcgcaagagcaaagaggagcggatggctcgtattaagcaacagcaggcagaggagctgaagcatctcaagaatttgaagaagaaagagattgcagtgaagcttgagaggatccgaatgatcgctgggattgaaggcgatgctgcatgtaagcttggtgctgatgacttggaggaggattttgatccagaggattatgacaagaaaatgcaggagatgtttgatgacagttactatgatgctgatgatgttgatcctgagtttggaagtggtgtggagatggatctggagaagccggattttgacaaagaagacgaattgctcgggcttcctaagggatgggctagtgaccagtcaaaagaagagtctactgccgctgatgcgaaaggtgcaaaagggaagatctctctcaaagacaaggtggagcttgagaaagagatggaggagtactacaagttagactatgaggacactattggagatatcaagactcggttcaagtataaacaggttaagcccaacagttttggtctgagtgcctgtgatatattgacatcagatgacaaggatttgaaccagtatgtttccattaagaagctagctccttacagagaggatgaatggaaggttacgcatcataagatgcagagcaaggatttgatccttggaggccagaaggaagggaagaaggacaaatctgtcaagaaatctaggtctgaggaaggcggccctagttcttcaaaaacagagaaagacaggctgacaaatgggcaagagtcaacagatgacaagaaaaagactacccgaagtgagcgaaggaagcgtcgtaatgctgacctaaagatatccgatgatcgattagcggcatttggaaagacaaattcgaagcgtcacaagagccattgactttctgagtga

SEQ ID NO: 429 - DNA, 580 bp, Glycine max
cgcaagagaagaatagaaaatggatatcaggttgatggatttggactctccattgttcaacactctgcaccgaatcatggatctgacagaggacgcagagaagaacttgaacgctccgacgcggacatacgtgcgcgacgcgaaggcaatggctgcgactcctgcggacgtgaaggagtaccctaactactacgtgttcgtgatcgacatgccaggcctgaaatccggggacattaaggtgcaggtggaggatgataacgtgcttctgataagcggcgagaggaagagggaggaggataaagagaaagaaggggctaagtatttgaggatggagagaagggttggcaagttcatgaggaagttcacgcttcccgagaatgccaacaccgatgctatctctgccgtctgccaagacggtgtgctcactgtcactgtcaacaagctgcctcctcctcagcccaaaaagcccaagaccatagaggttaagatcgcctgaattaatttcttcgtttgcactgagacctgctatcatttcctcttttccttttgtgtgtgccaatgcttttctatctttccgtag

SEQ ID NO: 430 - DNA, 644 bp, Glycine max
tggacgaagatggtaaatgggaatgtgaaaataaccagttgggtccaaaagaagatcactgatccccttctctccattatccgaagaggaactgaaccaaaccagttggctttctctgctgctcttggtattacattgggactatttcctatatgtggtgtcactgtgttcctctgcggaatggctattgcattgcttggatcattttgccatgctccaactgtgatgcttgcaaactttattgctactcccatagagttgagtctggttgtaccctttctacgccttggtgaggttatctctggtggatctcatttccctttaacatctgatgctttaaagaaagttcttactggccaagcttcacgtgaagtcttattaagtgtggcccatgcgttattagggtggctggttgcatcaccatttattttgggaactctatacatagttcttttaccatgcttcaaaattttagttcataatttctcaagtgttcctttaagtccaaagaagccgctcaatccacactcagaagtaaagctgaaggtaagggatgtttgacaaagtagcaacgatatcatagtctcaaaatctgctttgtcacagtgatcaatcattgattcctatattcttgcgtgacacaa

SEQ ID NO: 431 - DNA, 640 bp, Glycine max
catttcgtgctttaccagttatcttatctgggaatatctgctatgccattctaggattaagaatataaaaaaaaattgttgacagagatgtcagcgtatgacaatgttgttggtgggaaattgaagttgaagggaaaagcactggatgtggctggtggagtgaagaagaagaaaaagaagaacaagagaaatcaggaacaacttttgcaagtcgccgaagatgaagtttcagcaggtggaagtaaagaacaagccaaagattcaaatgatgaagatataaatgatgtgagtgaattaagcggggaagggaagacagctcattatgatgatcatcttacaccggtggagaggcgttacatagagcagagggagcaacttgatgttcacagattggctaagatatctaataaatctcaccgtgacagaattcaggatttcaaccaatatcttgcaaacatgagcgagcattatgatattcctaaagttggtcctggatgattcaatgaaggccaatccttatcatttgtatttgttcgttaatattaatgccgtgtgcccgcacaatggttattgtcactgcatattgatactttgttttggattcatatgatagatatatttggtttctctccctgtggat

SEQ ID NO: 432 - DNA, 2428 bp, Glycine max
aagataacagaaagaaagggtttgtgaagatgggaagaagaaacggtggtaggtcccttcaagaaaccctccgtcgccgacttgagtcatgcaaatccaaatactccaccgccgaagaattcgccaaccatctccgttcaacttatcccgattaccaccgaaccaagcaccaaaccctaattcgatttgttcaggaagctcttcattccaccgccaagcttaatcacactcccacacccaagcactgcgacggcgacgacgatgacgacgaagaaggagaggctcaaagcgcgtctcgaaagcggcggaagaaaatcgatgggagtgaagagagattgcagaggatggaagcgttacacgtccgaagcaaggtgcagagatcttcctcatcgtcctctgcttcggagagcgacgatgaagatgaagaagaaaccgtgtcgacttcggaggacgcaatttacggggagaaggtggagcctgagtttgatttgatgaagacaatgctgcgaaagtcgtatacgccgaagaaggttgccgcggaggaaaaaaacgttgaattggaggtggggaatagcagtaaggacactcttgtgaacgaggaaaggaaggaagtgaagggctcaagttcgggttcggtttcgaacaggaaggacggaccgaggtttaaggatttgggtgggatgaaggaggttttggaggaactgaagatggaagtgatcgtgcctttgttccacccccaattgccaagacagttgggagtgagaccaatggctggcattttgttgcatggaccacctggctgtgggaagactaaacttgctcatgccatagctcatgagactggtcttcctttctatcagatttcagctactgaggtggtttctggagtttcaggtgcatctgaagaaaatattagagagctttttgctaaagcgtacaggtctgcgcctgctattgtctttattgacgagattgatgcaattgcatctaaaagagagaatttgcagcgtgagatggagaaacgtattgtgacgcaattaatgacttgcatggatcaatcaaataggcttcttcaaccagcggatgatgtggagagttctggtgatgatcatcatcctggctatgttcttgtaattggagctactaataggcctgatgctgttgaccctgccctaagaaggcccggccggtttgatcgtgagattatcattggcaatcccgatgaatctgccagggaggagatcctttctgtgctcacttgcgatcttagacttgagggtttatttgatctacggaaaatagccagggctacatcaggattcgttggtgctgatttggcggctctggttgacaaggctggtaatcttgctatgaagagaataattgatgaaaggaaacgtgaattatctcaagatctcacgagtgagcatgctgaagactggtggagggaaccttggtcggttgaagaaataaacaagcttgccatcaaaatgtccgatttcgaggaagcagctaataaggtgcaaccttcattaagaagagaagggttctcttccattcctaatgtaaaatgggacgacgttggagggcttgatcttttaagaaaggagtttgaacgttacattgtaagacgtataaaatatcctgaagattatgaggagcttggggtggatctcgagacgggatttttgctttatggacctcctgggtgtggtaaaacactgattgccaaagctgttgccaatgaggcaggggctacttttattcatattaagggacctgaacttttaaataaatatgttggagaaagtgagcttgcagttcgtacaatgtttagccgtgcaaggacatgtgcgccttgcatacttttttttgatgagattgatgctttgacaaccaaacgtggtaaagaaggtggttgggttgttgaacgactattgaaccagttgcttgttgagttagatggcgctgaacaacgaaaaggtgtttttgtgattggtgctacaaataggcctgaggtgatggatcgtgctgtcctacggcccggaaggtttggtaaacttctttatgttccacttccaagcccagatgaacgagttttgatattgaaagctcttgcaaggaagaaggctgttgatgcctctgtggatttgagtgccatagcaaaaatggaagcttgtgaaaacctaagtggcgcagatcttgctgcattgatgaatgaagcagcaatggctgctcttgaagagagattgacctctattgagacaacttgtgatacattgaccatcaagaggaccatcaagaggcaccattttgaggtagcactgagtaaagtgtctccgtctgtgtcagacaggcaaaagcagtattatcagcatttgtcagagggctttaaagcagcatgagcagcatgacattcactttgtta

SEQ ID NO: 433 - DNA, 800 bp, Glycine max
atctcctgaagcagaacatcacctttcctatttactcactgtgtgatctaatcttcttctatgggttggcttagtcggttcataactgccgtggctttcttagccatcggagtgatattctcaccggagacactggggtcaaaatcaaccacactttccacctacctcaaactcgctcacctcctctgcttctccaccgccttcggcgccgctctgtgggtaacattcatcggcggcatcatcatgtttaaaaatctgccgcggcatcagtttgggaacctgcaaagcaagatgtttccggcgtatttctcgatggtgggtgtctgctgcgccgtatcggtggcttcctttggctaccttcacccgtggaaaacttcctccaccactgagagataccaacttgggtttttgctctcttcctttgcgttcaatcttaccaacttgtttgtctttacacccatgaccattgagatgatgaagcagaggcataaagtggagagagaaaataatataggggaagaagttgggtggtcaaaaaatgtagaagttgcaaagtcaaacccaaagcttgcagccatgaataagaagtttggtatgattcatggattatcctcccttgccaatataatgtcgtttggcagtctagcaatacactcttggtacttggcaggtaaaattgatctctgattcagtttctgcttccaattctatgaaagacaagtgagtttcttgtgaagagatgtataagtgaggatctcagtgttctctctatcttccactttcttgctttattgccaagt

SEQ ID NO: 434 - DNA, 994 bp, Glycine max
atatcacagtgcacacccactctgaaatcctctccttttttcataaaccctacttctacttcccccctttgctctcaaaccttatcacctaatccttatcctcccaaaccagaaaaccatgtctacctccgcagcttccctcgcactcccaaccctcactctccgaacccgacaacctctatgttctccccaatgcttctcctcgtccctctccctcacacccaacaacaaacccatttccatttctgctgtttttctcaaaccaacaactctgtcgtcgtctcgcttcgttccccacgtcgtggtgtcgtcggatttggggcaggaggaggacaccttcagtgacggagacggccccagcttctcccccgaccttaagctctttgtcgggaatcttccgttcaacgtcgacagcgcgcagctcgcggagctctttgagagtgccgggaatgtggaggtggttgaggtgatttatgataagactactgggaggagcagggggtttgggtttgtcaccatgtcttcggttgaggaagctgaagcggctgctcagcagttcaatggctatgaacttgatggaagagcattgagagtgaattctgggccacctcctgctcggaatgagagtgctcctcgttttagaggtggttcttctttcggttccagaggtggtggtccttcagatagtgaaaaccgtgttcatgtaagtaatcttgcttggggtgttgacaatgtagcacttaagtcattgtttcgtgaacaagggaatgtcttggaagctagggtaatctatgacagggaaagtggacgatcaagaggctttggatttgtgactttcagtagccctgatgaggtcaacagtgcaattcagtccttaaatggcgtggacttgaatggcagagctatacgagtctcattagcagattccaagcccaagcagttctgaggatttagcttttcgtctatacccgagagaggatttcggtatttgtag

SEQ ID NO: 435 - DNA, 821 bp, Glycine max
caagcttagtcaaagtgtctgtgactgtcacacacagtctttaagatctggaagcgcttctcacttgcccacaacaacaattcctctcaatttcaaaattttcagcttcaaaataataaaaccctaagagaggggttgcaagcaaaatgagaagcgcaaagatgtggacggttttgatgtgtctgatggtgagcttcttcgctcgcattgaatcgctgtccgtgacggtgaacgacgtcgagtgcgtctacgagtacgtgctttacgagggcgacaccgtttcggggaacttcgttgtcgtcgaccatgatattttctggaactccgatcaccccggcattgatttcacggtgacatctgctgcggggaatactgtccacaatatcaagggaacctctggtgacaagttcagttttaaagccccaacacatggaatgtataaattttgttttcataacccttactcaacacctgagactgtttctttctacattcatgttggtcacatcccctctgagcatgatcttgccaaagatgagcatttggacccaattaatgttaagattgctgagctcagagaggcactagaatctgttacagctgaacaaaagtacttgaaagctcgtgatgcgagacatcgccatacgaatgagagcacaaggaagcgtgttgtattctacactgtgggagagtaccttctcttggctgctgttagtgcactgcaagtcatatacatcaggcgcctcttcagcaagtcagtggcctacaatcgtgtttgagtccccttcatgattaacgttatggtttccttcattagctag

SEQ ID NO: 436 - DNA, 806 bp, Glycine max
aaacttattcaccaaagagaaaccaaaaggctcaaaacacaaccatgatcaatcatgctctttgtttcttagtattcctatctgcactccatgcaacacatgcagttgaatacactgtcactaacaacgcactctcaactcctggcggcgtggctttccgtgacaaaataggggctgaatacgccaagcgaacacttgactcggccacccaattcatatggaggatctttcagcaaaacaacccttctgacagaaaaaatgtgcagaaggtaagcttattcgttgatgacatggatggtgttgcatatactagcaacaatcaaatccatctcagtgcaagatacgttggaaacaataaaggggacgtgaaaacagagataacaggtgtgctgtaccatgaaatggtgcacgtttggcagtggagtgggaatggtcgtgctcctggtggattaattgaaggtattgcggactatgttaggctgaaggcaaactatgcacctagtcactgggtgaaagcagggcaaggacagaaatgggaccagggttatgatgttactgcacgctttttggactattgtgatagtctcaaaagtgggtttgtggcacaacttaacaagttgatgagaactggttatagtgatcaatacttcgttcagttactgggaaaaccggttgatcagctctggcgagactacaaggccaagtatggcaatattgcctaataacctaagagctttttcatttaaagaataagcgagtatatcgcaatgtttttcaataagattgtatcagctctaagattctgc

SEQ ID NO: 437 - DNA, 1137 bp, Glycine max
atttcccaaacccaccctccaatccatggcttccctgaacctccttccccaccctccacttttctcttctttccttcacagaccacactgcaacacccatcttcttctcacaccaaaaccttctcaacgaaggccttctcttgtggtcaaatctactgtgggtgtggctgatccttctccatcttcttcttcctacgctggggatacctctgattccatctcttctttgaagctcaatctgctgagtgctgtttctgggctaaatagaggccttgctgcaagcgaagacgatcttcgaaaggcagatgatgctgctaaggaacttgaagctgctggaggacttgtggatctctcgcttggtcttgacaatttgcaaggaagatggaaactcatttatagcagcgcattttcgtctcgaacccttggtggaagccgtcctggtcctcccataggaagactccttcctattactcttggacaggtttttcaacgaattgacatcttgagcaaagattttgataacatagtggagcttcaactaggtgctccgtggcccctaccaccccttgaagcgactgccacattagctcacaaatttgaactcataggatcttcaaagataaagatagtatttgagaaaaccactgtgaagacagctgggaatttgtcacagttgccaccattggaggtgcctcggattcccgatgcattgaggcctccatctaatacgggaagcggtgaatttgaagttacatatcttgactcggatactcgcatcacaagaggagacagaggcgagctaagggtctttgtgattgcttgagttcctggtgaatgcaactatgcactatgcattttctctgttggacttaaaaaaaaaaaggtttcaacaccttgtgccatcattttgtttagttttttcctcctgatggtatttgttctaagttcttcaatattgtaaacatgatggaattaaactctactatatagttccaaggaagcagggtactttttgtttaagtgtaacatatttcttttttaaggaataattgcttacagatcattagatatggatacttgaatacactgttgagagaattccccttcagtcttagactctgttcgcattggtataat

SEQ ID NO: 438 - DNA, 1040 bp, Glycine max
gccaacactgaatttcatagcttgaatccaagttgggaagaaaacaatggtttcagcttcgcttcaattctggtcttggatagcacctactcctatatcccaccgttacacccataaatttgcttccctaacctcactcaaattagccactcctgtttcttctactaataccgtttatcttcccaagcctctagttgtgcgttttgctctaactgagtccgactcgcccaaatccatagaacctgaccctcaaactcttctccaagaaattgctgacagttttgatcttccttccgattacttttcaaagcttcccggcgatcttcgattagacctaaacgacgcggcgttcgacctttcaaacggacctgttttagatgagtgtggccaagagttgggagagactttgctgaatctctctcgagcatgggaacttgctgacacatcaacctcccactctttagtgaaaaagctccctttgattgaggccaagctgacgggttatgccaaatcagcacttggaaagcgtttggtatctgctggaagaaggtttcaatcaatgggacagtatggccaaggtgagctgcaaaagattgcaaaagcaatgattgcagctggtagagttctgactgctagttcaacgtcagcagtgatagttgaagaacccaaagaggaagctagggtgctgaaatttggagaattgcaggttgaagtaaccccagataaggccaatattggggctgtaattgggtttctttttgggattctttgttggcaaatagcgcggggagttcaaaacgttcctgacagttcattgcagtatgcaaatgacaatgctttgctgcttgctaagtctttaaagggagcattgcttgctatattctactcctcaacgttcttgtctgcatttacctcggtgggacttgttctacttgggttacagctcaaatcaaagaaaaataaagattgagttctaggtgtgcccttccctcagttttgcttgtaaatggagtagatgcacggtctacgtttgtgagtaa

SEQ ID NO: 439 - DNA, 487 bp, Helianthus annuus
tgtaccaacaaccgctatcaccgtcgcaaaatggccagcaccgtcaccattttcatcatcctcttcttaaccattgccaccgtcttcacatccaataccgaagcatcatccgtcgatttcgtcaagaaaacagtctcttctcaccccattgtcatcttctccaaatcctactgtccgtattgtaaaagggcaaaaggtgtattcaaggagttgaatgtgaaaccttatgtactcgagctcgatgagagagaggacgggtcgaaaattcaggatgcattgagtgagatggttgggaggcgtactgttccacaagtgtttatcaatgggaaacacctcggaggttcggatgatactgttgaagcttatcagagtggagaattggcaaagcttcttggcattgagagtcataaaacggacctttgagcttcaagccttagacagcctaataatgccgtaatttgtacgaatgttggtagtttaagttgac

SEQ ID NO: 440 - DNA, 1741 bp, Helianthus annuus
tcagttaatcaccgagttgttgaacagatcgtacatttgtgtatcaaactataaacacattctccagatttgttccgtgaaaaaccctagatcattcaacagatttgatccaacggttgcagatttcattcacgcaagctgaggcaattcatttcccagtttattaacacaaggtggactcgttagtgggttttggagaaagtgttggtgtcatgcagttggctctttagagtctaaacacccccttgcttacgtaatctagaaatacccttgtcacatagtggtatttgatctatgggcgagtgggtgattggagctatcatcaatctttttggcagcattgccattaactttggaactaatcttcttaaattgggtcatgatgagagagacagacacgcgatgctaggtgaaggtatagacggaaagacaatattgaggcctattataagtttccagtcttggagaataggtattctatttttcgcttttggaaacgctcttaactttatttcatttggatacgctgcccagtcacttcttgcagcattgggatctgtacaatttgtgtcaaacatcgcatttgcctactttgtcttgagcaaaacagtaactgtcaaagtattagttgcgacaatttttatcgtcctcggaaacacgtttcttgttgcatttggcaatcaccagtcacctgtttacacacaggagcagttggcagagaagtacagtaacattaccttccttttttactgtctatttttggtggtagtggttgtcatgcatcactacgtatacaggagaggtgaattgctgcttgctatcccagagaaagaactaacgccctactggaaactactgcttccgttttcgtttgctgtcgtttccggggccgtaggatcgtgttcggttctttttgcaaagtcactttcgaatcttttaagattgtccatgtcaagttcgtatcgcctggatagctggttcacgtattcgattcttgtattgtttctatgtactgctggattttggatggcaaggttgaatgaaggattatcacagtttgatgctatacttatagtccccatgcttcagatcgcttggacctttttctcaatttgtactggatttgtgtatttccaggaatatcaggtctttgatgcgttgaggactgtgatgtttattctaggaatgatttccgtattcataggaatttcattgctggcacccgatgactctaaaggagaagtcaaggatagtccgtctccttcatcaaaagtcaacacggatgtagaaaggttgattgaagactcgtcaatcaaggatatgaagtcgcttgcaagagcaatggcaacaaaagcctcagctgcagttatcagagcaaagagtgcttgcacgctgttgttgggaatgggagacgacacaatgcatgcatcatcagtttttgcaatgcctatggtttcatccaaaatgacgggattcagagcagtgaacggtgaccggtcaaagttgctgtccttgagaagcccatcgggatggaacaggatcccggtggtggaagaaactgtaaatatgatggacagtatgtcgagtgaagaggattagcacatgggattgtatgggtgttatatatgtcattctaatggaaggagtgtggttgttgtagtaatggggaaagaggaaagcgccacgtgaagcgaatgtatagttgtttgattggttggattgaatttggatgtatatcctc

SEQ ID NO: 441 - DNA, 605 bp, Helianthus annuus
tttgtcgacaatcaatgggggatttgtcgagacggtctggattacgaggaattggtacctggtttaccaagcaggttgttgagccgtttgtggaaatcatcagcaggggagcacagcctaaggagttggcactctctgcagctcttggaattactctaggagtgttcccaattgttggagtgacttttttcctgtgtgtgctggctataacaatgcttgggactgccgtcaatgctccaaccgtcatgctcgccaattttatggctactccaatagagctgagtttgataatagtgttcctacggtttggtgagtttattacgggtggagctcattttcctttaaccgctgatgctttaaagaaggtattgactggcaaagcttcaaaggagatcttgctaagcattgttcatgcgttgttggggtggttggttttggccccttttatccttggcctactgtacatagttcttgtaccatgtttcaccatgttggttcgtagattcagtccttccatttccctggagaatgaggatgaagcgtcgtatactgaggtgatgcttaaagtaagggatgcttgatgtagggaaatatgaggatccaaa

SEQ ID NO: 442 - DNA, 1412 bp, Helianthus annuus
gccacccaattctctctcaccacttttccctctctctactcctctttaaaaaccacttacattcacaccttttcatatctctctgcaaaacaaacatggaggagataactaatggcggcaacaaaaacgaaccacagcttctgaagcttaaatgttccgtacagaactacgactggggacgaatcggttacgattcgcgcgttgcaaccctgtttgagaaaaattgtggtgttcagattgatgagaagaagcattatgctgagttttggatggggactcatgtgtccggaccgtcggttgtggatgctggtgatggtgataatgtgagtttgaaggtgtggattgtgcaaaaccctaaggttttgggtgatgttgttgttgataagtggggagttgatcttccatttttgcttaaggtcctttctgtgggcaagtcattgtcaatacaagcccatccagatcaggaattagcaggattccttcataagacgcaaccaaatgtgtataaagatgcaaatcacaagcccgaaatggctctggcattaacagagtttgaggcgttatgtgggtttataagttcagaggaacttgatgttgtgcttgaaactgttcccgagattaatgaagtggttggcaatgcaagtgcaaaccaaatcttaactgtcgacaaacacattggtgaactcaaagaagaacgcgctcttcagtcaatattcactaaactcatgtcagttgaccaagaggttatttctgaagcactatccaaattagtcaaccgtctaacccatgaaaaagagaaaaggcggttaactagtaaagaagaactagtgttgaagcttgaaaaagaatacccaaatgatgtcggggtgttagccgcgcttctctttaatcatgtcaaactcgaacccggtgatggtttatacatagcagcaaatgaaccacatgcgtatttgaatggtgagtgtatcgagtgcatggcagcttccgataatgtggtccgtgccggtctcactccaaaatatattgatgttaaaaccctctgctccatgctcacatataaacaggggttacctgaaatattgaaaggtgtaccgatgaaccaatatgtgagacgatacacaccgcctttcgaggaatttgaggttgaccaatgcgtgcttgaccaaggcgcgtcagttgtatttcctgcacttccgggcccgtctgtttttgtggtgatttctggagaaggaacgatggcgacgtcatcacgtgaagatcgagtgtcggaaggcgatgcgttgtttgcacctgcagggaccgaggttcatgttagtactgatacagaactgcagctgtatagagctggagtgaatcacaaggtgcttttgaacccttgactgatgaggatggaagaatgggtcactagttag

SEQ ID NO: 443 - DNA, 623 bp, Helianthus annuus
gatttcgaacgagaaatgaagcagccgatgatgcccaatccaatgatgtcttcatccttccctcctacaaacatcaccaccgatcagatccaaaagttccttgacgaaaacaagcaattaatattagcaataatgaccaaccaaaacctcggaaagcttgctgaatgcgcccagtatcaggctctactccagaagaatttgatgtatctagcagccattgctgatgctcaaccaccgacaccatcaccagcaccgacaatttcatctcagatgggcccacttgcacacgcgggtatcccacaacaaggagggtttttcatgcagcatcctcaggcggctgttatggctcaacaatcttctagctttccacaacaaatgccagccatgcagtttaatagcccacaagttatgcaacctcagatgggtgttaggcccggtgggccaagcgggccaagcagtgtgccgccaagctcagccgctagtgatatctggagaggaggtatgcaagatggtggtggcgctgacggtagtggtgctggtaaagatggtcatggtgctgcagccggtggaccagacgaagcaaaataataaaaatgaggggggttgttagtcggatggatgtg

SEQ ID NO: 444 - DNA, 1681 bp, Helianthus annuus
tgtagatctagcagcagcaatgccgtttctggattccttaacggcgatatcgctgttactgttcgttacggttttaaccgttcatgcttccgttcataattacgccggagttaagttcgccagaaaaggaaatgcgtatgtagttcatggaggaagtgaaggaatctattactcgcatccgaatctcaacggttctgatgcatcttctaacggcgatgcgtatattaagtttgaagagatcatatttagaaggccacaagaggcttcaaatttcagcacagggatgatatacgccattctttttgaggtagatgacagagaaacaataggcggttcagcctatggaggccaaagagccatctgctgcacagcagatctagcaaaattgggtgcgtgtaaagaaggtgaagttattcaccgcctgtcaacatcaaatcccgggtggcctgaaattttcggtgtctcatttgatgtcaatgatgaaacttccactatgcaaccaagatctgtacaaatcacaagaacagggatgtataatttgtacttcatgcattgtgaaccgaggctagctgatatggttgtagaaggaaaaaccatatggaaaaatccgaacggttatctcccgggtcgaatggcaccacttttgaacttctacgggttcatgtcacttgcgtttttagttctcggaatcttttggttctctcaatatgcgagattctggaaagaggttttacatttgcaaaactgtataaccttagttataacattgggtatgttagagatggcattgtggtattttgattatgcagaatttaacgaaagtggggtgcggccgacgggtattactatatgggcggtaacttttggcactataaagcgcactatttcgcggttaattattttaactgtttcaatggggtatggtgttgtaagaccaactttgggtggtcttacttcaaaagttgtcatgcttggaggaacattttttcttgcttctgaagtgcttgagttggtagaacatgtcggtgctgttagtgatttctcgggaaaggcgattctgtttttatctctacctgtggcagtcttggatgcattttttgttttatggatatttacctcactttcttcaactttaaataagctacaggctaaaagaatgatggccaaattagatatatacaggaaattcacaaatgctttggctgtagctgttattgtatcagtcggctggatatgctatgagctttattttaagtcaaccgatatatacaatgagcaatggcaaaacgcttggattatacctgccttctggcatgttctgtccttctctcttctttgtgtcatatgtgctctgtgggccccatctcaaaattcaatgcgatatgcgtattcggatgacggaagtgaagagtttgacaaggatgatacattgactctgataaaaccatcccccgttcctatttccgcaaaggatgtaggtgatgtaagatctgaagatgatgttgatttggaagaagataaaacagagtaatttatcggtcttttgtatgcgtatccacttgaaatctgttttgttatattttatagaatttagactaagtacgttattagatgtatatttacaaggaggatttaaacaatttgaaatcagaagttgaggtctcttgtgtaaccagccttt

SEQ ID NO: 445 - DNA, 1183 bp, Helianthus annuus
tcacccatacaatgcatcctctttataataaagttaaaaacacactacacaaaaccctcccttcaaaaccttttctgggaataatgtgtctcctcctcctccccttcatcatcttcctccacctccttccggccaccatcccttccgcagcaccaccgctccacccgggttactacgccaattcttgcccaaatgccgaactcatcgtccgaaacgtcatgaaaaaggccatgatccgagaaccccgaagcggagcttccgtcatgcgatttcaattccatgattgtttcgttaacggatgtgatggatcgatgttgttggatgatactccaacgatgctcggagagaagctatctttgtcgaacatagattcgttgcgatcgtacgaggttgtcgatgaaatcaaggaagcacttgagacggcctgcccccggactgtttcttgtgcggatatcattatcatggcctctagggatgccgtcgctctgagtggaggtccggattgggaagtgaagctgggaagaaaagatagcctaaccgcaagtcaagaggatgccgatgccataatgcctagtccgcgagcgaacgcaaccaccctcatcgatctctttgccaaatttgacctctcggtcaaagatttagtagccctttcgggctcacactcgattggtaacgggcgttgtttctccattgtgtttaggctctacaatcaatcaggcacaggccgcccagacccctccatcgagccaaagtttagacaaaagttagacaaactttgcccacttggtggtgatgggaatgtcacaggcgatttggactttacgcctcgcatcttcgacaatcaatatttcaaagatttggtaaatggaagagggtttttgaattctgatgaaacattgtacacttattggaaaacaagagagtatgttaaaaggtatagtgaggatcaagatgagttctttagggactttgttgaggggatgattaagatgggcgacttacaatcggggcggcccggggagattcggaagaattgtagggtggtcaacggtggtccaccgatggacttggtggtggatggatataaagataggaggatattgagttattagagttgagttgaacacattatgtatttatcatgaatatggataatgtagcatatggtgtcaactcaactcta

SEQ ID NO: 446 - DNA, 1289 bp, Helianthus annuus
attcactcatttcatgaccatcaatttgtaaacaaaagcatcaaattatcacgttttcatcatatctggggttcacaattctcgctataccatgggttctgctactgattttcggtgtttagagcaactttgggctggaattatgtgaaatgaggcaaatgcgtgtgtttgtgaaggggttataaagttaggatatgggtgttccttggaaaagttgctctttaattgtccgttagtttacaaagaaagaaagagaatcagattccagaagttacaacggtctgcgattctgaagcttttttgctaaaagtcttattttggatcccatattgaggatctgattttatcacatttatgcatcatcgatggggcttccatttcgaagtctcacgatgctgcttcttcttctactgatttggtggtcaacaagtgaagctcaaacacttagggctcttgatgctattctccaggactatgcttatcgtgcatttcatcgacccagaactggccgcccctatgatggggtcccccctgcaaatttgtccggaattcagatatccgcattgaggcttcgaagtggtagcttgtttactcgaggtgttcgacagtataagcagttctcaatcccagttggggtcattggaactccttatgtggagaggctggttctggtgtatcaaaaccttggcaattggtccacaacgtattaccctttgcctcctggatacatgtatctagcgcctgtattgggtcttctagcttatgatgcgtcaaacttatcggctacaaacctggaagaactcgatatttatgcctctgaagatcccatctcgatagagtttactcaagtgcaaccggtgcgtgatgcacggtgcgtgtggttcgatctagatgggcgtataaacttcacaaaggtggtgtctggcaacaagtgtctgacttacgaacaagggcatttctctattgtagtcgaatccacagccccatcgcctgcaccagtgccgcaaccacatcaaggcggtggggggaagggttggattattggtgggtctgtactcggtggggttgcattgttggtgttgttggcattgctgatcctgtgggtgtggagatttaataagaggaagaaagtgcataaaatggagaaggctgcagatgctggtgaagcactgcatatgaccgcagttgggaacacgaaagcaccagcggctacaaccactagaacacagccaagtctggaaactgaatatgttccatgaacttcatattctaaggttggttggttgtag

SEQ ID NO: 447 - DNA, 866 bp, Solanum lycopersicum
tcaccatgagaaccagtaatcacttaataggtttactaaacttcttcactttcttagcatcaatcccaattttaagcggtggaatctggttaagcagcagagcaaacaacacagattgcttaaaattccttcaatggccattaataataattggggtttcaataatggttgtttctttagctggatttgctggttcttgctacaggaacacttttttaatgtacatttatctatgggcaatgttcttcatcattgctgcattaattggatttgtgattttcgcttatgctgttactgataaagggtcgggtcgacccgttatgaatcgggcttattccgaatattatttacaagattattccggttggttggaacaaagagtttcgagtcaaaactactgggtaaagataagttcgtgtataagggattcgcgaagttgtggtaagatgagaaggatttacaatggagctccggagagtgttgagatgttttatctgaggaaacttagtcctatcgagtctggttgctgcaagcctcctacagaatgtggctacgtttatcagaacgagacggtttgggttcccggaggaggactagttggagctgatccagattgtgttaaatggagcaatgatcaagaacagctctgttacaattgtgactcttgcaaagctggtgtacttgctagccttaaaaagagttggagaaaagtgtctgttatcaacatagtcatattgatcctccttgttatcatgtatatggttgccatcgcggcatttaggcacaacaaacggatcgataacgatgagccttatggagaaacaaggatggagaaggctcaacctagcaggatacacttctaatga

SEQ ID NO: 448 - DNA, 1313 bp, Solanum lycopersicum
taaaaatggaggccactcgcagttgctctcaggctcacctccctttacaatccatctctttccctcctcaattctacaaaaagttccaattcacgaaatcgaagccttccaactctcatccacgcttggtgattgcaaaggtcttggggaccggcgataatggtgactttgaacattttacagctacacctaacaagatttttatggaagaggcaattggtgctgaatacggagaaggtttcgagacatttagacccaatggactgctcaaagttgatgtggattttttaaatgatagactgcaagagggtttcctgcgaagaatccgttatgcgatgaagcctgatgaagcttatggcctgattttctcttgggataatgtggtggcagattctcgagctctgatgttggatgcctggaatcaacttgcctctgaagaaggattagagcttcctgaagatgatagtgtgcagcggctgttactttatgcaactgctgaccatattctgcataaggcgctggcaggggagaagaatgaagctgatcaagatagattgaagacgagactttcccatctctatcaggacaagcttctcaaaatttcagagccaattgaagggttaaaagaatggctggatgctgtatcaactgctcgtatcccttgcgctgttgtgtcaagttttgatcgcagaaatatggttgaagccttagagcgcatgggactcatgaagtacttccaggcaattgtgacggaggaggacggaatggagtctatagcacatagatttctttctgcagctgtgaagctggacaggaagccatcaaagtgtgtggtatttgaagacgatcctaggggcataactgctgctcacaactgtacaatgatggctgtggcacttattggtgctcacccagcgtacgatttagggcaagctgacctagctgtaggtagcttcagtgagctttctgtgataaatctcaggagattatatgcacataaaggctccaactttatggacctagagaagcaaatagcggaaaaagcaccgcgcagaaggaagctcacaattgacaccattttctgaaccagtttggtacaacagtctaccacctccttttcctacttgtaaatgcccttttagtgttagaatctgtaggtcttgccgtcctttgccttctttcattcttgagataaatagagctggcagaagatgatttcccttggggtaatctgaaactcaggtgtccttttcttgtcttcttttctctctctcttttggggtttctgcttgttcgtgttatcaagccgttat

SEQ ID NO: 449 - DNA, 989 bp, Solanum lycopersicum
aatttctagactctgctgtttgtgagaatatgcagagaggaagaggggacaatttcaacagtccatttggagggataatgtcaagtatatttggatttggaggaagagacccattcgatgatccattcttctctcgcccttttccaaacttgtctcggacctccatcttacatccaacaactcctcatgatgatgaatctaataggccagtcattcaagagattgatacggaggatgatgatgaagatgcaccgctagaaccagatgaggagagcggggacgtgaatggctgtaacaaggaaagagatagggcttatgctaacagaaatccacttgttgaacatcctgaagacctaacggatgaccatagcaagagcagcaagatcataagcaaagatgtgactcgtggaatggaagacatgaaattggaaggaacacagtctaagcctcagagcatgagctatagaagagttacatatggtggaataaacgggacatattacactgccacgaccacacggagagctggaaatgatggaagggtgttagaggagagcaagcaagcagatagcacaacgggtcaagcaacacatagaatttccagaggaattcaggataaggggcactcgttgacaaggaaacttgcctcagatggtaaggtggatacaatgcagactttgcataatctagaagaagatgaattagctggctttgaacagacatggaatggcaatgctaataacgaaatccctggatggaatagtggatttgatttccacgcaaatgcaggaacaagcagtaattggctgacgaactgggaagctggattccgagatccatttagtggtgcgagaccaagtgacaacagtgctcagagtgctcagcgaaggacgcaaagtggaagaccaaagaaggttgttcggattaatatagagtgaatgtacgcgttcaccggattgatatcgagctatggaatggtgaatttctag

SEQ ID NO: 450 - DNA, 1830 bp, Solanum lycopersicum
acacccatttgataaagtttggttcttttaggaaataattcaactatacggttaaaagtttgctgaatccatggccggcatcgctaccgccggcgacaccagcaccagtaccagcagcaacctagcgccgacgaggagtttgagcaagaaggaaaatcaggggcttctgttgggcaggtatgagattgggaaattactaggacatggtacttttgctaaggtgtaccatgctagaaatgtgaagacgaatgagagcgtagcgattaaggtgattgataaagagaagatcttgaaagtgggtcttattgatcacataaaacgtgagatctcaattctcaagagagttaggcatccaaatatagttgaattatacgaagttatggctaccaaagccaaaatcttctttgtcatggagtatgtcaaaggcggtgagctcttcaataaggttgccaaaggcaggcttaaggaagaagttgctcggaaatatttccagcagttaatttctgctgtcgctttttgtcatgcccggggtgtttaccatagggacctaaagccagaaaatatactgttagatgaagatgggaatgtcaaagtttctgattttggtcttagtgccatttcagagcagataaagcaagatgggctcttccatactttctgtggtaccccggcttatgtggcgccggaggtgttaggaagaaagggttatgatgcagccaaagttgacatttggtcatgtggggtgatactctttgtgctaatggcagggtatttgccatttcatgatcagaatattatggctatgtacaagaagatttataggggtgaatttagatgtcccaggtggttttcacctgaattaactcggtttctaaagcgccttcttgatattaatcccgaaaccaggattactgttcaggagattatgaataataggtggttcaagaagggttttaaacatgttaaattttatattgaggatgataagttgtgtagtataaatgatgatgagtatggtgggattgattattcgtctgatagatcagagtctgagtctgaaatagagatcagaaggaggtcagctagtttacctaggccagctagcttgaatgcatttgatattatttcattttcccgtggctttgatttgtccggtttgtttgaggagggaggagatggggcaaggtttgtatctggggctcctgtgcccaagatcataaataagttggaggaaattgctaaagttgtgagctttgcagtaaggaagaaggattgtaaagtgagtatggaggggtctaaggaaggtgcaaaggggccgttgacagttgcagctgagatatttgagttgacaccatcgttgagagttgttgaagtgaagaagaaaggaggagatagcttggagtatgaggagttttacaacagggaattgaagccaggattacagaatttagcacatgaagttggataccctgttaattcatcgtatttgccatcagatactgaataaagagagagaaggggaaagggtaactgcggacatcttagggaccagttggaggcttcttgcactcaaacggagatctcctgaataccaaaaagaaggaacacatgccaagctagactgatggagcttcatgctagtgaaccttgacatgagttgatgttcgtaatcaagatttcaccacttcaattctagccagcgaggaacatggttcgtagtctaattgtatattagtagccccgtcaacaaggcccctccagtgcgggttagttgatgtagtagtacttactcagaaatttgaaaatggcacaaggaattgtcatagtcca

SEQ ID NO: 451 - DNA, 1300 bp, Solanum lycopersicum
ccaactttcttgatctttgacctcaaatcttgaaatgggtatcaagtttatcatgttttcattcattctaacctcacttttcctcattcttatctacatacccactcaattttcccactcacccatcaccatttttaagccaaaaagaagcttcataatctcaaataccacaactaacccttaccctgtaaaatttgcttacttgatctctgcttctaaaggagatgtagcaaagctaaaaagacttcttttttcactttaccatcctggtaatttttacttgattcacttagatttagatgcaccagaaaatgaacaccaagaaatttcaagatttgtaagtgaaaactctgtttttggagaaattaataatgtttgggttgttggaaagccaaatttagtgacatatagaggaccaactatgttagctacaacactacatgcaatggctatgcttttgaagattgctaaatgggattggtttattaatctaagtgcttctgattatcctttagttactcaagatgatctgatccatgccttctctgacttaccaagagatctaaattttgtacaacacactagccacatggggtggaagctgaataagagaggaaagccagttattatagatcctggtcttcattctctaaacaaatcagagatttggtgggttatcaagcaaagaagtcttccaactgctttcaagctttatacaggttcagcttggacaatattgtcgagatcatttgctgaatactgcataataggctgggaaaatcttcctcgaactctacttctctactacacgaattttgtgtcgtctccagagggttatttccaaacagtcatatgcaactctgaggaatacaggaacaccacagtgaaccatgatcttcactacattacatgggacatccctccgaaacaacatccaaggtccctcggtccgaaggattacaggagaatggttttaagcaacaggccatttgctcggaagttcaagaacaacaaccttgtacttaataaaattgatcgcgatcttctcagaagacgaaatggacagtacttctcagctggaggatggtgctccaatgacgatgatcgaggttgtttgaatctacaggttgagaagtatggcgttttaaagcctggaatgggtgccagaaggttgagaactttattgaagaaattggtatctgcaccacattttgctaagaggcagtgtagataagttggaaatgaaagtacttttgttggaaatagatgaaattaattgtggaagaggatgtaatcatcc

SEQ ID NO: 452 - DNA, 639 bp, Solanum lycopersicum
aagaaaatgtttaaattgctgtttctgttggctatcttactgttgagcagcgatgccgctgttcaagatttctgcgtggcagacttaaaagcaccggaatcaccttctggctattcttgcaaaagtgttacaaatgtaacagttgacgatttcgtgttttctgggcttagtgctgctggaaacacagcaagcattataaaggccgcagttaccccagcatttgcggcccagtttccaggtcttaacgggcttgggctttctgcagcccgtttagatttggccccaagtggtgtcatcccatttcacactcaccctggtgcttctgaaattttacttgtagtgcaaggatcaattactgctggatttgtttcatcagcaaattctgtttatttaaaaacacttaaaaagggtgatctaatggtttttccacaaggattattacattttcaagtcagtgatgctggatatacttctgtcggttatgtattctttagcagctctaatcctggacttcagattactgattttgcattatttgctaatgatttgccaactaagttggttgcggcaacaacattccttgatgaagcaacaattaagaaacttaagggtgtgcttggaggtactaattaagcatga

SEQ ID NO: 453 - DNA, 873 bp, Solanum lycopersicum
aaaggatcccttccgtgaaaatgaggtgtttcactcttctcttgtttttttcatctatagtagccgtggcattggcctctaatgttgaagaggccgtgataagccaagtagtagaaattcaccgtctaaggccacaaactggttctgctggttatacagtcccacaattagactgtcttagctggcgcctcgccatcgagactaacaacctacaaaactggagatcagtgcctaaagaatgtacaaactatctaggtcactacatgatgggcaaacaatatcgccacgactgtgaatatgtagccaagcaggctattgagtacgccaaaagcctcaaacttagtggagatggaaaggacgtttgggtatttgatattgatgaaactactctctcaaattctccttattacgctagatctgacgttgcttttggggctaaaccgtacaacgctacaaagtttgatgcatggatagctgagggaaaagcgccagccattccatcgatacttaaggtatacaatactgtgttgtctttgggaatcaagccaattttcattacagggacgaaacagaatttcaaacaagtaaggatcgttaatctcaaggaagctggttatgccaactgggcagcgctcatactaaagggagcaaatgatacgggatcagcagtgaaatttaaatcgagcaagagaacagcgttggtgaaggctggatatagaattattggtaatattggagatcaatggagtgatttgatcggagaaaatgttggagctcgtacttttaaagtccctgatcctatgtactacataggttgactctaacaaaattatctatataccgacttgcttcgatattttaattggtaccttt

SEQ ID NO: 454 - DNA, 848 bp, Solanum lycopersicum
gtacaagttctggtggctggagttgcgtaatcggctgtggcttccatcatctagcaatggatttttcatttttcggtaatttcccgtggttcaaaccccattctgcaaatgatatggcatcaacagttgcatctactagcaccctaatgcaaacacctaaacaaaatgctcagttttggaaatggactgtgttttcatttcttccttgggctaaagtagccgagggtaatattcaaatgccaacaactgtcaacaagaaactgaaacgacgtccgtctcgtgaaggtgtagactctctagctcgaaagtcagccatacgcttcagaccatatgtttctaaagttccatggcatacaggtccacgagcttttctttctcaacttttccctcgatatggtcattactgtggaccaaactggtcaagtggaaaagatggagggtcaccaatttgggacagaagaccgattgattggttggatttttgctgctattgtcacgacatgggctacgattctcatgatcaggctgaacttctcaaagcagaccttgcattcctcgagtgcttggagaagccaaacatgagtacgcgaggagatcctcatgtagctctactttacaagactatgtgcacatcaggccttaggaacatattgataccttacagacaacaactcattaccttacaatctaagcaactgtgttttggatttggatggctcggcggtatcatggaacctgcaaaatgcttgaaagatcgtttcgtatggttacagaagtaggtatgtgaacaattcccgcgctttcgttatggtgcagaacaagacatttctggcaagtctatttcctag

SEQ ID NO: 455 - DNA, 639 bp, Solanum lycopersicum
caaatcatgagcttcacattcatcaaaccctctattcctagtcctacatcggaattgctgcaccctttcagtaaatcacggctaaggcattgtccaacctcaccttttggaaataatgcaggcaggaggcaccagattgaaagaaatagggtgaaggcactcccagattggccattaatggcagtattagttgagcatatggaaggtcaaagagacctcataactcataaatctgtttggcatcttagtgatgaagccatgaagaatgtctatacattttacatcatgttcactgtttggggatgctgtttcttcggttctaccaaagatccttactatgattcagaacaatacagaggagatggaggtgatggtactggacattgggtctatgagaagcaagaagacatcgaagaagaagcgagagcagagctgtggcgtgatgaactgatagaggagattgaacaaaaggttgggagtcttcgagagcttgaagaagctgggaagaaggaacagttggtcaaatgatcatctttatatgtgctaagaacaaattttatgatgcttcccagttatgtatatacaatatatgatttccagttctatacaacatggctgttttgccttaattcagtgtag

SEQ ID NO: 456 - DNA, 671 bp, Solanum lycopersicum
taatcttccaaaagggtagtcgctgagagcttggaggtccaatggcgattggtatgaagcagatgtctatgataatagcaacccttggtgttttatcctttatatttggagttatagctgaaaacaagaagcctgcagctgggactgcaatatcaggaaaaggcgttgttatttgtaaatacaagtctgatcctactgttgccttgggctatttgtcttttgtttttcttgctgcatcttctgtggccggttttctgtctttgttttatccgtatcaaggaaagtcagttccacaagctgctttgctgagaaacactagtttcctcgtgttcttaaatattgcattgggcacaactggtttagcagcaacattgttgttgtggcctacaatcaccgagcaacttcatatcacacgcaacattcatcacaacttgcagaccgattgcccaactgccaagaccggtcttctaggtggaggtgccttcttgtctcttgattccgcgctcttctggttggtggctttgatgttggctgataacgctcgtgaggattatttccaagaaacggatatcaagggcgagccgaaagcaagttatgcagatgatgaaattatcaagaccagtgcttaagcctttctactctctctttgttatatgtgttgttgcaaatag

SEQ ID NO: 457 - DNA, 569 bp, Solanum lycopersicum
cggatcaacagtttcaatctccatttttctcgttaatcaagagatcttcatcatggatggtgaaattaagaacatcaagaagtggaacatactgtatccagtttatataaattcaaaaaagacgatagcggaaggaagaagaatttgtgtgacgaaagcttgtgaaaaccctacttgtactgagattagtgattgctgcaacttcctcaaaattccttgtgcaattgagcttgataaggcatatccacgagatttcatgcagagaggaagagtgagagttttgctgaagcgggaagatggaactccttacaaccctgtcattccttcacggaaacagctgatgatcaatgtcgcagagttggttcgaagacatcctaataggactaagaagcaggagcctgcagcctcttctgcagctggttcttcaaagtctggcaagggaggtaaaaagaagagatagtttcagaaggcaacatttcaatttcttcaaactgtttagagatcatagatttatttatcttggaatattttagtccttttattttacttgatttgagaaatgtattgca

SEQ ID NO: 458 - DNA, 1128 bp, Solanum lycopersicum
aagaaatgggaggaggagaagaagatcaacagaaattgaagaacacagcagcagcagcgtatgactacgagaatgatccgagatgggcagattattggtccaatatactcattcctcctcacatggcttctcgttctgatgtcgtcgaccatttcaagcgcaagttttatcaacgatacatagaccctggtctagtggttgagccaatggctaccagcagttcgtcccaaccagcaaaaccatcagttgctcaaccatcatcatcatcgtccacaccttctaataaccagccaagacagcgtaactctggtcaagctagtagaacttcaggcacgccaactactccaacttcaaatccgacatcacttcgctgggaccgaaatactatacaattttcagtgaatgcttgggtttttgttgttgcagttctctcaatatttccgcttacacctgcaaatctgtcgaacagagcatatcgactgtccttcttgggaactgcatgttcttcgctatattcattatactctgtatatgggaaaccgagggcttggaatttacaagcagtgcaagtttggttccagtcagttattgtgacgaaggatttcatctccttcatttactgtctcacatttgtcacttcccatctttacctgaaattttctttgattcctgttttatgccgatcacttgaacatgttggtaaatttcttcgacgtaacttcggcagatcttctttgtacaggaagtacttagaagaggcttgcgtatgggtcgagtcaaacgttactactctcaacatactatcttcacaggctgaaattggactgggatttcttctggttgtctctctattatcgtggcagcgtaatattatacaaacattcatgtattggcagatattgaagcttatgtatcatgctcctgctactgctggttaccatcagaatgtgtgggctaagatcggagggcttgtaaatccagttgttcaacgtgccccgttcttgaatactcctatttcaactattcagagatggtggttcaggtaggagacttgctgaaagatatacaagagttttaggggcatgaaatacttttttgggattatactttgtcctgaagggtgactat

SEQ ID NO: 459 - DNA, 1197 bp, Solanum lycopersicum
aactcagtggaaatgaaagacgattattagctagttaatactaatggataaagaagctgcaaatcatcatcaaaatcatgaaatttctaacaaagatgaattctcaccgaggattaagccgctgcaaaattaccatgttcccactggaaacagtgatcgactgaagagggatgaatggagtgaaggagcagtttcgtgtcttctcgaagcttatgaagctaaatggatactccgtaacagagcgaagctcaagggacaggattgggaggatgtggccaagcacgtgtcggcgcgtgtttattcaactaaatcccccaaaactcagacgcagtgtaagaacaaaatcgaatctatgaagaagaggtaccgatcggaatccgcaaccgccgccgatgcttcttcctggccgctctatcctcgccttgaccttttgttacgtggaaataatgcatccgcggcttcctcttcgctaattccgccgccgccgcttccgcctaatactaattgtgtgattgatgccgtcgaaccaccaccacagcagccaatattactacctccacctccggctactcttcctcctcctcctccgctcccgccgtcgccggctttgccttttgggaatggtgatcagaattcgcatgggtctaatggtcttgacagaggaataaaggaagacatattaatggacgccaaattatcggacaacgcagcagcaccagatcagaaaaacgcaacagctacaaatagcagcagcacgccagcactgtacagcgacaacaagagcaagtcgaaattgagatcaaagaataagcgaaagagggccgtggaagggtgggagatcggagagagcatacgtttgctagctgaagtagtggtaaggtcagagcaagcacgaatggagacgatgagagacatcgagagaatgagagcagaagctgaggccaaaagaggagaaatggatctcaagagaacggagatcattgccaacactcagcttgagattgctaagctctttgctagtattaccaaaggatcagttgactcttcattgagaattggaagaagttcatcatgagctagaaaataataataataataataatactctagctagctgtggaaatagaaattaccttgttatcatcttttaatttgatgatgatatccttcttgacccagccactacctaattatgga

SEQ ID NO: 460 - DNA, 622 bp, Solanum lycopersicum
tccagccgaaaaaactcacagaagcaaaatgttggggagaagatttatctccttcttgcgtcgctctccatcagcttcgggaaaagtggtggccgaggaagggaaggcaaagacatgggggcgaaggatagtgtcagggaccttgatttgcttaactggaggcgttgctctaagtgctcttgatgatctctccatatatcatagctgcagcagcaaggccttggaaagagccagtaagaacaagccgattatagatgccattggcgagcccattgttagaggtccttggtacaatgcatcactagcagtagctcaccaaaggcaatctgtatcatgtacatttcctgtctctggaccccaaggcaccggaatttttcagctgaaggcagttcgtaatggagaggacaaatggtcatcatttttacgggcaagcgactgggagatactcattatggaagctctcgtccatgtcccggggaatgaagagaagcagcaaacttttcggattaaagtttcagattacctacctccaccagctagtaatgcatgcacggattgcatacctcaggaatcatcgggtaatgtggataagaaatgacctagattcgttcttccatggtaa

SEQ ID NO: 461 - DNA, 1839 bp, Solanum lycopersicum
ccatttctagtggttcaatacgcgcttacaacaaaaacaaagctgaagaaaaggctaaagggagaacaatttgaagaaacagtggaaactagaagagatggctaacaatgcggcggcttgtgcagaaagggcaactagtgatatgctgattgggccagactgggctataaacattgagctttgtgatatcatcaacatgaatcctggacaagcaaaggatgctcttaagattatcaagaaacgcttggggagtaaaaatccaaaaatacagctccttacactattcgttcttgagactctgagcaaaaattgtggagagaatgtatttcagcaaattgtggagcgtgagattttacgagacatggtcaaaattgtgaagaagaagcctgatttaaatgtgagggagaagattttgattttgatagattcatggcaagaagctttgggagggccagggggacgatttccccagtattacgctgcatataatgagctgaaggctgcaggtgtagagtttccacctcgagaggaaaacagtgtacctttatttacaccaccacaaacccatccaatagtccacacgccttccgcttatgaggaggctgcagttgaggcctctcttgagtctgatccctctggactcagtgtcgcggagattcaaagtgccgaggggctatcagatgtcctcacggagatgcttggtgccttggatccaaagaaccctcagtccgtgaaggaggaggtgatagtcgatcttgttgaacagtgtcggtcttaccaaaagcgtgtgatgattcttgtgaacaacacagtagacgaggatctgctgtgtaaaggattggcactcaatgacaatctgcagcgagttcttcgtagacatgacgatattgccaaaggaacctcaacaattactgtaccacccagagaaactcctgttgcaccccttatgaatgtgaatcatgaggatgatgagtcagaagatgatttctctcacttatcacggagaacttcaagagatccatcacagggacaggggcggaagactattgatgtgaagagtgagccaatgcgaattactccaactcttcctcctccaccttcatcaaggagaccagtttttacggatgggaaaatggttgattatctcagcggtgacaggtttgaatctgaaagatcaatgggaacagaaggatcatcacctattgctgcttcaactaattcaaacaatgcgagtttcatcccatggtcaagtcccaagccatcttcatctgcaccccctccagatgatttgctaaatccaactgctgatgagaacttcttgaaccccactgcatctatgtttactggaaaaaacaaccagaatgaatccaattcaaaagccaaatctgctgataacttgcctccagcaccttgggatgctcctcctcctaccgcaatccctccaccaccagccagatatgatcagagacagcagtactttgagaaacatgtttctggtggctcccctcccgcaagaaccggatcgagttcctatgacagcatagttggacaaacaaagaatctctctattaattcttcttcaccatccaaaccagagaaacctgaggacgcactcttcaaagatcttgttgattttgcaaaagccaagtcttcctcatcttcaaaccaatccaatagatcattttgagtgatttcaatgaatatgaataatgtgtggtggggtgtatatctactttttcttcttgtagcaataaatattagagaggactgagttttatggattactggtgctgcttcttctgctttattttctgttcggctttcagcctttaggtgagt

SEQ ID NO: 462 - DNA, 401 bp, Solanum lycopersicum
gtcacatggacatgccaaaaggagacaaacttgttctaaggggtttaaaatttcatggataccatggggtgaagcaagaggaaaggaagcttggtcagaagttcctggtagatgttgatgcttggatggatcttcgatctgctggtgaatccgactgcttgtccgatactctaagttatactgatatatacagactagttaaagaggttatggaggggccacctaaaaatctgctagaatctgtggctcaactcattgcatcgacaaccctcaccaagtatccagaggtatctgctgttcgcgttcaagttggaaagcctcatgtggccgtccaagggcctgttgactacttgggtgtcgagatcattagatacagaagtcttgatgttcaaaactagtaa

SEQ ID NO: 463 - DNA, 2219 bp, Solanum lycopersicum
aaggatcctcctggctagcctatataacaactttgttttagttctcacaaatataagtctcttgaagaacttatatgccctatataatttcaagctattttcttgagaaagtgagacaaatataagatatgaagagtcgtcttggagttccattcaaaggcatttcagaggatattcgaggacgagtatcttgctacaagcaggattggattgctggaattagatccgggatagggatattagctccaactacctacatattttttgcatctgctctaccagtgatagcttttggagaacaattgagcagagaaacagatgggagcctcagcactgtggaaactttagcttctacagcaatttgtggtatcattcactcgatactcgggggccaaccacttatgatactaggagttgcagaacctactattattatgtacagttacttgtacaagtttgctaaaggtagagaagatttaggacagaccctttacttggcttgggccggatgggtgtgtgtctggacagctctcatgttgtttcttctagcaatattcaatgcctgttctgtcataagtaaatttacaaggattgctggggaaacttttggaatgcttatcgctgtgcttttcattcaagaagcaattaagggattggtaagtgagttcagcatccctaaagctgaggacccaagttcggagaaatatcaatttcattggctttacatgaacggactacttggaatcatattcacctttggtcttctctacacagccttaaagagcaggaaagcaaggtcatggtggtacggcacaggctggatgagaagcttcatcgctgactatggagttcctttaatggttctcatgtggtcatctctgtcatttatcgtgccaagcaatgttccgtctggagttcctagaactctctatagtccccttccttgggaatctgcatctttatatcactggactgtaatgaaggacatggtgaaggttcctccagtatacatttttgctgccataataccagctgtgatgatagccggactctacttcttcgatcacagtgttgcttcgcagatggcacaacaaaaagagttcaatttaaagaatccttctgcttatcattatgatatcttactcttgggatttatgactttgctatgtggtttacttggattgcctccttcaaatggtgttctgccacagtccccaatgcatactaaaagtttggctattcttaagaaacagctgattcggaagaagatggttgaaagtgcaaaagagagtatcaggcaaaaagctagcaactctgaaatctatggcaacatgcaagctgtattcattgagatagatagttctcctattagtgcagtagctaaagagttggaacacttgaaagaggcaataatgaaatgtgaaagtgataatgcaaatgacgaaaagtctagtggtatatttgatcctgagaagtacattgatgcttacttgcccgttcgagtaaatgaacaaagagtcagcaatctattgcagtcactactggtagcagcatcagcgggtgctatgccagtgataaaaaagataccaacttcagttctttggggatatttcgcctacatggctattgacagccttccaggaaatcagctgtgggaaagaatgctgcttctattcatatcccctggcaggagatttaaggtccttgaaggggttcatgcatcttttgtggaatcagtaccattcagatgcattgcaatcttcacaatattccaatttgtgtacttacttgttgtctttggagttacttggattcctatagctggcattctcttccccttgccattttttctcctcataagcataagacaacatttgcttcccaaatttttacaccctcgtcatttacaagagcttgatgcagccgaatatgaggaaatagctggtgctccacaacgcgcacttagcttctctttcagggaaacggagataactcttcctagaactgaaggcgagatagaaatttgtgatgctgagattttggatgaacttacaacaagcagaggagagttcaaagtccggactattagctttagtgaggataagcgcccacaggttatttatccaactgcagacacagaatctgagtgaacaatatttacatggctctagagtgtattgaatcttagagttggtatttgtatgtatccaggtaccttt

SEQ ID NO: 464 - DNA, 824 bp, Triticum aestivum
ctgcaacactcgctacaaaatgaagcttcaggtagccacagtcgcctccttcctcctggtggccttggccgcgacggcccaggccgtgacgttcgacgcgtcgaacaaggcgtcgggcacctccggcggccggcggtttgagcaggccgtcggcctcccatactccaagaaggtcctctccgacgcctccgccttcatctggaaaaccttcaaccagcgcggcgtcggcgaccgcaagcctgtggatgccgtcaccctcgtcgtcgaggacatcagcggcgtcgccttcaccagcgccaacggcatccacctcagcgcccagtacgtcggcggcatctccggcgacgtcaagaaggaggtgaccggcgtgctgtaccacgaggcgacgcacgtgtggcagtggaacgggcagggcagggcgaacggcgggctcatcgagggcatcgccgactacgtgcggctcaaggccgggttcgcgccggggcactgggtgaagccggggcagggcgaccggtgggatcaggggtacgacgtcacggcgaggttcctcgactactgcgactcgctcaagcccgggttcgtcgcgcagctcaacgccaagatgaagagtgggtacaccgacgacttcttcgcgcagattctcgggaagaacgtgcagcagctgtggaaggactacaaagccaagtttagaggctgaacgcacgataagttgatgggtcattcacggtgtgatggcataacgcactacttcgaataagacatgtgtgatggcataacacactatatatactgaaatgatcaacagaacatgtcccttacgctct

SEQ ID NO: 465 - DNA, 1322 bp, Triticum aestivum
acccaggtacacctacgcggcccggcgagatgaagctcccgctgtcggcggggtcgcccgacgcggcgcccgagctggccaagccgtcgctgccggcgacgtggctcatcctgcacgcgctcttctgcgccacctccatggccgtcggcttccgcttctcccgcctcgtcgtcttcctcctcttcctgcccacgccgcccatgaacccgtcggcgcacctcgtctccctcgtcaccccgcccgtcatgctcgccagctccaacaccaccgccaccatcaccactacgacgaccaccaccaccaccgtcacgacgaccaccacgctggctgagagcgaggccggcgccaacgcgcaccaccaggtccaccacggtccggtcttcgtcggccgccacgccatccgcgtccgcaagtggccgcacccgaaccccggcgagctcctcaaggcccacagcatcctcgccgccgtccaggaagcacagcgccgcagccgcaaccgcatggccgacccgctcaggcccgtgattgccgtcaccccgaccaccacctccgcgctccaggcgccgtcgctcacgtccctggcgcacaccctccgcctcgtcgacgccccgctgcgctggatcgtcgtcgagcctggccaccgcaccgacgccgtcgccgccgtgctcgcccgctccggcctcgacttcctccacctcgtcgcctccgacggcccctccaccgcgcgcctgcgaatgcacgccctcagggaggtacggaaggagaagatggacggcgtggtggtgttcgccgacgagaacggcatcctccggacggagctgttcgacgaggcgcagaaggtcaagtccgtgggcgccgtgcccgtgggcattctgggcgaggacgaaggcaccaaggagtccttcctgcaggcgccggcctgcgacgaggccgggaagctggtgggctaccacgtctcggaggagacgctgctgccggcggcgcggagcgacatgctgctgtccacccggctggagtgggccgggttcgtggtgaacgcgcgggtgctctgggagagcgcatcagagcgtcccgagtgggtgcgcgacctggacgccgtggacggcggcgcgcacctggacagcccgctggcgctggtcaccgacgccggccaggtggagccgctcgccagatgcgcccgggcggcgctggcgtggtcgctccggtcagacgctctgcatgaagtcaagttcccgcatgagtggaaatttgatgctcctctagtaagcgccgcttcgcgtcagcagagcagcgtagtaaatactgaagatggtcactagtag

SEQ ID NO: 466 - DNA, 2169 bp, Triticum aestivum
gcggagagagggccaagaatggcggcgctggccgccgccgccgcttttgccggcctcctcctcgcccttgcgcccgtggtcggggccgataccgacgctgccggcgtttcggctcttgggaacctctacacctcctggaacagcccggcccagctcgtcggttggtcggcggccggcggcggcgacccctgcggcgccgcctggatgggcgtctcctgctcgggctccgccatcacctcaatcaacctttctggtatgggattgaatggcactcttggctacctactgcccagtctagtggcattgacaacgatggacttgagtaacaacagcttgcatgatgtaattccgtatcagctgccaccaaatcttatccatctgaatttggccagaaataatttttccggcaacatcccatactctatatccaacatcttatcacttggctacctcaatgtcagtcacaactctctgttccaggaaatcggcgaactatttgggggcctcaattcgctttctgtattggatttatctttcaacaacttgtcagggaacctcccagtttcttttgtctctttgtcaaatctttctagcctctatatgcaaaataatcaactatcgggcacagtcaatgtcctcagcaacctaagccttactacactaaatatagcaaacaacaacttcagtggcttgatacctggggaactcagctcgattccagacttgagcgccggagggaactcatttatcaatatgcctgcatctccaccaccgattatcatgccaccgtccgagagtccacttgctcagccggaccgtcctcgagtaccaacaacttttccaaatggccctgaggatgagatccctatcgacgaaggtgacaagaagcaaggccggcaaacaggtctgcttgtagggttggctgttgggtcagtggctgctgcttcatgtatactttttgcgttggtgttctgccttcacagtgtccataaaagaaaggatggtggtaccagtgaactgaaagactttgtaggtgctcttgcagtaaacatagacagagattctaacaacaacatccatctagactctcctgtcgcagcttcagtgctccagcggcccattgggactcctgagagggcgtatggtgtaaatagttctccagcaaagaagataaaggttcctggtgcggcgacttcttatactgttgcgtcgctccaagttgctacaaacagcttctgtcaagataccctactcggtgaaggttcgcttggtcgtgtttacagggctgatttccccaatggaaaggtacttgcggtgaaaaagatagacagtgctgccctttccttgtatgaagaggatcattttcttgaggttgtatcgaacatttctcggcttaggcacccgaacatcgtgtcgcttacgggctattgcgctgatcatggccaaaggcttcttgtatatgagcacatcggcaacggaacactacacgaaatgttgcacttctctgatgaggcgaacaagagcctttcttggaacgcccgtgtgaggattgcgctaggcaccgctcgagctttggagtacctgcatgaggtgtgccttccccctgttgtacatagaaacctcaaatcatcaaatatcctgcttgatgaagagtgcagcccacatctgtctgactctgggcttgctgccttctcaccaaaccctgagagagaggtttcaactgaggtgcttggttcacttggatacagtgccccagaattcgccatgtcaggaacacatactgtaaagagtgacgtgtacagttttggagtagtgatgttagagcttcttacgggccgtaagccgctagacagatcctgggagaggtcagagcagtcccttgtcgggtgggcaatcccgcagcttcacgacatcgatgcgctcgccaagatggttgatccagcaatggatgggatgtaccctgcgaaatctctctctcgtttcgccgacataatcgcgttgtctgtccagccggaaccagagttccgtccgccgatctccgaggtcgtccagcaacttgtgcgtctgatgcagagggctagcatgttaaggcggcaatcgggagacgacctagggtcttcctaccgtgccccggagcgcgaaggaggcgcgtgggacgcagtctgatga

SEQ ID NO: 467 - DNA, 551 bp, Triticum aestivum
aaaggatccggagggagcaaccatggcgggggacggcgacgaggagcggccggcgatgggcggcgacaagctgatcctgcgggggctgcagttccacggcttccacggcgtgaagcaggaggagaagaagctcgggcagaagttcgtggtcgacgtggacgcctggatggacctcgccgccgccggggactccgacgacatctcccacaccgtcagctacaccgacatctacaggatagccaagggcgtggtggagggcccgtcgcgcaacctcttggagtcggtggcgcagtcgatcgccggcaccacgctgctcgagttcccccagatctccggcgtccgggtgaaggtcgggaagccccacgtcgcggtgcagggcgtcgtggactacctcggggtggagatactgaggagtagacaagcatgagcacaagaaccgaacagaattaatctcagttgagccgatcgatctctgtgtcttatattatctatctatgtgtgaacatatgttaatcgcgctcacgaaacaagaatcatgaacgggtaccttt

SEQ ID NO: 468 - DNA, 1086 bp, Triticum aestivum
ccgccacggaacttaatacacatctgccgcagaacccatgagcaggggcgccgcggcgaccggcagcctgcggacggccctctcgtactgcgtccagcaggtgcgcagctacgactaccacaactacctctgcctgctccacctgccgcctgccatgcgcaaggccgcgttcaccttccgggccttcaacgtcgagacggccaaggccatggacgtcgtgtccgacccccgcaagggcctcatgcgcctcctctggtggaaggatgtggtcgacaaggtctgcgccggcaagaaggtcgagcaccccgtcgcgctcgcgctctcctcggtgctctccgagcacaaggtcagcaagcactggctcaagcggtcgctggaggccaggatcaacgacgggaaccgggacgaggacgccatccctgagaacgtcccggagctggagaggtacgcggaggacacccagtcgaccatcctgtacatgacgctgcaggccggcgggatacagtccactgttgctgaccatgccgcctcgcacatcggcaaggcgagtgggctgctgctgctgctcaaggcgctgcctcaccacgtgagcaagcaagggaagataccgtacatcccggcgagtgtagccgaggagtgcgggctgcttgcgcgggagggtggccggacagaggtcaggatgggcgacgcgctcccggatgcagttttcaaggttgcgtctgttgccgaagctcacctgcagaaggcgcgggagctggccacgtctgtgccggcagaggcggtccccgtgctcctcccagccgtgccggcccaagtccttctggattccctgcgacgccgcgaattcaatgtcttcgactcgcgcttgtccagtggagtccatggcatatcccctctgtggtaccagctgaagctcaactggcacgcgtggcgaaacaagtactgaattcatccatgccgtgtgaaccgtgtttgttgaaagcgcggttcagcatgcgttttagcccagactaaacctggggtatccatttacgggaatgtaataagcttgatgatgaagaaaagctctgctacctgctccaactg

SEQ ID NO: 469 - DNA, 3728 bp, Triticum aestivum
aaggggacgtaggaggcgggcaagacatggcggccgcggcggcctccgttggacacagcagcaaaggcggcggtgggcggatccatcggctggaggtggagaattttaagtcgtacaagggaacgcagaccatcggtcccttcttcgacttcacggccatcatcggtcccaatggcgccggcaagtccaatctcatggacgccatcagttttgtgctcggcgtccgctcagcacacctccgtggcgcccagctcaaggacctcatctacgccctcgacgaccgcgacaaggaggccaagggtcgcagggcctccgtacgcctcgtctacaacctcccaggcaccggcggcgagcttcacttcacccgcaccattaccggcgccggtggcagcgagtaccgtatcgatggccgtctcgtcacgtgggacgactacaacgccaagctcagatccctcggcattctcgtcaaggcccgcaacttcctcgttttccagggtgacgtggaatccattgcctccaagaatcctaaggagctcactgcactcctggagcagattgccggctctgacgagctcaggagggagtacgacgaattggaggaacagaaaaccagtgccgaagagaaatctgcacttgtctatcaagagaaaaggaccatcgtcatggagaggaagcagaagaaggcgcagaaggaagaggcagagaagcatctgcgcttacagcaggacctgaaactgttaaaaacagagcatctcctatggcaactctacagcattgaaaaagacatggaaaaaatagaagccgagcttgaggatgatagacgttctcttcagcaagcgcgcgaagataatcaatcctctgacaatggacttgccgcaaaaaggaaggagcaaagtgcatttctcaagaaaattaccttatgcgagaagagtatgtcgaagaaaaaggttgatattgacaaaaagcaacccgagcttcttagattgaaagagcaaatatctcggctcaaatccaaaatcaaaagctgcaacaaagagattgacaaaaagaaggatgataacaataaacatttggaagagatgaaaaggctgcagagtgctttggctgatgtcacaagtgctattgaggagttgaacgagcaaggccaagataaaggagtgaaactgcaattagccgatgaccaagtccaggaatatcatagaatcaaggaagatgcaggaatgaggacagcaaagctgcgagatgagaaggaagtattagacaaagagctaaatgctgatattgaagccaaaaagaatttagaggagaatatgcaacagctgcgtagccgtgttgatgagatatcatcacaggagagtgaattgcagacaaagtttaataagattcttcattcaatccccaagcatgaagatgagcttacacgtttacgtgaggatcataacaagattgcaaaggaacgccaatcttcaggagctaagtatttgacattgaagcagaaggtggatgagatagatacgcagttacgtgaactcaaagctgtgaagcatgaaagtgagcgggatgctcgattttcagaaactgttaagagtcttaagaggctattccctggagtccatggtcgcatgactgaactttgtcggccctcacaaaagaaatacaaccttgctgtcactgttgccatgggaaaattcatggatgcagtagtggttgaagatgaaagcacaggaaaggaatgcattaagtatttgaaggaacaacgtcttcctccacagacatttattcccttacaatcgatccgtgtgaagccaataaccgagaggttgcgtacccttggaggatctgcacagttgatctttgatgtgatacaatttgatcgagctttggagaaagcagttctgtatgctgttgggaatacacttgtctgtgacaaacttgatgaagctaaaactcttagttggagtggtgaaaggtacaaggtcgttactgtcgatgggatacttttgactaaatctggcacaatgactggtggagtaagcggtggaatggaagctagatcaaataaatgggacgacagcagaatagaatctctgaagaagaagaaaagtaaactagaggctgaaatgtccgaacttggttcccccagggagttgcagagaaaggagcttgctgtatctgagaaaataactggactcgagaaaaagttacattactcgaatgtcgaacagaataatctcaaagagaagctacacaaattggcatctgagaaacgtaatattgagaaagaaattgatcatctggagccaggaaaggaggagttggaaagccgtcttgctaaaaacgaacgggaagtaagaaagcgggagaaaaaaataaatgagatagtcgacaggatttacaaggattttagcacgtcagttggtgtgaagaacattcgtgaatatgaagaaaagcaactgaaagatgctcaagcactgcaggagaggaagctaagtctgagcaatcaattatcgaaactgaaataccagctggaatatgaacaaaagagagatatgcatgctcctattgcaaagttaaacaacacacatgagaccctagagaaggagctgaagggcttgcaggagagagaaactcgtgctaaggctgatgctgaacatatttcaaatcagatggaagagctgaaggctgaggctgaagactggaagttgaagtcagatgaatgtgagacagcaattgaggaactaaagaaacagaatgatagtgttgctgctgcattggcaaagctggatcgccaagtgaagttaaaggagggacagatagttcaacttagatcacgccaacgtgagattcatgagaagtgcgacctggagcagttaaagcttcctacagttaatgatccaatggacactggatcatcctcacaggaacttgtccttgattacaaccagcttagtgaaatctacctgaaaggagtgcggctgtctgaccgtgacaaacttgaggcagagttcaaacaaaaaataggtgcactaatggctgagattgaacgcactgctccaaacttaaaagcactggaccaatatgaagcacttcaaacgaaggaaaaagaggtgagcgagaagtttgaagcagctaggaaagaagagagagaggtagctgacaagtataactctgtcaagcaaagaaggtatgagctgttcatggaagcctttgatcatatatctaaaggcatagacaaaatctataagcagttaacaaaaagtcacacgcatccgctcggaggaacagcatatttaaacctagaaaatgaagatgagccatttcttcatggaatcaagtacacagctatgccacctacgaagcgctttagagatatggaacagttatccggtggggagaagactgttgctgcactggcattgctttttgccattcacagtttcaggccatcaccattcttcatactggatgaagtcgatgcagctctagataatttaaatgttgccaaggttgctgggtttattcgatcaaagtcatgcgaacgtgctggcgaagagcaagatggtgatggaggttgtgggtttcagagtattgtcatatctctgaaggatagcttctacgacaaagctgaagcactggttggtgtttatcgggattcagaaagaagctgctccagaaccctcaccttcgaccttacgaagtataaagaagcatgaaatccactcctgtga

SEQ ID NO: 470 - DNA, 2177 bp, Oryza sativa
ccgcgatggggacggagcggaagcgcaaggtgagcctcttcgacgtggtcgacgagacctccgtctccgccaagctcggccgcgccgccaccaccaacggctcggccgccgccgccgcggccaacccgtccatcaatcggtggacggggaggccctactcggcgaggtacctcgagatcctcgagaagcgccgcacgctacccgtgtggcagcagaaggacgatttcctcgccgtcctccgcgacaaccagaccctcatcctcgtcggagaaaccggaagcggcaagaccactcagattccccaattcgtgctcgaggctgaaggcttgagcaaccgctcaatggttgcttgcacccagccgcggagggtggcagctatgtcagtttcccggcgtgttgcggaggagatggatgttactatcggggaggaagttggttacagcatccgttttgaggattgcagcagtcacaaaacagttctcaaatatttgacagatggtatgcttctgagagaagctatggcagacccacttttagagaggtacaaggtgattgttcttgatgaggcccatgagcggacattagcaacagatgttctgtttgggcttctgaaggaggttctaaagaacagacctgatttgaagcttgttgttatgagtgctacccttgaggctgagaaatttcagacctatttcagtggtgcaccgttgatgaaggtgcctgggagacttcatccggttgagatcttctatacacaagaaccagaaagggactacctggaagctgctatcaggacagttgttcagatacatatgtgtgaacctgctggagatatccttgttttccttactggagaggaggagattgaggatgcctgtcggaagataaataaggaaattaataacatgggggatcaggttggcccagttaaagttgtgcctttgtattctacgctgcctccagcaatgcagcagaagatttttgaacctgctccagccccatcaagagagggaggcccagctggaaggaaaattgttgtgtccacaaatattgctgagacatccctaaccatagatggtatagtgtatgtgatagacccagggttttccaaacagaaggtttacaatccaaggataagggtggagtcccttctggtgtcgccaatttcaaaggcaagtgcacatcagagagctggtcgtgctggaagaacgcaacctgggaagtgtttcaggttatatacagagaagagttttaacgatgatttacagccacagacatacccagaaattcttaggtcaaatctggcgaatacggttcttaccttgaagaagcttggaattgatgatttagtgcattttgactttatggatcctcctgcaccagaaactttgatgagggccttggaagttttgaactacttaggggcacttgatgatgatggaaacctcacgcctttaggtgaaacaatgagtgaatttcctctagatccccagatgtcaaagatgcttgtcatcagtccaaaatacaactgttcaaatgagatcctttcaatatctgccatgctgtcagtacccaattgctttctccggcctagggaggcacagaaggctgctgatgaagcgaaggctcgatttggccacattgacggggaccacctgacacttctgaatgtataccatgcatacaagcagaacaatgaagatccccagtggtgttatgagaacttcatcaatgccagagctctaaagtcagctgataatgtcagacaacagcttgttcgcatcatgaccagatttaacctcaagatgtgcagcacagacttcaatagtcgggagtactacgtcaatatcaggaaagccatgcttgcagggtacttcatgcaggttgctcacctggagcgaacaggacattacctgaccgtcaaagataaccaggttgtccatcttcacccctcgaactgtctagaccataagccggagtgggtcatctacaatgagtatgttttgaccaccagaaatttcatccgcacggtcatggatatccgtggtgattggctgattgatgtggctccacactattatgatcttagtaatttcccctcgtgcgaggcaaagcgcgtccttgagaggctgtacaacaagcgggagagggaaagagctgctaataggaactgatga

SEQ ID NO: 471 - DNA, 1328 bp, Zea mays
gtcccatggcgtccccctccttcgccgctgcggccaccagccccgcctcctccccactaaccctagacgccatccccctcgcctcccgccccgcacccggagccgccgccgcccagcgcaagcggtcggtcttcctcctcaaccaccgtccgcacccggtctcccctacgcccccgctccaaccaaccgccgccgcgtccgctcagcacgcacgccgaaaaaagacctctcacccgccccggccgcggtggcagaccgtgctcagcatcgccgccaagaacgcggctctcctcgccgcgctgctctatctcggggacctcgcctggcgctggtcccacccgcccccgccctcgccgccgcccgaccgcgccgcgctcgagggctacgccgcccgcgtcgacgaggtggaggcctccctcacccgcaccttccggatgatccaggtgcaactcgaggccgtagatcgcaagatcgacggcgaggtcggcgccgccaggggcgaccttctcgctctgctggaggataagcggctcgcgctcgagcgccaactcacccggcttgacgcgagggccggtgagctcggcgacgcgctggccgggctcaagcggatggagttcctccggaaggacgagtttgagaagttctgggacgaggtgaaggggagccttggctcgagttcggagagcgaggttgatctggaccaggttcgtgccttagccagggagatcgtcatgagggagattgagaaacatgccgcagatgggatcggcagggttgactacgccgttgcctcaggcgggggaagggttgtccggcattcggaggcctatgtgcctaaacgtggtttcatggtttggatgtctggagttgacgtggggcctaagccagagaagatgcttcaaccgagctttggggaacctggacagtgctttgctttgcagggtagcaatgggtttgttgaggtcaagctcaagtcagggataattcctgaggcagtaacgcttgagcatgtgtccaaggatgtggcgtatgacaggtctacagctccaaaaggctgtcgggtgtatggatggtacgaggagacgcccggtgagacccaatctggtcatgctgcaaagatggctttggcagagttcgcctacgacttggagaagaacaatgtgcagacatttgacgtgacagccccagatgtaggcgtgatcaatatggtccggctggatttcacttcgaatcacggaagctcgcagctgacgtgcatctaccgcctccgggtccatggccatgaaccggtctctccaggatcctccgcaggttctcaggcctgatga

SEQ ID NO: 472 - DNA, 1685 bp, Oryza sativa
cacccatggcggcggcggccgcgaggggcgccgccgcggcccgctccccgctcgtcctccaccgccacccccaccccgcgcaccaccgccgcctccgcctcctccccctggtggcgggcggcgggggaggctcgcccccgcgtgtggggaggaggatcagggccagccgggagaaggggcggcgggtcgggattagggttttcgcgaggtacagccaggcccaggacttctccactcgcctccaagatagagctggcgaattgcctaagttggttgaggaccttctacagacatcaattagcacagggccacgaggtgcttttaggtttgcccaagggatccaagctgtccttggggttggtggggagtggctaaatgacttctcaaagacagccaacacatcagcaggaataccagctcagatgcagctgggtttgctttctcctctttatcttagaaggctttttgagcgcatgggtgcaacttatatcaagctaggtcagttcgtagcttctgcaccaactttgtttcctgcagagtatgtcgaggaattccagaactgttttgaccgtgcaccacctgttccatatagtgagattgagtcaatattgcgtgaggagttgcaacagccgttggatagtgtatatgaatacattgatccagttccaatagcttctgcgtcaatagcacaggttcatggggcaaggttgaagagctctcagaaggatgtggttatcaaggtcctcaagcctggtattgaagacactttggtggctgacctgaattttatctatgttgttgcacgtattttggaatttctaaaccctgaactacagaggacatcactggtaggaattgtcaaggatataaaggaatctatgcttgaagaagttgatttcaggaaagaggctatgaatattgaggcttttcagaggtacatcgatgcaatgggatttgacaggcaggccaaagccccttttgtgtatcgccactgtagcacaaagcgtgtcctaactatggaaagattgtacggtgttccactcactgaccttgattctataaggtctcttgttcctgatcctgagctgactttagtcactgcacttaatgtctggtttggaagcttgatttcatgtgaatccttccatgcagatgtgcatgcaggaaatttatggttgctccgagatggacgtgttggatttcttgattttggaattgttggccggatatcgccaaggacctgggctgcaatggaggtctttttggcttcatttgcaactgacgattataatgctatggcatcagccctttctgaaatgggtgctacagggaatgatataaatgttaatgaatttgcaaaggacttggaaaaaatattctcatcaatacaggatttggatactgaagtcatagttgcaacagcaagaactcctgatgctacagcagtatcggctaatgttgtcgttgacgagagacagatgaatgcattgtttcttgatctggtgagggtcagcgagtcgtatggattgaaatttcctcgcgaattcgctcttctgatgaagcagcttctgtattttgatcgctacacaagattgttggctcccagcatgaacatgctgcgagatgagagggttaacattagctcccgccaacaggccagaagagtagatcgtttccagtgatga

SEQ ID NO: 473 - DNA, 659 bp, Sorghum bicolor
atctagttgctgtggctttgtgcgtgactgctgaatgggcatgcagcataaaggcagccccccaaaaaaaaagctgagacgggacgacaccgagagaatcagtgactcatattcccaaatcccaaaaggccaaaaaccatacgcccaacgcaaaagctaaagagagggaggggcgtccaggttcaatgcatgtacacacgatcctctgcagtgtgacctgtcgctacaatgcaggtcatctctttcaaaccccacacgagatgtttcttcaaagccaccaggtccaaatcccagcagctctgagctagggaaaaacgactttggtgccatggagagaggggtatttgcagtacaagtacctttggatccaagagctagcatcactcgtaaattaagcagctaatagctgaagatgcatcgaggactgttcttcttcctcaagccgtagcctgtgggaggagaagccacaggcctcgcatggagttcccccactcacttcttggtcccctgttgttcgttccctcaggtagagaggatcttgttttttgtgctgatttcttcctcgtgtaagctcatgcgtggggcgatggatttgtctctgatcgtcctcatgcctcttgtatcgtgatttggatcaattaatgcaaataaatcatcga

SEQ ID NO: 474 - DNA, 971 bp, Sorghum bicolor
agctagcagcagctcaaaccttttcttcttccccggcccgtctctctcgttcgccctccagagtccaggcattctggcctctcgagtagctagctcgagcggtgcatgctttcgcatttgtagctagccagcctagctactaccttgcggcggcgacatgggcaagaggttgatgagggcgtgcgcggcgagaggcccacgaggaggaggcgcctcccgcgcatgcctggtgctctcgtccagccgtcgccggctccgggagctcgttccggccgccgggcagtgatctctccgatccttgcctgcttcctgctcgtcggtgcagctagctgcctacggggatgcatggtcgggcgcgcgggacagatcgatcgatcgaccaagtgatggaggggatcgagtcgtcgtcgtcttcgcgcgcggcggtagtgatccaatccaagggctgcagaaaggagctaactggtggtgttcgtgtaggtctaattaactcgatcggcggcatacatgggaaagccaggcattttctcgcaagttcaagtaccttccgttagctttcctctccatgcattgcacggtgatggtcttgttttaatccaattaatcatctgttcgtttcctctcttagtctcttaattttgggattctttaggcatataatagtagtagtactactaagaagttgaaggagctaggttactgagaccaaaatagtggggtgtatgtatacatctgcattttcctcgaggtgcgattatacaacttgctgctaaaggtttcttcgtattctgtctccttttgtaagattctaagtaatgcatgcatatgttctagagaatccatcaccgatcgatcaaatgaacatttgttgacgtgtcatgttttatgctacgtaatcctacctgctaaaagtttgggaatgttgtatatatgtggctgtacatttgtacttccagtgtcttgttaccgat

SEQ ID NO: 475 - protein, 681 aa, Arabidopsis thaliana
MWLFCMFCHKHVHFIHPLLLLLLLSSVFCPLSLFSGCGRLYLVKHNLKTSAAIFNSGRHIGGFDCGRIKKCFLFFRRRFFFYIHRFGALATSNRLRLISKMKILPCFGFIRRKKNKGNSKPQKTQRILQIRLEEPVKPLENDEPNNKDSPIKHESYDGEDERDDKDSTNREFSKFHVHERAVESVKSKEEVTDTSENGDDNDEDEGGHVSDPGLGKTTAWVTSPKLKRSCSTLSKFNGRFHGSDLHDLKETVPVSNESVRSHRSADRVMLKKHSSMQILPSGSRRLWWKLFLWSHRNLHKHRVSLKSQPLNKNQQSGYTSDFAEHNQSSHEEESTNYCADFTNQSSNLWPHHNQWVAFSAESSSMKRVDEWVRGLDVETVVPVNEDKDVLAIFPTSPNTERSPLGNVVQSGNVSEAIVHANSLIQSLSKSSSVAHISSIGLKAIPSISHFTSLKSIDLSNNFIVQITPASLPKGLHALNLSKNKISVIEGLRDLTRLRVLDLSYNRISRIGQGLSNCTLIKELYLAGNKISNVEGLHRLLKLIVLDLSFNKIATTKAIGQLVANYNSLVALNILGNPIQNNVGEDQLRKTVSSLLPKLVYHNKQLIKPQRAREVLKDSVARAAFGGGDSLHHRRKRTSTKSVVGSASPSVHHRGHIAKGRGSKNRSQRQLRKTSAAGTPSH

SEQ ID NO: 476 - protein, 213 aa, Arabidopsis thaliana
MGWYTSFLVVVASLAVGVIFSPETFGSLTNGENSAKISIFLKLAHLLSFATAWGAALWATFIGGIIMFKNLPRHQFGNLQSKLFPAYFTLVGSCCAISLSAFGYLHPWKSSSTVEKYQIGFLLSAFAFNLTNLFVFTPMTIDMMKQRHKVERENNIGDEVGWSKNREKAKSIPKLAAMNKKFGMIHGLSSLANIFSFGSLAMHSWYLAGKLNL

SEQ ID NO: 477 - protein, 307 aa, Arabidopsis thaliana
MLSLRYSLPYLLLQTRESSTKLFTKKPNNVVVCAARGPRPRSPRVWKTRKRIGTISKAAKMIACIKGLSNVKEEVYGALDSFIAWELEFPLVIVKKALVILEDEKEWKKIIQVTKWMLSKGQGRTMGTYFSLLNALAEDNRLDEAEELWNKLFMEHLEGTPRKFFNKMISIYYKRDMHQKLFEVFADMEELGVKPNVAIVSMVGKVFVKLEMKDKYEKLMKKYPPPQWEFRYIKGRRVKVKAKQLNELSEGEGGLSSDEDKIDNEIESEEEDGEDLSEEEEDEKELLGGSQGQITSREPSLDHLDSS

SEQ ID NO: 478 - protein, 316 aa, Arabidopsis thaliana
MAVSCNHSAILFSPSSTAGSSSVTSSSSLIGFPRFQTLRFKSRSVYSKSRASSPVSALPSRSLEALIFDCDGVILESENLHRQAYNDAFSHFDVRCPPSSSASLDWSLEFYDKFQNLVGGGKPKMRWYFKENGWPTSTIFDSPPQNDDDRAKLIDTLQDWKTERYKEIIKSGSVEPRPGVIRLMDEAKAAGKKLAVCSAATKSSVILCLENLIDIERFQGLDCFLAGDDVKEKKPDPSIYITAAEKLGVSVKDCLVVEDSVIGLQAATKAGMSCVITYTSSTSDQNFNDAIAVYPDLSNVKLKDLETLLQTIVTAA

SEQ ID NO: 479 - protein, 421 aa, Hordeum vulgare
MAAGDEFRPLDEASLVAYIRATPALAASLGGRVDALSVKEVGDGNLNFVYIVTSDAGSVVVKQALPYIRCVGDSWPMTRERAYFEASALREHGRLCPDHVPEVYHFDRAMSLIGMRYIKPPHIILRKGLIAGVHYPLLAHHMADYMANTLFFTSLLYNSTTHHKKQVARYCENVEMCRLTEQVVFSDPYMVSKYNRWNSPFLDKDAEAVREDDGLKLEIAELKSMFIERAQALIHGDLHTGSIMVTPDSTQVIDPEFAFYAPMGYDIGAFLGNLILAYFAQDGHADQANDRKAYKQWILKTIEESWNLFQQKFLGLWNKHKDGNGEAYLPAIYNNPELLGVVQKKYMTDLLHDSLGFGSAKMIRRIVGIAHVEDFDSIEDASKRASCERRALDCAKAILKGRRQFESIEQVIAHVRSVTHD

SEQ ID NO: 480 - protein, 782 aa, Hordeum vulgare
MAKRPRNFRAVRSNSFESYLRRVISEAGLAVPGCCADDVAAALRSRHPDLRRKQHAPLVAAVRRALLTIPLAPAPGAGSDSDMDSRASSPSSRRRHRAHATASSSTSYSEHDDDDDDAPSPPPAFDVTKAMLRTRYASLTPRKEPAAAAAAAASQQLEIELNSEKPRRRVTTDGGGGGDPKQEAGASEGGGGGGAKGPRFSDLGGMETVIDELMMEVVVPLCHPELPLRLGVRPVAGILLHGPPGCGKTTLAHAIANETGVPFYKISAPEVVSGVSGASEENIRVLFKKAYRTAPSIVFIDEIDAIASKRENLQREMERRIVTQLMTCMDEFHQNVGSDGGDLDSQSSEKKPGYVIVIGATNRPDAVDQALRRPGRFDREISLGVPDEIGRKQILKMLTQNLTLEKDQFDLFKIARATPGFVGADLKALVDKAGNLAMKRIIVERKKQSGGGDVNSKQDWWRHPWSEDEMDSLCITMDDFEEAATMVQPSLRREGFSSVPDVTWEDVGGLDSLKKEFDRCIVRCIKHPEVYKDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRHGVYVIGATNRIDVIDEAVLRPGRFGKKHFVPLPGADERVAILKAHTEKKTLSEDVDLETIARREECNNLTGADLASLVNEAAMAALEERCEFLAKGDSSMSTDLTNKIKLQHFEHALSKVKPSVSEQQRKHFDALSKKYSAN

SEQ ID NO: 481 - protein, 254 aa, Hordeum vulgare
MRPVFVGNLDYDTRHSELDHLFYRYGRIQRIDMKSGFAFVYFEDERDGDDAIRALDGYPFGPGRRRLSVEWSRGDRGTRRDDRDGYSKPPVNTKPTKTLFVINFDPINTRVSDLERHFGPFGRISNVRIRKNFAFVQFETQEEASKALDATHLTKLLDRVISVEYAFRDDSEPGDKYDRPSRGAGGYGRQDDSSYRRSVSPVYRRSRPSPDYGRPVSPQYGAYGRSRSPVRDRYRSRSPVQRSRSPAPNRRGYD

SEQ ID NO: 482 - protein, 532 aa, Hordeum vulgare
MAADADTAAAARALLLLAVSVAALLRAGEASVHEYTGLGFLNKGNAFILHAGSEGLYAPVSPANATAEEEDDEAAAAAAPDAFIRFDKITFRRPEEANDSVKETSSSKVQILVFEIEDREMIGGSAYGGQKAICCTSDLAKLGACVEGSVIYRPSQVNPGWPQLFVASFDGSDLIATLPSRTIPVKKTGMYNMYFIHCDPALAGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYGVVRPTLGGLTSKVVMLGGTFFVATEILELVENLGTVNDLSGKARLFLVYPVAILDASFIVWIFISLAKTLSQLQARRLMAKLDIYRKFTIALAITVLVSIGWIGYEIYFKSTDVFNERWQYAWIIPAFWHALSFSLLCVISYLWAPSQSSMRFTNDASEKFDREDSLSLIRPRPIVSKNGWSVTSAPDAKATNNTNTVASFDEDDEENKRE

SEQ ID NO: 483 - protein, 419 aa, Hordeum vulgare
MWRARRWPRPRWFSSGTAAAGADPGHPARRRVAALWGNGDHGRLGLGALESRWSPTACPFFLARPADPPASLSCGGAHTLFLTEGGRVFATGLNDFGQLGIGSSMPHTLDPVEVSGFHEKVVQISAGNHHSCAVTADGELFVWGKNSSGQLGLGKSAGKVVSTPRKVDYLADVRVKMTALGSEHSIVVTEDGEALSWGAAGGGRLGHGHKSSFLGFAMTSNEYTPRLIKNLDGIKIKRIAAGMLHSACIDEKGTVFIFGQKTEKVLGRSNDAPRPSVVEEIQFSEEVACGGYHTCAVTDRGDLYSWGSNENGCLGLGGTGMVRFPEVVSSSLFKLPVSKVSCGWKHTAVISGEDIYTWGWGGANGTFFEEGHSSGGQLGHGNDVDYCEPMMVELHKNARAVHVSCGFNHTGAILEYAEN

SEQ ID NO: 484 - protein, 345 aa, Hordeum vulgare
MSDAPGAPASAMGSGRELANPPSDGISNLRFSNHSDHLLVSSWDKTVRLYDAEANVLKGEFAHPGPVLDCCFHDDSSGFSAGADHTVRRLAFTSSKEDVLGRHDAPVRCVEYSYAAGQVITGSWDKTIKCWDPRGVSGPERTLVGTYAQPERVYSMSLVGNRLVVATAGRHVSIYDLRNMSQPEQKRESSLKYQTRCVRCFPNGTGYALSSVEGRVSMEFFDLSESAQSKKYAFKCHRKSESGRDTVYPVNAIAFHPIYGTFATGGHDGFVNVWDGTNKKRLYQYSKYASSIASLSFSKDGHLLAVASSYGYEEGEKPHEPDAIFIRGVNEVEVKPKPKALAAPQ

SEQ ID NO: 485 - protein, 303 aa, Hordeum vulgare
MERATPVRSPHTSTADLLTWSATGAGAPSASPAAPSRPSLKPAGGITPAMFGAPVSEHDAEDLSNSERRLMSGSKMKEMTGSGIFAEKSENSDSESSNPANRTSVRMYQQTVTGVSQISFSADGSVSPKKPSSLPEVAKQRELSGTFETDAEAKINKQLSEAKNKELSGSNIFGPPPETPARPLAARNMELQGNVDFALPQRRSVHTSVKVSNPAGGPSNITFSEDPVTKTAKKIHNQKFQELTGNNIFNEDAPPGSADKSLSSAKLKEMSGNDIFSDGKASSRDYLGGVRKPPGGESSIALI

SEQ ID NO: 486 - protein, 935 aa, Hordeum vulgare
MLQSKSFVKKTKQGRVVKVVREHYLRDDIPCGAFSCPSCDAAARRLNADAAAILVVDTNVVLHQIDLLENPAIEDVVVLSVVLDEVKNKNLSVYNRLKTLCTNTARRFFVFTNEHHRDTYVKEMVGESPNDRNDRAIRVAAHWYQSHLGDSAKVLLVTNDRDNKRKATEEGLNAETVESYVRSLAQPGLLDLVVVPSSGDVAMEDVEDLRPSKSKIVYNEHKPMSEITSGLRCGIYHQGKLRVNRYNPFEAYVGSESIGDEIIIRGRSNVNRSFDGDIVAVELLPQDQWHDSKSFIADDDEDDNEEDVRLVPNSADDAPRNTTSTQSTAGSSAASVPSRPVGRVVGIIKRNWNSYCGSLEPMPMPAGSGGVAHALFVSKDRRIPKIRIQTRQLGNLLNKRIIVAVDSWDVMSRYPSGHYVRTIGDIGDKETETEVVLIENDINTRPFSTQVLACLPPLPWTLSPEDVANPNRQDLRHVRVFSVDPPGCRDIDDALHCTPLPNGNFEVGVHIADVTNFVHPGTPLDEEASQRATSVYLVGQRIDMLPKPLTEDVCSLRADVERLAFSVIWEMTPDADIISSRYTKSVIKSCAAMSYVEAQARMDDSRLVDPLTVDLRNLNSLAKIMRNRRCERGALTLASAEVKFEIDSETHDPLDIGIYQIREANQMIEEFMLAANVSVAEKILQHYPLCSLLRRHPSPTKEMLEPLLRTASSVGLSLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFRTRPVDTEARIVKIKANGFIVFVPKFGIEGPIYLTAKGDKGADWVVDEVHQKVTKPGTNISYAVLQSVMIHMEVVEPQPHRPKLQLTLI

SEQ ID NO: 487 - protein, 190 aa, Hordeum vulgare
MQSPSHYQSSYYAVLGVHPGASAAEIRAAYHRLAMRWHPDKIANGRVDPAIAEEAKGRFQKIHEAYQVLSDEKRRALYDAGMYDPLDDDQQEVEGFHDFLQEMLSLMATVGTEEPVYSLGELQSMLDGMMQDFTSPQPPPPSSFFTSTSSSTRFGAPSGGAQQQRRSSSRVRPQGFGGSACFSQTAFSGC

SEQ ID NO: 488 - protein, 312 aa, Hordeum vulgare
MGFLICACLLQLLFLGSSPVAAQSPSPARALDAMLQEYAYRAFVRPHTGIVYNGTVPSDLAGVAVSGLRLRSGSLRRKGFSNYFNFRIPPGVIVQPYVERVVLVYHSLGDLSEKYYPLPGYTYLSPILGLLVYDAANLSAVGLSELSIVASGSPISVNFSNVRAVPPGSPAPQCVWFDLDGVPQFRALEANNVCATYRRGHFSIVVNSSEVAPAPGPSGAIAPPIPTDGGRDKGSSDAWKIAVGVVGGVIALGLLALLLVCFLRYKKEKKMEVMERNAEVGETLRMAQVGRTQAPVAFGTRTKPVIESEYVA

SEQ ID NO: 489 - protein, 343 aa, Hordeum vulgare
MVVKSAGGGGGGGGAEEGAAGAAVRRWVEAGGGRLVLDGGLATELEAHGADLNDPLWSAKCILSSPHLIRKVHLDYIEAGANIIITASYQATIQGFEAKGFSKEQGENLLTKSVEIAHEAREMFLKEHPDQSTALRPILVAASIGSYGAYLADGSEYSGDYGEAGTLEFLKDFHRRRLQVLAEARPDLIAFETIPNKLEAQAYVELLDECNINIPSWFSFNSKDGVNVVSGDSLIECANIANACAKVGAVGINCTPPRFIHSLILSIRKVTDKPILIYPNSGERYDAEKKEWVESTGVSDGDFVSYVGEWCKDGAALIGGCCRTTPNTIRAISRSLNQYYPAA

SEQ ID NO: 490 - protein, 215 aa, Hordeum vulgare
MAAAAMSYVHADVENLKATELRLGLPGVEETAKVPSPPSTPRAGSKRALAGEHREEEPKTAPPAAKAQVVGWPPVRSYRKSCFQQASSKTKPAAPAPVAVKQEEAAVTAAPPAAAAAGGSLYVKVSMDGAPYLRKIDLKMYKGYRELREALEAMFLGFSGDAGSVNPSDFAVTYEDKDGDLMLVGDVPFEMFMSTCKRLRIMKGSEARGLGSSKE

SEQ ID NO: 491 - protein, 265 aa, Hordeum vulgare
MATISSCSRLCGGGSTAFHRRRSRPARATVVTCRRFSAVVRAAASATAAAPASTVPQTKECKLPTWAEFELGKSPVYWKTTNGLPPAPGEGLKIFYNPGTTKLTPNEQFGIAFNGGFNQPIMCGGEPRQMTLQERGKACPPIYTIRIRVPQHAMTLVFSFTNGSEWDGAYTLKFKVPKPWLNKPLSFFNEGLADELNMEGACDRAIFPDENIVITSCDIGGFYEEGGDRCKLDIVTGCMDRTSHMFDPLATIDDGSCPLDSDSEE

SEQ ID NO: 492 - protein, 165 aa, Unknown
  Sequence found in Organisms: Hordeum vulgare, Festuca arundinacea, Leymus cinereus x Leymus triticoides, Lolium multiflorum, Avena sativa, Pseudoroegneria spicata, Secale cereale, Triticum aestivum
MSSVFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 493 - protein, 330 aa, Hordeum vulgare
MEAPAARGGGAVASVVVVVVVMAMAAATARAQLQVGYYDTLCPAAEIIVQQEVSKGVSGSPGTAAGLLRLHFHDCFVRGCDGSVLVDSTAGNQAEKDAPPNSSLRGFEVIDAAKTRLEQACYGVVSCADVLAFAARDALALVGGNSYQVPAGRRDGNVSVAGETNGNLPPPTANVNQLNQIFGSKGLTQAQMVALSGAHTVGMAQCSSFSSRLYSYGTSGGKDPSMDPTYLATLSTQCPQSGASQPVAMDPVTPNTFDTNYYANVAANRGLLASDQALLADNSTAAQVLGYTTNPGTFQTDFANAMVAMGAIGVLTGNTGTIRTNCRVVG

SEQ ID NO: 494 - protein, 182 aa, Hordeum vulgare
MASSKTLLLALCAAAAAATLSPASAADDLTKFKVYFHDVLAGKSPTAIRIAQAASTNSSSTFFGAVVAIDDPLTTSPAVTGSAKSKDEVGRAQGTYTFADQATFGLLMNMNFVFTAGEYKGSSLTIYGRNEVLSAVREMSILGGTGKFRMARGYVQASTVDSGANSGETVVEYTVYVKAAAA

SEQ ID NO: 495 - protein, 546 aa, Hordeum vulgare
MALTLLRGIRTQTLFGANAGLFCTTRRHPLAHFTTRVESVQTSEPKSVRKSIQQATKEAAEHKTQGFEAVIGIETHVQLSTITKAFCSCPYDYGSQPNSTVCPTCMGHPGTLPVLNAKVVECAVKLGLALNCEISMTSKFDRKQYFYPDLPKGYQISQFDIPIAEKGYLDLDIPMEFGGGHRRFGVTRVHMEEDAGKLLHSESGSFSQVDLNRAGVPLLEIVSEPDMRTGIEAAEYGAEIQRVVRYLGVGNGNMQEGSLRCDVNVSVRPIGQSEFGTKVEIKNMNSFSEISRAIDYEISRQILLHKESQADKIVQETRLWDESSQKTFTMRKKEGLADYRYFPEPDLPEVVLTSEYIDEIRNSMPELPEAKRRRYENMGLSMQDVIFLANDDIVAHFFDSTLERGADAKLAANWIMGDITAYLKNEKLSIDEIKLTPLELSELIAFIKNGTISGKIGKEILVELITKGGTVKSVIEEKDLVQIADPAAIEAMVDKVLAENPKQLEQYRAGKTKLQGFFAGQVMKASKGKASPVLLNKILGEKLKGN

SEQ ID NO: 496 - protein, 349 aa, Hordeum vulgare
MGSLPVLSLPECAAPPQEGARATVAAPDLAALFRAQRRHLDHFFDRLDMPQAAAFAQALLDAPGAVFFTGVGKSGIVARKLAQTLASLGFARAGFLSPVDALHGDIGSLFPGDVLVLLSKSGASDELLALVPCARAKGARLISLTSAASGADCPLAAACDLNVHLPLQGEVCPFGLAPVTSTAIQMVFGDTVVAAIMEARRLTRDQYAANHPAGKIGKTLIFKVKDVMKKQNDLPLCKEGDMIMDQLTELTSKGCGCLLVVDDEYHLIGTFTDGDLRRTLKASGPAIFSLTVGEMCNRNPRTITAGAMAVEAMEKMESPPSPVQFLPVVDDKNVVSGIITLHGLVSAGL

SEQ ID NO: 497 - protein, 70 aa, Hordeum vulgare
MAGGGIFSRALSYVVNEFLVEGLANNRAFQRFAVRTNKTLENLSTKAKQVREEVSEQFKDARGPDDRFKQ

SEQ ID NO: 498 - protein, 300 aa, Hordeum vulgare
MRGIASAGTLHPRPSAAVRSKSNAADRPTLHLRRSPENSLPSIRRSGRLMPPLTAAALATSSGAESFSELASADDFAAIASPDGHISVIGFGSLLSERSARSTFPELEGFRVAALRGFRRVFAHAAPIFFERGIAIEATKEFSSLSVEHCEGEMIVVTVFEIKEEEVPAFIERELEFRFLAVVPEGLDGVPFPNQAVVCARYSDEEYFRVRCKGSKEIYNQHYGRYNIDKIWRDDILPCRLYLRHCVLAAKNLGEAAYSNFLDHTYLGDRRTTIREYLATTGAGIMEEEPPEMLKSRYGG

SEQ ID NO: 499 - protein, 93 aa, Hordeum vulgare
MGSLGPAVSVSMAKASGGTAAVGGQQQQQPERGAFSCGFRMPLHYPRYRKADYEAMPEWRVDCLLREYGLPVAGDVEDKRRFAMGAFLWPGQY

SEQ ID NO: 500 - protein, 584 aa, Hordeum vulgare
MQHRSPAAATASGAASTAAAMAPGVSGVEPAVTLDQVPRWSDPDQRLYTPSSSPAAADAADGGSEPAASAFLSFSDPLTGDDGGAAGGGRAGASRFPVDHEINSRIYLWRGHPWNMEVDAVVNSTNESLDEAHSSPGLHSAAGSGLAEECATLGGCRTGMAKMTNAYDLPARKVIHTVGPKYAVKYHTAAENALSHCYRSCLELLIEDGLESIAMGCIYTEAKNYPREPAAHVAIRTVRRFLEKQKGKIAGVIFCITSSSDTEIYKRLLPLYFPRDKQEEETAVSKLPADVGDENGETVIDERKIRIRPLPAGAADRTVPAAPLDLPVESGLASSRNAFKLDSYLDPSFMSLIKDPDVRRKEQWEKSSQAQKGFNYARLLGYGDIGFPPLSAAEEYSLHSRYLAKANSLNLSEIAEMKIIYRGGVDSEGRPVMVVVGAHFLLRCLDLERFVLHVVKEFEPLIQKPYTIVYLHSAASLQPQPDLGFMKRIQQILGRKHQRNLHGIYMLHPTLGLRTAILGMQLLIDGEVWKKVVYVDRLVQLFRYVPREQLTIPDFVFQHDLEVNGGRGMIVDPRTKHIYQRPSG

SEQ ID NO: 501 - protein, 358 aa, Hordeum vulgare
MKLCFCLAVVTLAALLSSEAVVACIDVGFYDRTCPSAETLVQQTVAAAFGNDSGVAPAIIRLHFHDCFVKGCDGSVLIDSTPGNKAEKDSGPNFPSLRFFDVVDRAKAALEAQCPGVVSCADVLAFAARDSVVLSGGLGYQVPAGRRDGRVSTEADALNNLPGPTSTASDLVAGFAAKNLTVEDIVVLSGAHTIGVSHCSSFTERIYNFPNTTDGIDPKLSKAYAFLLKGICPPNSNQTFPTTTTLMDLITPTRFDNKYYVGLTNNLGLFQSDAALLTNATMKSLVDSFVRSEAAFRTRFARSMLKMGQIEVLSGAQGEIRRNCRVINPTNATSAGAVHHHLLPGSSGSSGSNQVAAS

SEQ ID NO: 502 - protein, 1165 aa, Hordeum vulgare
MAASARVPDLGSDFAQKMLQDLRRRRERLGFGSPSAQQQQRTASTAAATATASRDACSNSQRPAPSQRPQQAAAAPRSTRPEATTTPRQPSTSNAVLASAARPRRVRPVAAADADARAIVPFQGGGGGAGGGKPEHAVVASGVDVQMAALALALSDGGKLRNIEVVARNGSVFFRQPDAARLGVGGGGGYLLPPPPSGGDTGAHAAEVAIGVQGLNDMLMAAYSSGGRRRPDDEARKKLFRGSMDMEEALSMLVMVQDASRYMEGSGSGLKGKENRKSSPAARSARIEEIVDEDSDAEHGKHASMQMVVHDKFQSHESADSRSVIQSSPGSSKINSASGGEKDGSKVRMPSVIAKLMGLENLPSSTTTTTAAERKGTERFVKPGAAAPRMEVRGNAMDRKLPIRIIASEKGQHKIVLAGEWKNGMTNFGESEMGAAALSNSSSHPATGNSKQGRLTMREVLRKMVAAERGADERQVADERIIHEDKTAAEEIKLQNSVDVGCRADSGKRMDFLKRFRKNSDNRPVKEEKQTAQVKNAEVGKKQATGMRRLLGRDGEAKSRKAREKVNKENLATAETKAAGKNVKADQMRKQAQSKHVERQITARKPQNRRETQRETPSRKTENKKSVMSEAGHMRKKPEYNLVTQQDNEEHAKEHDSFSKPADSTHGEGGLSEPLAIVVRSSSIAGAASLDQPLQKITEGSTEKATETPREPQNCRGTQSETPSRKLENKKLPLSEAGHMRKNLEYTVVAQHENEGDANVNCTISSSKPADSTNGEGGLWEPSTMVVRDSTTAEAASLDKPLQKITEGTSDPTVPAESVVQASEDLKFLDQSASAEINDERINHTPSETTQIPEIFAEEEQQQEQEMIVKEQLTEDLKFLDQSTIPETNDEQINHTPDEATEIPETFAEEEQQQQQQERDQQMIVIPETFSEMEEQQQQMIVKEQLTDGSDHTTASISSENLQQDQETHVVTCDSLTENQLLLMRLLVKDRYLLETAKSIVRVDAPVSFMDDVASAPNWSDKGNELLSDVAREVTRRKGKRSEAMEEVSVARATNPRLRYLDDLVRELDGDVESLDMSKSKSARHHGDNGAAENLRRILEGDIQNEHPDANSTWDFGWNRVWELPLEKADVVRDLEKNILGGIITDVARDLIGVSVRHGCCPCVA

SEQ ID NO: 503 - protein, 691 aa, Hordeum vulgare
MAAVADAATAMTIDFLRARLLSERSVSRAAKDRADQLANRVAELEEQLRSVTAQRREAERAAAEVLAILDSQGFSDAADSGSDDDACGPPEAPDHGTGGQARGEAEDALSGSELGGPPQPGGLSWKGRAASPGADRRHPHLKARQRYGHGHRRSYFYLLAADSSPKYQPGQSCRKIRRKEPRLHTEGGDAKDNAAEGLEEDQAKSDSTVCTDEKLDLDGEVGHGGRGSCGDGRVEDDGGRYAMEDVKDGEMERVLENHAALIGQYEAQENAQREWEKKFNGSRDSTSDDVDRDSKLNQNEKACEQRGRAAQIMDREVVGEETPSRDKDLSGTNSPSECLLNVSAFGLSTNAPNVSVIGKCKGSDNDFERVTAAVATLDELHSRKDELVHKIYTEIIEGGGSNRGRSASSPQKSHSSSPTAGHNEGQGDGNSDNGSSYHVNACSYEHYGTSPSPGSPLSDTPKSKVSEWSSSCFHNHIDNQIDMQPSSSDDVGGVLKALQRAKMSLREKLSRASPPRQDMLALPAPEDHYTDDDSQANDTEFSLCMSQRLSHEILALPVSGEYLSRISWPGDDAKIPVGPAGLFRLPTDSFPQNEVCSADGYGSRFSLASSRQTVFSGNPASNSMLTSSRPQYGSGFSPDPYYDLHSSMLLSMPTTRNASFIPEILRSSDDSRRGMSSGDAGMLSQYGNAYD

SEQ ID NO: 504 - protein, 641 aa, Hordeum vulgare
MHGLWRCGGCFEPLQYFATAVRCAAFELLRRDPDGRPSPLYIPPAAAIPPPSHRTTAPPATDEKHSPPRPLSAMACSCAHGVEFDANVIRNSALEDGLAGWAAVGACTELSVRHEEPARVPTETINDVEDGYRPSGRYILAAGRGGEEDGLCQAIPAGALKPRVTYRVAGWIGLGDGAAGEHAVRVNIRLDGGEGGECAMVVEGGAVCAEAGRWTEIKGVFRLKASPPSGAAVHVQGAPPGVDVKVMDLQVFATDRKARFKKLRKKTDKVRRRDVVLKFAGAGASSAVSGASIRVMQMDTSFAFGACINPAVIQEPAFVDYFTKHFDWAVFENELKWYHTEAVQGQLNYADPDALLDFCDRHGKPVRGHCIFWAVDRMVQKWVKDLPNDQLAAAVQGRLTSLLTRYAGRFPHYDVNNEMLHGTFFQDRLGDDINAFMFKETARIDPGAALFVNDYNVEGGSDPSATPDKYIAQVNALMEKGAPVGGIGLQGHVTNPAGEIICDALDKLATTDLPVWLTELDVCESDVCLRAEDLEVVLREAYAHPAVEGVVLWGFMQGHMWRQDACLVNADGTINDAGQRFINLRQEWTSHARGKIDSDGNFKFRGYHGSYVVQLATATGKMHKAFSVDKGDTPLVLDMDV

SEQ ID NO: 505 - protein, 382 aa, Brassica napus
MRMETQGKVITCRAAVAWGAGEALVMEDVKVDPPQRLEVRLRILFTSICHTDLSAWKGENEAQQAYPRILGHEAAGIVESVGEGVEDMKAGDHVLPIFTGECGDCRVCKRDGANLCERFRVDPMKKVMVGDGKTRFFTSKDNKPIYHFLNTSTFSEYTVIDSACVVKVDPRFPLEKMSLLSCGVSTGVGAAWNVADIQPGSTVAIFGLGAVGLAVAEGARAKGASKIIGIDVNPDKFPLGREVGINEFINPKESDKTVHERVMEITEGGVEYSFECAGRIEALREAFLSTNSGVGVTVLLGVHASPQLLPIHPMELFQGRSITASVFGGFKPKTQLPLLFTQCLEGQLNLDLFISHQLPFSDINEAMQLLHQGKALRCLLRL

SEQ ID NO: 506 - protein, 417 aa, Gossypium hirsutum
MSFSEFRPLDENSLIEYIKATPSLSSKIGHNYDGLKIKEVGDGNLNFVYIIVGPSGSFVIKQALPYIRCIGESWPMTKERAYFEAVALKQHGGLCPEHVPEVYHFDRTMSLIGMRYLEPPHIILRKGLIAGIEYPLLAEHMSEYMAKTLFCTSLLYQSTTEHKRAVAEFCGNVELCRLTEQVVFSDPYKVSEYNRWTSPYLDRDAETVREDNLLKIEVAELKSKFCERAQALIHGDLHTGSVMVTPDSTQVIDPEFAFYGPMGFDIGAFVGNLILAFFAQDGHAGQGNDRKSYKEWILKTIEDTWNLFHQKFTALWDEHKNGSGEAYLPAIYNNPELQKLIQEKYMKELFHDTLGFGAAKMIRRIVGVAHVEDFESIKEANIRADCERRALELGKTLLKRRREFVSISEVISAMKHV

SEQ ID NO: 507 - protein, 515 aa, Setaria italica
MAWARLASRSRLRPAASSAVSRAPRASPPAPPPPPQAGHAARAAPPLRRLLRLPQLHSAAAASSASHARRLGDRWQRLGVARRWLSDASAAAEAAELVEVPLAQTGEGIAECELLRWFVNEGDQVDEFQPLCEVQSDKATIEITSRFKGKVHQIHFGPGDIVKVGETLLKMIVGDSQIVSPDNIFPSADKSLEEEPAVPSSEGNIPSGTLSTPAVRHLAKQYGLNINEIVGTGKDGRVLKEDVLNYAVSKGLYKEQSSSLEENIGLIDLLEEGKSLPDVPFYEDKKILLRGYQRAMVKSMSLAAKVPHFHYLEEINCDSLVKLKKAFQNENKDNTIKHTFLPFLIKSLSMALNKYPMLNSSFIEETNEVILKGSHNIGIAMATAHGLVVPNIKKVQSLSILEITKELARLHEMASHNRLSAADIEDGTITLSNIGAIGGKFGSPLLNLPEVAIIALGRIQKLPRFDDDENVYPSSIINVTVGADHRVVDGATVARFCNEWKGLVEEPELLLLHMR

SEQ ID NO: 508 - protein, 215 aa, Setaria italica
MARRRPAVLLLVVVALAAVLSAARWADALSVTVTDTECIHEFVPYEGDTVSGNFVVVDHDIFWSSDHPGIDLTVTSPGGNTVHTLKGKSGEKFEFKAPRGGMYKFCFHNPYGAPETVSFYIHVGHIPNEHNLAKDEHLDPINVKIAELKEALESVTAEQKYLKAREARHRHTNESTRKRVMFYTMAEYLAFMAASALQVVYIRRLFSKNVAYNRV

SEQ ID NO: 509 - protein, 340 aa, Setaria italica
MAKGNGAAMAAAAVLALAALLCSPAAGELARLEHTAKNGGSLSLLVVGDWGRKGTYNQSRVAEQMGKVGEQLDIDFVISTGDNFYENGLTGTDDQAFEQSFTDIYTAKSLQKPWYLVLGNHDYRGDVLAQLSPVLQKIDSRFICMRSFIVNAEIVDFFFVDTTPFQLKYWTHPKDDHYDWREVAPREKYLANLLKDLDEAMKKSTATWKIAVGHHTMRSVSDHGDTKELLQLLLPVLQANGVDFYINGHDHCLEHISSRDSPIQYFTSGGGSKAWRGVFQPNEDNLEFFYDGQGFMSLQLDQNQAEFTFYDVDGNELYQYTRSSPMETSHLRPSGYATEE

SEQ ID NO: 510 - protein, 833 aa, Setaria italica
MAEPPEQASSDPTTPPQEDNQSTKTNSKKNRGTKKSKRAGASSLCSSTMVEDPFFVLAGGKEGGFLELEEIDEADFGIVGGYVEEVGADEGKAGKDRGKKKKKRKRKRGGDDQVLSGDGDSFLKQCDGDSVVENEQEGEKEKKNAKGKRDRKKRKVKDSEKSGESGKDIADDDNAEDVQDKNENMEQDKDDDLILGEDDVFAWHELRLHPLLVKAMRRLGFKEPTPIQKSSFPAAAHQGKDVIGAAETGSGKTLAFGLPILQRLLEEREKASRLHQEDEKMEESAGESPLRALILTPTRELAQQVCDHLKEAAKFLGIGVIPIVGGISMEKQERLLKNKPEIVVGTPGRLWELMSMNNQHLVELHSLSFFVLDEADRMIERGHFHELQSIIEMLPLTNGSDEQAARTMPNCETVPILQIKKRQTFVFSATLALSSNFRKKLKRGLSTSKASTDDVSSIEALSKKAGMKPNAEIVDLTKASILPEKLEESFIECSEEDKDAYLYYILSVHGQGRAIIFCTSIAALRHISSILRILGINALTNHAQMQQRARMKAVDRFRGSENSILVATDGFARGMDFDDVRTVIHYQLPHSTDVYIHRSGRTARKSLAGCSIALISSADKSKFYSLCKSLSKENLQQFPIDHAYMPAVMNRLSLARQIDKITRKNSQENANKSWLQRNAESMGLILETSDSEEERVKGHKQRKATSAHLQKLQQELSDLLQRPLQPNTFSRRYLAGAGISPLLQKQLEELAKRKVSNNRSKTENKGSRFVVIGQDRVEPLQALQNSGQEVCVNLDKQREKRRLAQNWKQKKHEEKKRSREQKRKEKRKAKAMD

SEQ ID NO: 511 - protein, 624 aa, Setaria italica
MEDIEDVLGPAGLSGGGAPPGLRLPLSTVAVKPKRRSSRVAQTPPQPEARIPGTQTIYVKTFGCSHNQSDSEYMSGQLSAFGYAITEEPEGADLWLINTCTVKNPSQSAMTTLISKCKNAKKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKIVVSEGVREIWLSSEDTGAYGRDIGTNLPNLLNAIVAELPADRSTMLRIGMTNPPFILEHLKEIAAILCHPCVYSFLHVPVQSGSDAVLTGMNREYTVGEFRKVVDTLCELVPGMQIATDIICGFPGETDEDFAETVNLVKDYQFPQVHISQFYPRPGTPAARMKKVPSNDVKKRSRELTSVFESFSPYQGMEGKVERIWVTMIATDGVHLVGHTKGYIQVLVIAPDSMLGTSAVVRITSVGRWSVFGEVIEGSVVVGEAPKQISIVPQKEHRQNQVEEADCCGADSCGTCACSDVVQNCVPEQCKNTPDAHQTIDDVNRQEAIQSTLVRRNVEGSTKASESSAVTRSVGQEQQVNFVTRRGLNVDTILWCGLALSFAATVALLVLLTSKISSTSSN

SEQ ID NO: 512 - protein, 471 aa, Setaria italica
MAPLPRAACLLRSAAGRLRSPPPPPARLLSSAAGTGTGVGAGAGREAAIVAAAVAVAGSGLGLWLKPPSLADSGETEAGGQISVAGAGAGAAEARGERGRFLFADSFRRRVFFNYEKRIRLLSPPEKIFEYFASARKPEGEVYMLPADLMRAVVPVFPPSESTVVREGRLRGERSPGELHCAPSKFFMLFDTNGDGLISFAEYIFFVTLLSIPESNFSVAFKMFDVDHSGVIDREEFKKIMSLMRSFNRQGATHKDGLRIGLKVGQPVENGGVVEFFFGNDGNEPLHYDKFSKFLKELHDEIIRLEFSHYDVKSSNTIPAKDFALSMVASADMNHINMLLDRVDDLVNDPDLKDMRISFEEFKAFADLRRRLEPLSMAIFAYGKVNGLLTKQDLKHAAQHVCGVDLTDRVVDIIFHVFDTNQDGNLSSEEFLRALQRRETDIRQPTIPGPLGFLSCWFGGRKSSSLRQMVF

SEQ ID NO: 513 - protein, 70 aa, Setaria italica
MAGGNLFGRALSYVVNEFLVEGLANNRAFQRFAVKTNRTLESLSSKAKEVREELSEQLKEARGQDDHFRR

SEQ ID NO: 514 - protein, 226 aa, Setaria italica
MAMSAGPLLAALLLPALLLSAASAADSTNNPADQLVSLVNSNRTASKASSLSDNQGLGCIALQYIKAYQGQCSDVRDKKPPESSFAEKFAPDCGVQVATLSKITGRLVACQSKYPSPPEALDILVNDAKDLQVLHSKNHTEIGVAVSGTDGGGPYFWCVLFSGGKPATSFKVDGEVPKTAMHPGCFSGNNDDCAGPSPTNGAVPTIAGASRLVAALLFVMACALAL

SEQ ID NO: 515 - protein, 328 aa, Setaria italica
MSWCTIESDPGVFTELIQQMQVKGVQVEELYSLDVDSLSELRPIYGLIFLFKWIPGEKDERPVVRDPNPNLFFAHQVINNACATQAILSVLMNRPEIDIGPELSQLKEFTGAFTPDLKGLAIGNSESIRTAHNSFARPEPFISDEQRAATKDDDVYHFISYLPFEGVLYELDGLKEGPVNLGQCGGLDDLDWLQMVQPVIQERIERYSQSEIRFNLMAIIKNRKEVYSAELEDLEKRREQILQEMNKTSATESLNNSLTEVISAIETVSEKIIMEEEKFKKWKTENIRRKHNYIPFLFNLLKMLAEKQQLKPLVEKAKQQKSSSPSTR

SEQ ID NO: 516 - protein, 531 aa, Setaria italica
MSAAAEPAADQNPKPKDAKPHEPTAEAGAEFAEEEYEEDGEEYEEEEEEELDGPAAAAAERERVQSVFRRLSSDPVGIRVHDVIIKGNTKTRDELIEAEVADLLRAAPTVQDLLRAASVATGRLHRLDVFDAVKITLDAGPPELPGTTNVVVEVVEAANPLTGTAGVYSKPEARSWSLEGSLKLKNPFGYGDIWDASGSYGWDQTTEVGVGIYLPRFKSIPTPLMARASLSSQDWLKFSSYKERLLGLSFGLISTMNHDLSYNLTWRTLTDPSRASSKAIRRQLGHNLLSALKYTYKIDERDSLLRPTKGYAFQSTSQVGGLWDNKGLRFFRQEFDVRGAVPLGFYNAALNVGVGAGVILPLGRGFMNSSSPVPDRFFLGGHSSPVCSLSGLSSLLGFKTRGVGPTEARRLVPNESDSGSAPAPGRDYLGGDLAVSAFADLSFDLPLKLFRDAGIHGHAFLAAGNLTKLSEGEYKNFSVSDFKRTFRSSAGAGIILPTKLFRVEVNYCYILKQAEHDSGKTGIQFSFSSPM

SEQ ID NO: 517 - protein, 426 aa, Setaria italica
MAAPSSSLASSSHLSRRGTATAGAAAVVPSSPLQPQPQLLRHACSARRTQRVRCSWAGGRAASRRRTLGVCFVVSPSQPAGLAAIDVPAASIPNTTTIPERISVSSLLEVVSDDLLKLNNNLKSLVGAENPVLVSAAEQIFGAGGKRLRPALVFLVSRATAELAGLSELTTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAICEQMYEYGRNLGLSFQVVDDILDFTQSAEQLGKPAGSDLAKGNLTAPVIFALQDEPELREIIDSEFSETDSLAAAIDLVHRSGGIRRAHELAREKGDLAIQNLQCLPRSDFRSTLEKMVKYNLERIE

SEQ ID NO: 518 - protein, 294 aa, Setaria italica
MVIPAAFSSSLVVRSAVGVLLAAAIAARAVRRRSLDASGGIAGFVVMAVHIACGYRYGAVLLAFFLSSSKLTKIGEDRKRRVEEEFKEGGQRNWIQVLANSTIATILVVIFEIITGGQDQCLDSNGSKIITGIMGGIIGHYCCCNGDTWSSEIGVLSNEQPRLITTLKHVRKGTNGGVTLQGLLAATGGGLLIGLTFIIVGLLTAECSFDVALQQLLVLPISAAAGLLGSLIDSLLGATLQFSGYCSVRKKVVSKSGPTVTKISGMTVLDNDAINAVSILLTTILTAFVCIYIF

SEQ ID NO: 519 - protein, 280 aa, Setaria italica
MAGKRNGYDDDNVNPFAGGSVPPATNSRLSPLSHEPADFYNVDIPLDSTKDLKKKEKELQAMEAELNKRERELKRKEEAASRAGIVIEEKNWPPLFPLIHHNISNEIPIHLQRTQYLAFSSFLGLIGCLFFNVIATTTAWIKGEGVIIWLLAIIYFISGAPGAYVLWYRPLYNAMRTESALKFGWFFLFYMIHIIFCVWAAVAPPFPFKGKSLAGILPAIDVISKSAIVGIFYFVGFGLFCLESLLSIAVIQQVYMYFRGSGKAAEMKREAARGALSSAF

SEQ ID NO: 520 - protein, 202 aa, Unknown
  Sequence found in Organisms: Zea mays, Pennisetum glaucum, Oryza sativa, Cenchrus ciliaris, Setaria italica, Eragrostis curvula, Saccharum officinarum, Panicum virgatum
MVSSSSPVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNVQRYGPVISTIPQQLSRFQFNMVSS

SEQ ID NO: 521 - protein, 175 aa, Setaria italica
MGSLLTRTGVLPWLQSKIVDPVLQVIRRGAEPKQLAFSAALGVTIGIFPICGTTVILGGVAVAMLGSRCNAVTLMVLNLAATPIELSLIIPFLRLGEAVTGSGHFPLTADALKNVLTGHASKDVLLSIVHAMLGWLIAAPFVLGVLYTVSVPCFKILADRFGGIPSSPRTPIKAV

SEQ ID NO: 522 - protein, 624 aa, Setaria italica
MKSSLRKLRGFALQRHEQRVDRDRGRGHSTAAAATAADELLVAAQDMADMRSCYDNLLSVAAAIANSAYEFSEALQEMGTCLLKRVTPNKDGINDKVLLLLGKSQFELRKLVDSYRVHVLNTITTPSQSLLNELQTVEEMKRQCDEKRELYEFMLNAQKEKGRSKSAKGDTGASEQLRQAQEDYQEEATLFLFRLKSLKQGQFRSLFTQAARHHAAQLNLFRKGLKSLEAVEPHVRLAAEQQHIDHQFSALEEEDYFVEDENDDDYNDSHDGELSFDYGENKEAEESGNATRSHTEDFFNRSKEEYSSVPRERQRIVSQSAPLFPEKKLETEEKIKDLRRSATRKLNTYVLPTPNDVRATSQIVSGNPTLGPLDSRGPLPSPPHTSADMGDLRDNKLPSPTRLSNAQSVLKESNTNTAETRKTLPVGDIALPGYYDLKASDNKKVKRGSFSGPIASRPRSTENIDVLSAAPRHSSAHQPIHIRVSPGNSPPPISSPKIKELHELPRPPVNTSKNTAFPSLVAHSAPLVPNSASLVPKVQDHFRARQTPPSTASPLPTPPTPPGPIARSFSIPSRRTSGISDGKETDERQDKGAARMSLSSLPSAQTFLEDREPLSAAAESVSKT

SEQ ID NO: 523 - protein, 266 aa, Setaria italica
MASDVPMSPELEQVDGEIRDIFRDLQKGFQKMDKIKDSNRQSKQLEDLTGKMRECKRLIKEFDRILKDEEKKNTPDVNKQLNDKKQFMIKELNSYVTLRKTYQSSLGNKRIELFDTGNDQVAEDTPVQMASEMSNQELISAGRKQMDQTDQAIERSKMVVAQTVEVGAQTAATLTQQTEQMKRIGNELDSVHFSLKKASQMVKEIGRQVATDKCIMAFLFLIVCGVIAIIVVKIVNPHNKSLRDIPGLAPPAMNRKLLSIDPFGGL

SEQ ID NO: 524 - protein, 723 aa, Setaria italica
MGTERKRKVSLFDVVDETSVSAKLGRAATNGAAAAAAGGANPTVNRWNGRPYSGRYFEILEKRRTLPVWQQKDEFLRALRDNQTLILVGETGSGKTTQIPQFVLEAEGLGNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQGYFSGAPLMKVPGRLHPVEIFYTQEPERDYLEAAIRTVVQIHTCEPAGDILVFLTGEEEIEDACRKINKEINNMGDQVGPVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAPETLMRALEVLNYLGALDDEGNLTQLGEMMSEFPLDPQMSKMLVISPKYNCSNEILSVSAMLSVPNCFLRPREAQKAADEAKARFGHIDGDHLTLLNVYHAYKQNNEDPQWCYENFINSRALKSADNVRQQLVRIMTRFNLKMCSTDFNSREYYVNIRKAMLSGYFMQVAHLERTGHYLTVKDNQVVHLHPSNCMDHKPEWVIYNEYVLTTRNFIRTVTDIRGEWLIDIAPHYYDLSNFPSCEAKRVLERLYNKRERERATNRG

SEQ ID NO: 525 - protein, 97 aa, Setaria italica
MAKRLIPSLNRVLVEKLLQPKKSAGGILLPETTKQLNAAKVIAVGPGDRDRDGKLIPVSLNEGDTVLLPEYGGTEVKLAEKEYLLFREHDILGKLLE

SEQ ID NO: 526 - protein, 423 aa, Setaria italica
MAMRARVMGLGGGRRELLVSAAFTALLVASILLLPSLLLTGAGAGPKSWPFLSSLAASDGAAGEAPRYPVSFAYLISASSGDAGRAARLLAALYHPANSYLLHLDREAPAEEHRRLAELVSGRGVYATAGNVWIVGRPNLVTYRGPTMLTTTLHAVALLLRLRRRWDWFVNLSASDYPLVTQDDMMEAFAGLPRDLNFIQHTSHLGWKIKKRARPVILDTALYEDGRAELLRPENISTNLRRFPTAFKLYTGSAWTMLSRPFAEYVTMGWDNLPRTLLLYHANIISSPEFYFQTVACNSRRFRNATVNHDLHFIRWDNPPKQHPLYLTARDYRRMLLSGVPFARKFREGDPVLDRIDRDILRRRDPGQFAYGGWCSEGGAALCGNPQEPGREGAVKAGAGSRRLKALLRKALSPKNFRKQQCR

SEQ ID NO: 527 - protein, 874 aa, Gossypium raimondii
MAAGNKFARFLHKHTSKITVILVYAVLEWILIFLLLLNSFFTYLITKFANYFGLKPPCPWCSRVDHVLEPDNSNSSNSYRDLVCDKHGSEISKLSYCSSHGKLAETHLMCEECLASRPTPSDGKSIGMTRRIAFISWVSGDPKLDNGEKVVPCSCCNGTKLHPPYFLFKPSWGALDCAEKGSLIIQAIEDDDDNDGSESDQCKDGEDMIEIKLNNQDDDDDDDDQNDQRAKTEHQVLFEKDVHEDDRSDAINIAEKHFSSATSGIVEPCFAGDYMLDFINLHHQKCVSDRLFPVELIDLSTSASHFSEKQDNGSETSDSSNEETPLHAIDEIAETITSPREAENLELDHQLDKNDLNLMAERPISETTLLSTQDSDLPQIQVSDSSLQCLREDGFSTFKDQAKGVDAPESSKTQILGFTLGTHEEKSTMDENGERINASLSVHTDCNNNEAEEEKFPDTPTSSHEGMHYLHNKLLFFGKRQSGIEESLDGSVVTEMESGDPVRTIERLKTSLKAERKALSALYAELEEERSASAIAANQTMAMITRLQEEKAAMQMEALQYQRMMEEQSEYDQEALQLLNELMIKREKEKEELEKELEVYRKKVLYYEAKEKTRIMRISKDGSLGSGKSSAACSYAEDSDELSIDLNREAKDEDSSFSGNQESSSDAVGNLEEMALDCVNHVSALDESLTEFEEERLSILDQLKALEDKLLTMGDDQFMEDLKSIQNSFDGLDEKNDLRSKEGNEFSKETSCGKTMASMAKSLLPFLDAADNGTEEGTMYGKQGESDSEPVVMQTYPGPELELDPKKLAIEEEVDHVYERLQALEEDKEFLKNCMSSIKKGDKGMDLLQEILQHLRDLRAVELRTRTLCGDVQG

SEQ ID NO: 528 - protein, 266 aa, Zea mays
MVALTAGISVATGVVFSPAGRRRGRGHAAFRCSSSSAGERQALFSRIAPVYDHLNDVLSLGQHRTWKRICVSWSRAKMGDRVLDLCCGSGDLAFLLSQKVGLDGEVMAVDFSSQQLQTAAGRQEQRWKLCYKNIKWIEGDALDLPFTDCYFDAVTVGYGLRNVVDKPKAMQEIYRVLKPGSRASILDFNKSSSLFTASLQSWAIDNVVVPLASGYGLTEEYKYLKSSISQYLTGEELEKLAKEAGFCAAKHYELGGGLMGNLVATR

SEQ ID NO: 529 - protein, 208 aa, Zea mays
MASRSASKDIITLRGSAAIVSEFFGYAANSILYNRAVYPEESFSKVKKYGLTMLLTQDEGVKNFIASLTSQLSEWLEAGKLQRIVLVIMSKATSEVLERWNFNIVTDAEVVEKGAIKEKSDKEIMREIQAIMRQIASCITYLPCLDEPCVFDVLAYTDTDVDAPGTWVESDAKLIDNPQMVKLHSFDTKIHKVDTLVSYKKDEWDEEE

SEQ ID NO: 530 - protein, 347 aa, Zea mays
MARVLPLETAEMARGEEAVVDMPRSSAGASCTAVDHSEQSRKDDEYERLVTRAQHATSDVGTTILSEQPKSRSFIWWMKVLLGCFLLILVGYVFVKWGVPFVFEKVLLPIMQWEASAFGRPVLAIVLVASLALFPVILVPSGPSMWLAGMIFGYGWGFLIIMAGSTIGMVVPYWIGSLFRERLHVWLTKWPQQIALIKLAGEGNWFQQFRVVALFRISPFPYTIFNYAVTVTEIKFNPYLCGSVAGMVPEAFIYIYSGRLIRTLADMKYGNYKMTPVEIAYNAISFVIAIALTVAFTVYAKRALGDIKSPDDGIGKDEEDHGPNGSGVRMNRRQERADARYIELDDM

SEQ ID NO: 531 - protein, 204 aa, Zea mays
MAALGSSVTSRGLALHTSVCVVFLHRRHGNPVIPAAPSRPQRSLASGLTTSSSGMNNAFPIIKGTTRIPAVGPGPANPAGGNLPIPSSMPPWAKWVAGAVILAIPIYRRFRTLEDKIEKTAEVAIEVVDTVAEAAEKVAGEVAGAFPGNDGLREAASKIKTVADEIEEDAEKAEALIEKVDEIKKEVDSIVDPIIDKVVKDKEI

SEQ ID NO: 532 - protein, 726 aa, Zea mays
MALLLRPIPPPPRLRALLGRLLSTGASLFPSRMLPAPRSTAAVPRLLFGPSAVAAAATRRNGVRVRAFMASTTASEAMHEKQVSAEYTAANVQVLEALDGVRTRPGMYIGSTGPRGLHHLVYEILDNAVDEAQAGHASKIDVVLHDDNSVSVTDNGRGIPTDMHPQTKKSCVETVLTLMHAGGKFGGSKSGYSVSGGLHGVGLSVVNALSETLEVTVWRDGKEHRQSYSRGKPTTRLTSSTLTGETSSRQGTRIRFWPDKDIFTTTIDFDFNTISSRIRELAFLNPELTIILTKEEGHTVQRNEYCYAGGLVEYVKWLNTDKKPLHDPIAFRKELDGITVDVSLQWSSDSYSDTVLGYANSIRTIDGGTHIDGLKASLTRTINNLAKKSKTIKDKDITLSGEHVREGMTCIISVKVPSPEFEGQTKTRLGNPEVRRIVEQSVQENLTEYLELHPDVLDSILSKSLNALKAALAAKRARELVRTKSVLKSSSLPGKLADCASANPEESEIFIVEGDSAGGSAKQGRDRRFQAILPLRGKILNIERRDEAAMYKNEEIQNLILALGLGVKGEDFKKEALRYHKIVILTDADVDGAHIRTLLLTFFFRYQRALFDEGCIYVGVPPLYKVERGKLAHYCYDDADLKEIVNTFPANASYHIQRFKGLGEMMPAQLWETTMDPERRLLKQLRVEDAAEANVVFSSLMGTRVEYRKELIQKAASMINIDQLDI

SEQ ID NO: 533 - protein, 584 aa, Zea mays
MSAAVACAERATNDMLIGPDWAVNIELCDIINMDPGQAKDTLKLLKKRLASKNTKVQILTLYVLETLSKNCGDIVHQQIVERDILSEMVKIVKKKPDLSVREKILSLIDTWQVAFGGPSGKYRQYHAAYQELRAAGVDFPPREENSVPLFTPPQTQPLRHPHLYTPPGQSYEDAAIQASLQSAPPASALSLSEIQSARGIVDVLDEMLNALDHRHPEGVREEVIVDLVGQCRSYQSRVMDLVNSTGDESLLFQALGLNDELQRVVQRHDDIAKGIPPGTGAPLPASGNVNQGTAPPRPTAVSFSPLLNVHEDDEPEDEFSVLSRRSARDGAVAQNNVPSAPRNERSYPSPLLPPPPASKRPVYTEASSVDYLSGDSYKSEKVSDDFINPTAPANISTSSHSKAEAHPPPSYGGRPDRVSDDFINPTAPSFSAPSRPTNEEPARPSVKRQESLPDDDFINPTALPGFSSSSATKESGEDLPKAPWEAQAAAGSLPPPPARYGQRQQYFEQNVYSGGSNEGGYNGLTTQTEGLSLNPRSSENERSAARPAASRPAKPEDSLFKDLVDFAKTKPSSPSKPANSRRTR

SEQ ID NO: 534 - protein, 325 aa, Zea mays
MEVVVAAKQKAKKHIHLFYCSECEELALKIAASSDAIELQSINWRSFDDGFPNLFINKAHDIRGQHVAFLASFSSPSVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDAENITIAFPDDGAWKRFHKLLQHFPMIVCNKVREGDKRIVRIKEGLPEGRHVVIVDDLVQSGGTLRECQKVLALHGAAKVSAYVTHAVFPKQSYERFMASSSAGPGDRFAYFWITDSCPHTVKAIGQRPPFEVLSLAGSIADALQI

SEQ ID NO: 535 - protein, 120 aa, Zea mays
MHDFCFTIPYGFAVLAGGVLGYLRRGSTASLAGGAGAGALLLLAGFVSLKAFQKRRNSYVALALETLCALALTSVMGQRFLETSKIMPAGAVAGLSAVMSAFYLFKIATGGNHIPPPKKE

SEQ ID NO: 536 - protein, 657 aa, Zea mays
MEMAETLHVLPDDGNGSAAVQTEPYCHEDAIEDMESFLDEVNDRVHVSGIVTGAIIKGILSDVRQEAASQIALKDAEISSLNQKLQQPVNGSLSLSEGRDKRHDEFYSLRQQLDSISKSLLNSEWGLSGSQHNFEDSENASKQQDKENSSRNGVAKTIHPGDSKEEVFGDPKLLDHMDKVALIAHFNKSMNEMKRQHDSVLYQRTEEIFKLKREILKKDGSNPFHLRNNKELEQTRKKIEEVISKLDVLLLENKRASVRIKSNAIPGQQDKNNVLGSEIEQLESGASNNEDYHCSIPTHSSHFASREADHELNIVRPQFDVEDARIAATFREEIERIIIKEFISEINIELHGYEIEGGMKQEVCSIIHNEAIARAMSNIDSLLLKYEEKKGHAEEESLHKQKIEKLKLIVDSFTEVLSEKEKFVSQIGLEAMQTRVESMCCELDLLRDKVAKQDSYLSEKNREFDAIMCRLEQAQQHVQHNDVTLVELNDRLRTISNSLKDLEKQNQALHYAMEEKEKMLTSAVSKDNDMREFMENLVKSIKDFEIVMMNQQAVVANKVDHHESRFCLLKEQCKHLAKEGNLLRKKALRYKEISETRDSNLQKAELEVDLLGDEVEALTDLLAKIYTALDHYSPVLQHYTGVMETLSMIKKHISMAK

SEQ ID NO: 537 - protein, 223 aa, Zea mays
MAMFARPLLATLLLLPAFLLSAASAADSKSNPADELVALINSNRTAGKASSVSDNQGLGCIALQYIKAYEGHCDQVDDKKPMESSFTDTFAPTCGVQATTLSKITGRLVACQSQYLAPAEAFGVLLVNDAKGLQILRSKNHTEVGAAVSGTDGGGPYFWCVLFSDGKPTTSFKVDGEVPKAAIHPGCFSGNNDDCSGPTNGAVLTSAGALRLVTAILFAVAAL

SEQ ID NO: 538 - protein, 524 aa, Zea mays
MAEVKPEEISHPPMEQLQGFEYCIDSNPPWGEAIILGFQHYILALGTAVMIPTVLVPMMGGDDGDRVRVVQTLLFVTGINTLLQSLFGTRLPTVIGGSYAFVIPIMAIIQDPSLSGIPDGHERFLETMKAIQGALIVSSSIQIILGYSQLWGIFSRFFSPVGMTPVVALLGFGLFERGFPVVGRCVEIGLPMLILFVVLSQYLKNIQIKEIPILERFSLFICVALVWAYAQILTSGGAYKNSAEVTQNNCRTDRANLISSAPWIKIPYPLQWGAPTFNAGQSFGIVSAVLVSLVESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYTMAAHRGPAHTKAGWFNDYINTIFSSPPTVGLMVAVFLDNTLEVKQAGMDRGMPWWQRFRTFKGDSRNEEFYRLPFNLNRFFPPA

SEQ ID NO: 539 - protein, 586 aa, Zea mays
MRHLLLSRFLRRGGGSGIPNGHYHHLPLLRALSSSPSPVSSDAELRKYAGYALLLLGCGAATYYSFPFPADALHKKAVPFRYAPLPEDLHAVSNWSGTHEVHARVLLQPDSLPALEGALAAAHKERRKLRPLGSGLSPNGIALSRAGMVNLALMDKVLDVDAKKKTVTVQAGIRVAELVDALREHGLTLQNFASIREQQVGGFTQVGAHGTGATLPPVDEQVISMKLVTPAKGTIELSREKDPELFYLARCGLGGLGVVAEVTLQCVERHQLVEHTFVSNADEVKKNHKKWLSENKHIKYLWIPYTDTVVVVQCNPPSKWITPKLASKYGKDEALQHVRDLYRESLKKYRTETESKDPEIDTLSFTELRDKLLALDPLDKDHVVKINKAEAEYWKKSEGYRMGWSDEILGFDCGGQQWVSENCFPTGTLAKPSMKDLDYIDKLLQLIEKEEIPAPGPIEQRWTARSKSPMSPASSSEEDDVFSWVGIIMYLPTSDARQRKEITEEFFSYRSLARSLWDDYSAYEHWAKIEVPKDKDELAELQARLRKRFPVDAYNKARMELDPNKVLSNAKLEKMFPVLEPPHQTK

SEQ ID NO: 540 - protein, 309 aa, Zea mays
MDRGQNGRDDVFGRRDPFSGFGFGPHRSLFSGLLGGRDPFDDPFFTHPFGGRMMGDHDMFVPSPFGPMGGPFGDMRNGGFIEQAPPRGNRRRPVITEVEEDGGENAEHGNQQPNQDPYVQEPDDGIDETEGGQVELHRDLSRANSGGQPQARTFTYQSSSVTFGGINGAYYTTSKSRRTGSDGITVEESKEADTTTKEATHRISRGIHDKGHSLTRKLNSDGKVDTTQTLHNLNEDELAGFEQSWKGNAGHYLPDWNHNAGAPNSDNSGDRSSNGRDRRSASGWALPGTEQGRDPRRNGKPKSRVIPIS

SEQ ID NO: 541 - protein, 81 aa, Zea mays
MELGDKAVGFLLTLTSLTLFTYYTFWVIILPFVDSDHFVHKYFLPQEYAILIPVLAGVVLLSFLSVFVGLVMLKSKKKKTA

SEQ ID NO: 542 - protein, 277 aa, Zea mays
MVSTSSTPHPLDPSVPAVVGGGKEEEEEAVESCAAAAATPLPPVGIDDEEEGPRRVRKPYTITKSRESWTDPEHDKFLEALQLFDRDWKKIEAYVGSKTVIQIRSHAQKYFLKVQKNGTGEHLPPPRPKRKAAHPYPHKSSKKALQVVLPQQVSHIMEQGCGTPMDVATVATDSSVNNAFPVQHFSPRHTQAMPDFARVYNFLGSIFDPETNGHLQKLKEMDPIDAETVLLLMKNLSINLTSPNFEEHRRLLSSDASSMDQKSGSSRVHLPFMITSK

SEQ ID NO: 543 - protein, 148 aa, Zea mays
MAKPQLLLCFLLAASAPLIVATAKKSGDVSELQIGVKYKPESCSIQAHKGDKVKVHYRGKLTDGTVFDSSYERGDPIEFELGTGQVIKGWDQGLLGMCVGEKRKLKIPSKLGYGPQGSPPTIPGGATLIFDTELVAVNGEPTNQSDEL

SEQ ID NO: 544 - protein, 509 aa, Zea mays
MDGSSKGSGHSEALRNYNLGRTLGIGTFGKVKIAEHKLTGHRVAIKIINCRQMRNMEMEEKAKREFKILKLFIHPHIIRLYEVIYTPTDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVEPMKRITIREIREHQWFQIRLPRYLAVPPPDTTQQAKMIDEDTLRDVVNMGFNKNHVCESLCSRLQNEATVAYYLLLDNRFRATSGYLGADYQESMDRNLNQLASSESSSSGTRNYVPGSSDPHSSGLRPYYPVERKWALGLQSRAHPREIMVEVLKALQELNVRWKKNGHYNVKCRWCPGFPEVNDTLDASNSFLGDSTIMDNDDANGRLPTVIKFEFQLYKTKDDKYLLDMQRVTGPQLLFLDFCAAFLTKLRVL

SEQ ID NO: 545 - protein, 171 aa, Zea mays
MLSSTSLAALLHGRPHYPFPASKAHLFLALPNNPTRFLASASVRVAYPPRWPLRAADGERDNRVQELRVPDSWLTPAGATQESEWLRETLRKWLDDEYCPEPANVDISSTAARSYRESLIARQSDLGEILLRMVGDLDKLSYRESFHGPFSAANAAVRLIAQRMEESLPDE

SEQ ID NO: 546 - protein, 1175 aa, Zea mays
MHIKEVTLEGFKSYAGRTVVPGFDPLFNAITGLNGSGKSNILDSICFVLGITDLRQVRAASLQELVYKQGQAGVTKATVSIVFDNSDRSRSPLGYEDSPEITVTRQIVVGGRNKYLINGHLAQPSRVQTLFHSVQLNVNNPHFLIMQGRITKVLNMKPPEILSMLEEAAGTRMYEMKKESALKTLEKKQNKVDEINKLLDVEILPALEKLRKERCQYMKWANGNAELDRLKRFCIAYDFVQAERVRDGALNDVKQIKTKIVELDETTENIKAAIQEMDNNISTLAAEKEAKVGGEMKVLSDKVDKLSHVLIKETSVMNNQEETLKSEEKGAEKILTNIEDIKRSILERDAAVKNVENEASDMKRRAEDLTKELDEKEKEYQGVLAGKSSANEKKCLEDQLRDAKAAVGDAESGLKQLATKIKHSEKELKEKKTLLVSKRDEAIAAENELKTRTKDLEGIKASMGSINYDEGQMEALQKDRSAELEIIQKLKDRVRNLSGELANVHFSYRDPERNFDRSKVKGVVARLIRIKDSSTATALEVAAGGRLFNVVVDTEETGKQLLKNGDLRSRVTIIPLNKIQTYMIPDRVQQTARRLVGPDNVTLALELVGYGEEVKNAVAFVFGSTFVCRNMDAAKEVAFNRQISSTSVTLEGDTYQPSGLLTGGSKGGRGNLLRKLDELAKAEADLSDHEKKLFVIEQQIGALLPLQKRHTELKSQFELKSYDLSLFQNRVEQNEHHKLGELVKKIEQELQESKQELTEKQVQHEKCVSTVSELEKTIKTYGTEREGKLKALEKRIKSIKSEMQSMSKQLKAYESDRERLIMEKDAVVGELATLEEQLTTSKAQITSLSETLEKQKDKVTSIKQDYDQAESELNVGRSKLKECDSQINRMAKEQQKLQQKLSDSNVERKKMENEVKRMEIEQKDCSSIVDKLVEKYNWIATEKQLFGKSGTDYDFESCEPHKAREELENLQAQQSSLEKRVNKKVMAMFEKAEDEYNDLMSKKNIIENDKAKIKKVIEELDEKKKETLKVTWLKVNKDFGSIFSTLLPGTMAKLDPPEGGTFLDGLEVRVAFGTVWKQSLSELSGGQRSLLALSLILALLLFKPAPLYILDEVDAALDLSHTQNIGRMIKAHFPHSQFIVVSLKEGMFNNANVIFRTKFVDGVSTVTRTVPSKQR

SEQ ID NO: 547 - protein, 135 aa, Zea mays
MSEYKNVVGGRLKLKGKALDVKEGGVKKKKKKHQLEESSQIEHDELHKGGDSGLPTDHNNELIEAGKVGDEEGNPHPDYDHLTPAERRYIEQKRKIDMQKLAKVANKSHRDRIQDFNQYLANLSEHYDIPKVGPG

SEQ ID NO: 548 - protein, 142 aa, Unknown
  Sequence found in Organisms: Zea mays, Sorghum bicolor, Setaria italica, Saccharum officinarum
MIRFILLQNRQGKTRLAKYYVPLEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKKAIIERMGELEKLE

SEQ ID NO: 549 - protein, 284 aa, Zea mays
MGRKGRKARVSRDADVDGSEDEMAAAPAAAAGRSLYEILGVEKTASQQEIKKAYHKLALRLHPDKNPGDEEAKEKFQQLQKVISILGDAEKRALYDETGITDDDALVGEAANDLQEYFRTMYKKVTEADIEEFEAKYRGSDSEKTDLKELYTKYKGNMNRLFCTMICSEPKLDSHRFKDIIDGAIAEGELKSTKAYEKWSKKISEMEPPTNPLERRAKSRKKSEENDLILAISQRRAERKNQFNSILSNIMSKCDSKASSSEPTEEEFELARQRLESKMAKRRK

SEQ ID NO: 550 - protein, 340 aa, Zea mays
MSSQGFGAGSPKSFRYPRGGDFDLESGSPRKGRKPKNPHLETSIVMRIRYFYEAHPVAVALILLSFGLSVLILLSVYETRFRTMRSVSAWSSDGGDYPLPMLRNLVMVAGHSIYTSSRCGETESENSWFLEPYQKHAGQAATFLAHIKEGVGIAARDEGALLLFSGGETRRDAGPRSEAQSYWAIAESKGWFGNDEGVRSRALTEEHARDSFENLLFSVCRFRELTGRYPQNITVVSYDFKEERFAQLHRTALGFPEGRFFFSGTPATPSAREAALKGEAAVRAQFLEDPYGCLGSLHVKRLKRDPFHRTIPYPAGCPELKGLFSYCGPVPYSGHLPWTE

SEQ ID NO: 551 - protein, 54 aa, Zea mays
MEMKKIACAVLVAASATVALAAEAPAPSPTSGSSAVAPAIVGAAVASFFAYYIH

SEQ ID NO: 552 - protein, 343 aa, Zea mays
MASTAFAAAKYFPAHLDSSPRIAPRRAAPTASLSFSPLSASPSSLLRLRSPCPSGPGGRLPPPPPPPPRSYGGGGGSGGDAANSGGGRRGGGILGLFLAGWAARVAADPQFPFKVLMEELVGVTACVLGDMASRPNFGLNELDFVFSTLVVGSILNFVLMYLLAPTAAASSAASALPSHMFEPGAFSLGSRVATLVSKGATFAVVGFAAGLAGTALSNGLMAMRKRMDPAFETPNKPPPTLLNAATWALHMAGSSNLRYQTLNGVEYMLGKVAPAPVFKASVVVLRCLNNVLGGVSFVLLARLTGAQKSDKPATVAEEKDRLIAVGNAAADAIGEARDGEEGK

SEQ ID NO: 553 - protein, 685 aa, Zea mays
MDLDMDGYVDPYEEAAAEGDSDDPDEDDSDAESDYEEKSFGLLKSGKHRVRNPDGTFRCPFCLGKKKQGYKIKDLLQHADGIGVSSKHRRHGRERANHRAFARFVRTDPSFAEDLVGITGIQGAITTTPANENYSANGNGKAKANVDTAGSSSVAAKVGPPQEVERFAWPWACVLAAGAGFNAEDFVGRVALFSSVEVVPLFVDEMEVTETFAIVRFTNDWSGFNDALTIENYFSVNKLGKKEFQMRDSGLGSVEGDGEGDVKVYGWVARAEDYDATTVVGRFLRKHTVLQTIDEVSKTELEKSGEMVAILASQIEEKNRYLQDLETKKNATELSISRLEEDNRKLHEAYNEEMRNLHRRARENALRIFQENENLRIDLENKRRELNLRAKELEKMSAENANDRKTLDDQKQKTKYDNSELELASIEQQRADADVLKLLADQEREKEDVLARMLQLEKELHEKQQLELEVERLNGTLQVMKHLEGDDDGGDIHEKMEKLSERFEREKKRLEDLSGDLVTKERESNDELQQARKELIKGLEEELNGRTAVGIKRMGELDEKPFLNACKRKYGNNEYQVKAAELVTNWQEELKNPSWYPFKMIHVDGEDKEILVDDDTKLKFLWIEFGDDVCNAVKTALMEINEYNPSGRYVVPELWNFRKGRKATMKEVLKYLFSQMDTTTKRRRG

SEQ ID NO: 554 - protein, 580 aa, Zea mays
MTEEAEAKAKGNAAFAAGRFEEAVQHFSDAIALAPDNHVLYSNRSAAYASLWRYAEALDDAKRTVALKPDWAKGYSRLGAAHLGLGDAPKAVEAYEKGLALEPSNEALKSGLAQARQSASAPRRPVGSGADAVGKMFQGPELWSKVAADPTTRGYLDQPDFVQMLREVQRNPGRLNSYLSDQRMVQVLTLMLNIKFQNQSSGAPDPAAAQSNPPPPKQQPEAKAREPEPDPEPEPMEVTEEDKEQKERKASAQKEKEAGNAAYKRKDFDTAIQHYTEAMELDDEDISYITNRAAVYLEMGKYDECIKDCDKAVERGRELHADFKMISRALTRKGTALAKLAKSSQDYDAAIEIFQKALTEHRNPDTLKKLNDAERAKKELEQQEYYDPRIADEEREKGNEFFKQQKYPEAVKHYTEALRRNPKDPRVYSNRAACYTKLGALPEGLKDAEKCIELDPTFSKGYTRKGAIQFFMKEYDKALETYQAGLKHDPKNQELLDGVRRCVEQINKASRGELSEEELKERQNKAMQDPEIQNILTDPIMQQVLTDLQENPRAAQAHLKNPGVMQKIQKLVSAGIVQMK

SEQ ID NO: 555 - protein, 297 aa, Zea mays
MAPPRRALLVLAALLLSLSLGAASFHSDELLLNDDEEFEGVVARPSAPSPPAAPVVSSSRRRSADAPLPGSGESNAVQFTLEHDLGDGKGFVSAGTFSARLKTFAHGTQTLTKLRFTRNDFTEDDKAAFKKVLQEDGFYTIRLPSNVLDTTKKHHVVSSIRARCIPRDSLDEHIVIHMDGVNILAVNYGSVDGCQYPRPMKLPSKWTFSSYTILKTAEQAPRTPSFADQLIEADNGLGEVMKPPEKSFWAKYWMYIIPLGLIVMNAVTAAANIPEEAAGQGQPGAQRAPAAVAGRRR

SEQ ID NO: 556 - protein, 333 aa, Zea mays
MISTAHSRQQHHAFEKSPGNSHMKSIDRKLQQAMSQAASKYMQRIYPLGMQRSSSSLTLSSLSLSQNSNDSSISSSNSSWEPKVPLLYGGTFSPWGDVMVSREMRREDDDKVSDHDVEGGEEDLDCSEPGSLRRCSWITKNSDEAYVQFHDECWGVPVYSDNRLFELLSLSGMLIDHNWTEILKRRDMYREAFADFDPSAVARMEEEDVAEISGDRELRIAECRVRCIVENARCIQRVAREFGSFSGYMWGHVNHRPVVGKYRHHKYIPFRTPKSEAVSKDLVRRGFRLVGPVIVYSFMQAAGMAIDHLVDCFRFHDCVRLAERSWGITNVAA

SEQ ID NO: 557 - protein, 605 aa, Zea mays
MAKLSCFPALLPGKRKKKTRKITDAIKASGNECPKVKPVEVELIDPTLGAGVVQDVVPAELSVPVEDRNNKEAADQLVLVKESDLSDFDFSFHAAMKPVRSDSDVALDTSADAAVADTSPKLKRSCSNIETKRPGSRSAPEMPARSRSYGDLGNLVAGLALDATATPHGAPEASPASVKTSRTADRVMLKKRSSSQVLPSRSRKLWWRLFLWSHRNLHMPRSARTAHRSFSPGRHDGYTSDTFEEGPAADRKNKTVMVDESPPAASVPNQWVAFCAESSIHDRVSAWVSSIESEPPFDIAEEDDDNYDGEDDEENGECAASQPRHLELGEPSSGKGGNSKSKRCATTADEVVQANTVVQSLNAFSSVAHISGMGLKVVPMIAPFSTLRAVNLSSNLIVHISPGSLPKGLHSLDLSRNKIASVEGLRELTKLRVLNLSYNRISRIGHGLSNCTAIRELYLAGNKISDVEGLHRLLKLAVLDLSFNKITTAKALGQLVANYHSLLALNLVGNPVQANIGDDALRRAVTGLLPSLAYLNKQPVKPQRIAREVATDSIARAALSGSDSRSIRKRTSRRLTQSPRSSSLTRARGGGGGGSPTPRNTSRRR

SEQ ID NO: 558 - protein, 58 aa, Zea mays
MDKANKLSAGAGEKATKSRSHGSTALFVAVDYAFLLAFAGFLAYLVGSRILPSAAGSA

SEQ ID NO: 559 - protein, 101 aa, Zea mays
MAAASVPPTSSSGGWDFTCNLEVDYGSEENASIVYRTLAVDKELQPDKVKREMTLSGSKLAVHFAAVEARFLRASFSSFVDLMGLVTKLVEEYGVANAGHS

SEQ ID NO: 560 - protein, 409 aa, Zea mays
MAAPAQAQAQVLPLLRWSRSASFLCASSRRLFSALQRPSAAARCEAGSKAMLKGMDYSELENWVQAQGFRPGQAMMLWKCLYGNNVWAHCYDELAGLNKDFRKMITEHADLKALTMKDIHIASDGTRKILFSLEDGSVIETVIIPCARGRTTICVSSQVGCAMNCQFCFTGRMGLRKHLSTAEIVEQAVFARRLFSDELGSINNVVFMGMGEPFHNIDNVIKASAIMVDEQGLHFSPRKVTVSTSGLVPQLKRFLQESNCSLAVSLNATTDEVRNWIMPINRKYNLNLLLGTLREELNLRQKQIVLFEYVMLSGVNDSMDDAKRLIELVQGIPCKINLISFNPHGGSQFKPTPDDKIIEFRNVLIQGGLTVFVRLSRGDDQMAACGQLGEPGGYQLPLLRVPEKFQVAL

SEQ ID NO: 561 - protein, 523 aa, Zea mays
MGIQVAAVVIPPPCSSPSSSSSSPASPSSSAIATSPQHAVLGARLARSQSSLACWNAAGLGRRRGGEHTIRRALSASIDSVGSDGGDDEEFSRRIQELAVGQHPGAGGCGWPASVERSASSVGLPLSLRMLKRRKQQQLEQGRWDERLVDSAGESARAAVGRAFSSMVLIIRELQSFTLQMRETLLYEDLQGVLARVHAEMHASFVWLFQHIFSGTPALMVSLMLLLANFTVYSMGDSVAAAASLLPPHAAVAAVEMVDTQQPEQSHSQQQRFDTPALKTFSTGRTASVGGNGGGGGKVRPVAGATGDGQSDESSSYRQSGAVLPQDVSQATPLGAGAGAGSEASVSDSMAVEEAQQTVQDELVIWKRISDEAIRMQASVRAEELMDPEILEQLVAPVEAPKPDVAYPSEEHVATAQRYEQAVSEEPNSSLLLANFAQFLYQVQGDLDRAEHFFRRAVRAEPADAEALGRYAAFLWQARNDLAAAEETYQEAIAADPGNAHHAAAYAHFLWNTGGEDTCYPLD

SEQ ID NO: 562 - protein, 132 aa, Zea mays
MGSAMNKDKVHDKETHGTSSDITEKTPVETVKGPNLLERAKEEIEALAGAVHTKMEHHSSPHAKKDESHKEGKEGSLHKIKAHTDETHGTSADINENTPVDKVKGPNVFERAKEEIEAIVEAIHPKNGSDSK

SEQ ID NO: 563 - protein, 247 aa, Zea mays
MPLLAVCPRRVPPLSLARRHRRSLYRARSLALKCEVSSPPLLLTRRMSAAGSLLVAVVPVPAPSPQLPVASASELETETAEGESGASEGLALERYTDQEQGFTLLKPASWPKVEKAGATALFQQEGKGSNNIGVVVNPVRLNSLAEFGTPQFVADRLLQAEKKKESTKSAEVISVGERSGHGGLTVYEIEYMLDSTRGGMKRIFSCAFVASRKLYLLNIAYSDTQEKPLDRETRTVLEKVLHSFDSV

SEQ ID NO: 564 - protein, 747 aa, Zea mays
MRSGRACSALASLLLLWLGVAAAQKASSWKTLSGKAPAIVAKGGFSGLFPDSSEYAYQFALLASSPDTILYCDVRLTKDEIGICLPDIKMDNCTNIPDFYAQGQKSYLVNGVPTSGWFSVDYNGTELEQVTLKQSINSRTPRFDSSFFPLLAVEDVQSKFKPSGIWLNVQHDSFYSQFNLSMRNYIISVSKRVVVNYISSPEVSFLTSLLGRISNKTKLVFRFLDESSLEPSTNQTYGSMLKNLTFVSTFASGILVPKGYIWPHSPDNYLQQYTSVVDDAHKAGLEIYAADFANDFVVSYNHSYDPLAEYLSFIDNDVFSVDGVLTDFPITASEAIGCFTNLNKSNTDHGKPLIISHNGASGDYPGCTDLAYQKAVDDGADVIDCPVQVTKDGIPICMSSIDLMNDTTVARSQFISQTATIKDIQIAQGVFTFNLTWDDIVNNLQPKISTPWYSFRLDRNPRYRNAGKFMRLSDFLDFTKDKDLYGIMISVEHAAFMAGELGFDMVDKVIKALDDAGYHDQTAQKVMVQSTDSSVLEKFKEQTKYDLVYMVNKKVGDAASSSLVDIKRFASAVSVDTGSVFPETHYFTVYETNLVQTLQTAGLSVYVYTLMNEFLSQPYDFFSDATAQINAYVKGALVDGLITDFPATARRYKVNSCMNMGNSTPNFMAPARPGDLMQSISKSAQPPALAPVPPLTGSDVAEPPLPPARSNSSTAPTQSLASRTRACAAHIPALASLAMLCAWLSLV

SEQ ID NO: 565 - protein, 670 aa, Zea mays
MDLLRHPFKGVVTDIKGRATWYKHDWVAGLHSGFRILAPTMYIFFASALPVIAFGAQLSTATNGILSTVETLASTAICGIIHSILGGQPLLIVGVAEPTIIMYTYLYNFAKNHQALGEQLYLAWTGWVCIWTAIMLFLLATFNASNVISRFTRIAGELFGMLITVLFLQEAIKGMISEFSVPEDADSSSPIYQFQWLYVNGLLGVIFSIGLLYTALRTRRARSWLYGTGWFRSFIADYGVPLMVIVWTGLSYLHPGKVPSGVPRRLSSPLPWESSSLGHWTTARDLFSVPPAYIFGAILPAFMVAGLYFFDHSVASQLAQQKEYNLKKPSAYHYDILVLGFVVLLCGLLGIPPSNGVLPQSPMHTKSLAVLKRQLLSKKMVDTAKESIGGSATSLEIYGKMEEVFIKMDSEQNTDSVDRELKNFKDAVLQEGDEEGRLAREFDPRKHIEAHLPVRVNEQRLSNLLQSILVGGCVGAMPVIRMIPTSVLWGYFAYMAIDSLPGNQFWERIQLLFITESRRYKVLEGPHASFVESVVPKTVTIFTIFQLVYLLICFGITWIPIAGILFPVPFFLMIVIRQYLLPKFFDPVVLRELDAAEYEELDGVPLEHKLEDEASEVGSCPSRPDAEILDELTTNRGELKHRSSSLREERPIQVTVSTHMVASSAVQPSL

SEQ ID NO: 566 - protein, 266 aa, Zea mays
MEVTSSPSPSAPPPASSKPALQLNPAAVLLRRLPTPTPTAATPVTATAPPARPATASNPLAALLVPFWRGLRRAPKQPVHPASAAAARRAAEQQEAEAEAEARQLVGCAVPLFRPYVAQLPWHGGARAWLSKLFPRYGHYCGPNWSSGKEAGSVLWDRRPVDHLDFCCYCHDMAYDTHDQAQLLRADLAFLRCLEGSRHTPARDGIAAAAIYRAMCIFGLKTILIPYRTNLVRLQTGPNYADFFADFVKRVASSSGRPTGGEKQRL

SEQ ID NO: 567 - protein, 435 aa, Zea mays
MASEKHFKYVILGGGVAAGYAAREFAKQGVKPGELAIISKEAVAPYERPALSKGYLFPTNAARLPGFYVCVGSGGEKLLPEWYSEKGIELILSTEIVKADLSTKTLTSAAGANFTYEILLIATGSSVIKLTDFGTQGADSNNILYLREIDDADKLVAAIQAKKGGKAVVVGGGYIGLELSAALKINDFDVTMVFPEPWCMPRLFTADIAAFYEAYYTNKGVKILKGTLAVGFDADANGDVTAVKLKDGTVLEADIVVVGVGGRPLTTLFKGQVAEEKGGIKTDASFETSVPGVYAIGDVATFPLKMYNELRRVEHVDHSRKSAEQAVKAIKGKESGEPVPEYDYLPYFYSRSFDLAWQFYGDNVGETILFGDSDPTSSKPKFGSYWIKDGKVLGAFLEGGSPDENKAIAKVAKTQPPVANLEELKKDGLQFASKI

SEQ ID NO: 568 - protein, 396 aa, Populus trichocarpa
MTMEEAIVVNKGDDLIDLPPGFRFHPTDEEIITHYLTEKVMNSSFCASAIGEVDLNKVEPWDLPKKAKMGEKEWYFFCQRDRKYPTGMRTNRATESGYWKATGKDKEIYKGKHSLVGMKKTLVFYKGRAPKGEKSNWVMHEYRLEGKFSYYSLPKVARDEWVVCRIFHKSTGIKKTSIHDLLRVNSFGDDFLDYSSLPPFMDPLNYNSRPSTSSFSGGDNNEFKEMATRSSDGNYFSNTSMLNNNQNFAQPPNTNYQAPNSSFHPQIPASNPLYTFQTSPNMPGYLHQGKSSSNSFQNFQNSIFSDNEHTLLRSLARNSYREASGLEKQCKVERFSSNQSMVSLSQDTGLSTDVNTTAEISSVVSKQEIGSHDKVFEDLEGPSAGPIADLDCLWDY

SEQ ID NO: 569 - protein, 505 aa, Populus trichocarpa
MAIQATFIADPVLISSPSRISIRGWEQCIGSFVLKTRPRHPRLSNGGRVRARASLNADLKAVGIPHQWYNVVADLSVKPPPPLHPKTFEPVKPEDLSPLFPDELIRQEASTDKFIDIPEEVLDIYSLWRPTPLIRAKRLEKLLDTPARIYYKYEGGSPAGSHKPNTAVPQVFYNAQQGIKNVVTETGAGQWGCSLAFACSLFGLDCEVWQVRASYDQKPYRRLMMETWGAKVHPSPSSITETGRRILQMDPSSPGSLGIAISEAVEVAAKNADTKYCLGSVLNHVLLHQTVIGEECIKQMEAIGETPDVIIGCTGGGSNFAGLSFPFIREKLNGKINPVIKAVEPAACPSLTKGVYAYDYGDTAGMTPLMKMHTLGHDFIPDPIHAGGLRYHGMAPLISHVYELGFMEAMAIPQIECFRGAIQFARSEGLIPAPEPTHAIAATIREALHCKETGEAKVILMAMCGHGHFDLKSYEKYLQGKMVDLSFDEEKIRASLDKVPQVTRN

SEQ ID NO: 570 - protein, 526 aa, Populus trichocarpa
MASSSLAFPSLQTQFQSLKKPSSPKPSTRRFSVRPIRASISEKPSVPGPPATVSPSEPTKLPIRKIPGDHGLPLIGPFKDRMDYFYNQGRDEYFKSKIQKYQSTVFRANMPPGPFIAPNPHVVVLLDGKSFPVLFDVTKVEKKDLFTGTFMPSTELTGGYRVLSYLDPSEPKHAKLKQLMFYLLKSRRDHVIPEFNASYTELFMSLEKNLALGGKASFGEANDQAAFNFLARSWFGTDPAETTLGLDGPGLVSKWVLFNLGPVLKLGLPKYLEDLTVHSFRLPPSLIKKSYQRLYDFFYASSGFLLDEAENLGISREEACHNLLFTTCFNSFGGMRILFPNMMKWLGRAGTKLHARLAEEIRSVVRSNDGSITMRGMEEMPLMKSVVYEALRIEPPVSLQFGRAKRDLIIESHDAAFEVKEGEMLFGFQPFATKDPKIFTQAEEFVADRFIGEGEKMLEHVLWSNGPETEKPTLGNKQCAGKDFVVLVSRLFVVELFLRYDSFEIEVGTSPLGAAVTVTSLKRASF

SEQ ID NO: 571 - protein, 329 aa, Oryza sativa
MGENAQGSGRRPFGDLTNVLGKRPAPSNLEKSAGGIKIVRVEKAVEPRKEFDETAKASGGATRNTLPLFDSIAKENLMRPSIFRETKMQHMAAEAAVLLSKESDDMRSCAMSLGSSGLHDKEQESSLESEGGCEEDDDDDMDSEYLAYTRDSTKTATNDGECLTQEEMAGSSGNQKPLSSLDFTTGCDDMPCSDVHHHSLGNSELENDDTTKSCACSFCLKAAFMWTDLHYQDTRGRLAALKKSIKFARLLGKRSQGDEYSVNAGRYNLKRAAEMEFELYQQQRSLFLHTENVLIRESAQLHSSLVKLKEFRENCKTDLETASSSLLGK

SEQ ID NO: 572 - protein, 465 aa, Oryza sativa
MNSLQSFLALNPPAAAAALGGARLRPSRVTACLATPTPTPPPPTSAPLAPAAAAARRELSAASRAVVEDEARYIVGTYNRSRVVLVAGRGCKLYDADGREYLDMAAGIAVNALGHADPDWVAAVSAQAATLVHASNVQYTVPQVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLAKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 573 - protein, 190 aa, Oryza sativa
MAPPPAAAAAVDGVGVGVGAHSVFVYGSLMQDEVVRTIIKRVPPSSPALLPNYHRFNIKGRIYPAILPVQSKKVAGKVITGVTDAELQILDEFEDVEYVRTRVEISLTDTSETMLADTYVWADAEDPNLYGEWDFEEWKRLHMKDFLAMTHGFMDGLEQPESKSRVETYQSFMQEIQQPGTTTTTTQVEI

SEQ ID NO: 574 - protein, 688 aa, Oryza sativa
MGGVCSAGIPGDRSPAELSFRAMGLVVEQELKAFPAVAGKVQGKHKTAPVEVAPEPDPPRRLSPEKAPRLSTGGGGGKARRSVSKEPQLVRSSSEKLKAGKSRTSTSGKASDKGSVFGRASTSGIGKAVEVLDTLSSSMTNLSPVGGFVAGAKMKGSPQKILAFEVANTIVKGMSLMQSLSKESVRYLKGTVLRSEGVKRLVSSDMSELMRIAAADKRQELALFSREVIRFGNRCKDTQWHNLDRYFSKLESEITPQPNLKEIAEAEMQQLLTLVRHTADLYHELHALDRFEQDYRRKLEEEKKSVAFERGDTVQIIRQELKSQRRHVKSLKKKSLWNKMLEDVMDKLVDIVHFLHVEIQESFGTYDGALQLNQPSESRQTLGSAGLSLHYANIISQIDNIVSRSTVPPQSTRDALYQGLPPTIKSALRKKLHNCPQPQEVPITEIRSSMERTLQWIIPIANNTARAHHGFGWVGEWANTGNDAMRRAAGQPDVIKIETFYHADKAKTEACILDLVLWLHHLISYSRPSNGGRSRSPSRSPVRSPPLTPPHQVPTTTSSSSPPPPAVARPSGGTGGGLTREDRAMLQDVYAGRRRRAPCHSRSQELSSARGGGGAGGDSSSAVAAAAQLSKNDRLSKSSNDAPARSGGGGGGGKLFPLSRRPSSAVVSPAVDFDIDGIKALADAQKRQ

SEQ ID NO: 575 - protein, 355 aa, Oryza sativa
MESCSFRTAASPSPFPSLPSSSRQAPPCSSLRFPRPRNGRMVGVRRRASGFEAFPPLPGKVFVEEAIGAEYGEGFETFRMDGPLKVDVDYLNEKLQECFLQRIRHAMKPDEACGLIFSWDNVIADTDSLKLDAWRQLALEEGKDIPNAGHVQKSILHGAADHVLRKVLCWAKDESQMERLKARLIELYYENLFKLDTPVNGLREWLDAVQTAGIPCAVASSLDRRCMIEALDRMELSKYFKAIVTDEDDMESIAHRFLSAAMKLDRKPSKCVVFEDDPRGVTAAHNCTMMAVALIGAHPAYELVQADLAIAKYSELSVINLRRLFAHKGLSFMDLQKQIIERSPPKRKLTVDTIF

SEQ ID NO: 576 - protein, 484 aa, Oryza sativa
MGLQVAAVAPSPCARSSASSSPPSTSSSRPALGGAGLARSRAPVNWGAGVMARRRGLRQPARCALSASLDGVGGGDAEFLRRIEELAAAVGVQPTGCGWPASVERSASSAGMPLSLRMLKRKKQQQQLVARQTRWDERLLGSAGDSVGRAFSSMVLIVRELQSFALQQMREAMLGDDLQSVLARVHGEMHASFVWLFQHIFAGTPALMVSLMLLLANFTVHSMGHSVAAAAAIPPAPPTSAAVAVVDTQHADPSLPRFDAASVKTFSIGRAASVGGSSGGGGKVRPVAGATGDDRWDESLARLSGVAPQQPAPPAGTGAGMAVDEQAIWERMVAEASNMQENARAEELSDPDVLGNLVAPVEAEIETEGHAEYTRTEQRYELAVSEEPNNPLILANFAQFLYLVQNDHDRAEQYFERAVRAEPADAEALSRYATFLWKARNDLAAAEDTYQEAIAADPGNAHHAAAYAHFLWNTGGEDTCFPLD

SEQ ID NO: 577 - protein, 472 aa, Oryza sativa
MADEEHAPTSRKRVAGTQINKDNPEPDDDSTEQEMGTFKRASEEVMATRRIVKVRRQQPSSAPSNPFSAIRFTPSDTSAQATIPVSEPQPSDVITANAKDSSSEKADEGSNGSGKDALPVTDKSAGSSEVAETEKDGSDLKGSDEKAKSSDSIEPPSQPVETTDEAKDLGGGSVVAGEAKEDNSKASDIEDKTAKEGDAEEEDGANEAGAEDKISKGDDEKKDGDESETKDGSSEEQKDADNKGQSSSPTPLFSFKNLSSGQNAFTGLAGTGFSGSSFSFGSGSKESSSAPLFGLKTDGSSFPSFSIGASNNGSSSPALATSAEAPKKFAMPEGPVETGEENEKAIFTADSALYEYLDGGWKERGKGELKLNIPVSGGERSRLVMRTKGNYRLVLNASLYEDMSLKDMDKKGVTFACMNSIGDSQSGLATFALKFRDTSIREEFKAAVEMHKAKKASGTLKTPENSPKASDD

SEQ ID NO: 578 - protein, 288 aa, Oryza sativa
MGNLFCCVQVDQSTVAIREQFGKFDAVLEPGCHCLPWFAGKRIAGHLTLRLQQLDVRCETKTKDNVFVNVVASIQYRALAGKANDAFYKLSNTRSQIQAYVFDVIRASVPKLNLDDAFEQKNDIAKAVEDELEKAMSAYGFEIVQTLIVDIEPDEHVKRAMNEINAAARLRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGQATTTSH

SEQ ID NO: 579 - protein, 397 aa, Oryza sativa
MRMAAPQQVHVRAAPLARALRTRVAAAAASASSPERALLGLSEPDLRQLAVDLGQQSYRGKQLHDLLYKSRAKQIQEFSHVPKVFREALVGAGWKVGRSPVHHAVTASDGTTKILLKLEDNRLIETVGIPVDDDKGPSRLTACVSSQVGCPLRCSFCATGKGGFARNLHAHEIVEQVLAIEETFQHRVTNVVFMGMGEPMLNLKSVLEAHRCLNKELKIGQRMITISTVGVPSTIKKLASHKLQSTLAVSLHAPNQKLRETIVPSAKSYPLEALMDDCKNYFLETGRRVSFEYTLLAGINDAKEHAEELAELLHTCGGGYHVNLIPYNPIQGSEYKRPYRKVVQAFVDALEARKITVSVRQTRGLDANAACGQLRNEFQKNPLLESSPSSEPNLVPA

SEQ ID NO: 580 - protein, 590 aa, Oryza sativa
MASAAAHAATATAAAVLLVVFLAPLAAASDSDHKYQSEEKVMLWVNKVGPYNNPQETYNYYSLPFCHPSNNPVHKWGGLGEVLGGNELIDSQIDIKFGRDVDKGTICSIELDPDKAKQLSDAIESSYWFEFFIDDLPLWGFVGEADRNSDNKYFLFTHKNIVIRYNGNQIIHVNLTQESPKLIDAGKALDMTYSVKWEPTNVTFAHRFDVYLDYPFFEHQIHWFSIFNSFMMVIFLTGLVSMILMRTLRNDYAKYARDDDDLETLERDVSEESGWKLVHGDVFRPPRSLALLSALVGVGTQLSALILLVILLAIIGMLYIGRGAIVTTFIVCYALTSFISGYVSGALYSRHGGKNWIKAMIMTASLFPFMCFGIGLVLNTIAIFYRSLAAIPFGTMVVVFILWAFISFPLALLGTVVGRNWSGAPNNPCRVKTIPRPIPEKKWYLTPSVIALMGGLLPFGSIFIEMYFVFTSFWNYKVYYVYGFMLLVFLILIIVTICVTIVGTYFLLNAENYHWQWTSFFSAASTAVYVYLYSVYYYHVKTKMSGFFQTSFYFGYTLMFCLGLGTLCGAVGYLGSTLFVRRIYRNIKCD

SEQ ID NO: 581 - protein, 237 aa, Oryza sativa
MAAAGSIGVYRAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGDLSERKSSFVIIGRIIFSILGAMMAAVVIYTVITDGLPFRKDLLTPWMAATLIDFYINVFAISVWVAHKESNWISTAIWICLLICFGSITTCGYIVIQLFQVSYRDPIYHVLLNSHNKKI

SEQ ID NO: 582 - protein, 360 aa, Oryza sativa
MALLLLRRGGGFAAATVLAVVVVALVLSCGGGAEAAVRDLRVGYYAETCPDAEAVVRDTMARARAHEARSVASVMRLQFHDCFVNGCDGSVLMDATPTMAGEKEALSNINSLRSFDVVDEIKEALEERCPGVVSCADIIVMAARDAVALTGGPFWDVRLGREDSLTASQEDSDNIMPSPRANATTLIKLFAGYNLTVTDLVALSGSHSIGEARCFSIVFRLYNQSGSGRPDPNMDPAYRAGLDSLCPRGGDENVTGGMDATPLVFDNQYFKDLVRLRGFLNSDQTLFSDNAGTRLAVRKFGEDQGAFFRAFVEGMIKMGELQNPRKGEIRRNCRVANAPAPPPVEAEVAATSKAVVLVDF

SEQ ID NO: 583 - protein, 718 aa, Oryza sativa
MDITEVTVVHHAALVLLALWAAVSAGWAHPAIFLAALLYLFAVNERYTMRLRKRIQHEERKCANQRRLLSDAETVRWLNYAVEKIWPVCMERVASEQFLLPIFPWFLEKFKPWTARKAVIQDLYLGRNPPMFTDIRVVRQSTDDDHLVLEIGMNFLSADDMNATMAVQLRKRLGFGITANMHITGMHVEGKVLVGVRFLRQWPYIGRVRVCFVEPPYFQMTVKPLFGHGLDVTELPGISGWLDRMLDVAFGQTLVEPNMLVIDLEKFASESTDSWFSVDEKPPIAHAKVEILEGADMKPSDPNGLADPYVKGHLGPYRFQTKIHKKTLNPKWMEEFKIPVTSWAALNLLSLQVRDKDPIFDDTLGDCSISINKLRGGQRHDIWIALKNIKTGRIHIAVTVLEDENEKVPNDDDEQCGTPKGGKASTPRSSFSSRTNNESESSEEFRKISAEYEPVDIEGLEKVDVWVHRPGSDVAVTWEPRKGRARCQDSRILRENDVYCDSPKSCQSESQRSDSSTEEPANGKSRHHLHKVKKGLGKLAGAMFKSPKKESDDEASPCVTPHPNIKPLGEKRVSVRYVVDEDPSENLPDDQHSSPERGESESPTKRHLRKKAVHMVKHAGNKTAHNLKNMFSRKGSDKSKEGQDDQKDDPDTIVVEPSKVKKDNPDASEVDIDPSQVENDIPDSTAIDPLKVDSNVANNIVVDALEYASESDAKDKPQ

SEQ ID NO: 584 - protein, 181 aa, Oryza sativa
MALPLLKSSPHFSALHSANRAQLHGRCRATLGGFHDPRSNSSRCKKSAGRGSVKANASPLDVVTLMVTMVEHVDLQRDYVVHKSIWHLSDAALKSVYTFYAFFTVWGICFFASMKDPFYDSEAYRGQGGDGTVHWYYDRQEDLEASAREELLREELLEEIEQRVGGLRELEEAAKEEQLTN

SEQ ID NO: 585 - protein, 929 aa, Oryza sativa
MLVRLGVVVVASVAALTLKRANSGNRDGQARKGKDKTRYSEHGEKEEEKEEVKTISGIINSALSDDDDMLSEIESLLSGEIDIPLPSDRFDVKERSRYNSVNSELERLRGLVRELEEREVKLEGELLEYYGLKEQETDVVELHRQLKIKMVEIDMLKMTINSLQEERKKLQDDVARGTGAKRELEAARNKIKELQRQIQMEANQTKGQLLLLKNQVIALKSKEEEAAIKDAEVQRKLKKLKELEVEVVELRRKNKELLYEKRDLIVKLDAAQGKITESDVVSHAREEINKLRHANEDLTKQVEGLQMNRFSEVEELVYLRWVNACLRYELRNYQAPSEKISARDLNKTLSPKSRERAKLLMLEYAGSERGQGDTDLETASSAPSSPRSEDFDNVSVDSSSSRYSFFGKRPNLMQKLKKWGRGKDDGSSLASPTQSFTSDSPKSASQKPKGPLEALMLRNAGDGMGITTFGKREQDPSDIMDEANVASSFHLMSKTVQGFADDKYPAYKDRHKLATEREKAIKEKAEKARVQRYGGVNSSGIVPSPRSALPPKLAQIKEKAPTANAESSDQPSDNQNNPLVVTQLKLANIEKRAPRVPRPPPAPSATANTASALPPPPPRPPGAPPPPPPPGKPGGPPPPPPRPGSLPRNLAGGDKVHRAPEVVEFYQSLMKREAKKDTTSLGSTTSSVSDVRSNMIGEIENRSTFLLAVKVDVETQGDFVESLANEVRAASFVNIDDVVAFVNWLDEELSFLVDERAVLKHFDWPESKTDALREAAFEYQDLLKLEHKVSSFTDDPKLACEEALKKMYSLLETVEQSVYALLRTRDMAISRYREYGIPVDWLSDSGVVGKIKLASVQLAKKYMNRVATELDALQGTEKEPNREFLLLQGVRFAFRVHQFAGGFDEESMKAFEELRSKMCTTQTSAPQIS

SEQ ID NO: 586 - protein, 290 aa, Oryza sativa
MARAFRAASPLPLPSSSSRAAAASGGTGGGGGGNFPWLSRKRLGAKPPSPQRRGGQEREGGGDEAAGMGTTTRAARFSATSSAEPAEVQSSSSSRKRADALARLRAAFLAAITHRRRRRQLGSSLTGTIFGRRRGRVHVALQTDTRSPPVLLVEMAAYSTGALVREMSSGLVRLALECEKQPINPGEKRRALLEEPTWRAYCNGRKCGFAVRRECGADEWRVLGAVEPVSVGAGVLPDDAAAAAAAEEGDLMYMRARFERVVGSRDSEAFYMMNPDGSGGPELSIYLLRV

SEQ ID NO: 587 - protein, 518 aa, Oryza sativa
MEKERKQGFFAALKEEVVRGLSPARSRGKSPARSASPGRMLIPRRRKEKQQQPPPEKLLQQYFAEPLISRSGSLRPGGEALAPLIEGPDPERLAAGGDFAGGEESARREGFGRWVRGQLARTPSVASSAAAAAAASPGGSGDSFRRSDLRLLLGVMGAPLAPIPSKLADPLPLLSIKGTPIESSSAQYILQQYMAASGGYRLLQSVRNAYAMGKVRMVASEFETATRVVKNRGPSGRGAASVEQGGFVLWQMAPDMWYVELAVGGSKVHAGSNGRLVWRHTPWLGAHAAKGPVRPLRRVLQGLDPLTTAGLFAEARCVGEKKVNGEDCFILKLSADPQTLKQRSEGPAEIIRHVLFGYFSQRTGLIVHIEDSHLTRIQPHSGGDAVYWETTISSALEDYRPVEGIMIAHAGRSAVTLFRFGEAAMSHTKTRMEEAWSIEEVAFNVPGLSVDCFIPPADIRSGPVGESCELPPPAAAPHGERARHPARVAAVDRAPPHHNAGGANVGRRGDKIMWRVEV

SEQ ID NO: 588 - protein, 259 aa, Oryza sativa
MAPKRGAKAPVPARKKAAAAAVNPLFEKRPKQFGIGGALPPRKDLHRFVRWPKAVRIQRQRRVLKQRLKVPPALNQFTRTLDKNLATNLFKMLLKYRPEDKAAKKERLLKRAQAEAEGKTVEAKKPIVVKYGLDHVTYLIEQSKAQLVVIAHDVDPIELVVWLPALCRKMEIPYCIVKGKARLGSIVHKKTASVLCLTTVKNEDKLEFSKILEAIKSNFNDKFDEVRKKWGGGIMGSKSQAKTKAREKLLAKEAAQRMT

SEQ ID NO: 589 - protein, 774 aa, Oryza sativa
MMQRPFRPEEYSLKETSPHLGGGAAGDKLTTTYDLVEQMQYLYVRVVKAKDLPSKDITGSCDPYVEVKLGNYKGTTRHFEKKTNPEWNQVFAFSKERIQSSVVEIIVKDKDFVKDDFIGRVLFDLNEVPKRVPPDSPLAPQWYRLEERNGHKVKGELMLAVWMGTQADEAFPEAWHSDAASIPGDGLASIRSKVYLTPKLWYLRVNVIEAQDLIPNDRTRFPDVYVKAMLGNQALRTRVSPSRTLNPMWNEDLMFVAAEPFEEHLILSVEDRIAPGKDDVLGRTIISLQHVPRRLDHKLLNSQWYNLEKHVIVDGEQKKETKFSSRIHLRICLEGGYHVLDESTHYSSDLRPTAKQLWKHSIGILELGILTAQGLLPMKTKDGRGTTDAYCVAKYGQKWVRTRTIIDSFTPKWNEQYTWEVYDPCTVITIGVFDNCHLNGGEKANGARDTRIGKVRIRLSTLETDRVYTHAYPLIVLTPAGVKKMGEVQLAVRFTCSSLLNMMHLYSQPLLPKMHYVHPLSVMQVDNLRRQATNIVSTRLSRAEPPLRKEIVEYMLDVDSHMWSMRKSKANFFRIMGVLSPLIAVAKWFDQICHWRNPLTTILIHILFVILVLYPELILPTIFLYLFLIGVWYYRWRPRQPPHMDTRLSHAESAHPDELDEEFDTFPTSRPPDIVRMRYDRLRSVAGRIQTVVGDLATQGERLQSLLSWRDPRATALFVTFCFVAAIVLYVTPFRVVVFLAGLYTLRHPRFRHKMPSVPLNFFRRLPARTDSML

SEQ ID NO: 590 - protein, 111 aa, Oryza sativa
MAGLQRSSETFRRSGSSGLVWDDRHLSGEIKPADGGGGGAAARVERSRSAGHGGYRAAGRVQPALDPPSPRVAVCGFCRFFGGSGKGGRSGGGAAAAVAGGKAKARRHSSS

SEQ ID NO: 591 - protein, 362 aa, Sorghum bicolor
MAGGAHQQVVVVLAMVALMVTAAEGFISKKTWSAIRRADRDGPFVGLVVPNTYEMDPVLSSPDFKPSNNIPILDVQGRRFRFGTIGSQNVVMVMTGLSMLNAGLTTQLLLSLFRVKGIVHWGIAGNANEDLQIGDVTIPESWAHLSLWNWQRHGDGAENELPLESAGDYTREYGFLNFSDYTVGQANPELSANTLNSVWYQPEEIFPISGTPEERQHAFWVPVSKRYYRLAAKLEGMELPACVNETTCLPRAPRVTRVPRGCSANIYTDNASYRQFIRAHFGCTPVEMESAAVALVAHQHGVPFITIRSLSDLAGGGSSLSNEAATFLDIAAKNAVDVMLKFVPLLGRGGEQEQADGLAQDM

SEQ ID NO: 592 - protein, 435 aa, Sorghum bicolor
MEDPPALAPPEPEPEPEPEASPAPPQRLLRLRCAVQHYEWGQHGAASLVARLADQNPDPARPYAELWMGTHPSGPSTLLGDGALLRDWLARNPDALGPAVAARWGGDLPFLFKVLSVAKALSIQAHPDKKLAEVLHALRPSTYKDDNHKPEMAIAFTEFRALCGFAPIEELKDVLRTVPEIEGLIGHEDTGKLMNMKEYDGVSEVKSSLRSAFAKLMTASKDMVSEAVAKLISRLNTDSKIRNLTDKEQLVLSLERQYQDDVGVLAALFFNYVKLSPGEALYIGPNEPHAYLSGECIEIMATSDNVVRAGLTPKYRDVQTLCSMLTYKQAFPEILRGVPVQPHVRRYTPPFNEFEVDCCLVPPGELLVISPVPGPSVFLVMTGEGEIQLDSMSGGEKAKEGDVFFVPAYTEVKISACGPESVLLYRAGVNSRFFS

SEQ ID NO: 593 - protein, 547 aa, Sorghum bicolor
MAAKKQLPQAVAAASGHTKMGEEKLIIRSEKVRFIDVLSMLFLRRPITSYAFVEAGDRTAADFGSTPGDWLVALTQLIQKALDAAYYPALVIGAVVEFLLNFVALNNGILGIFLNIFRCKLVIPHRDAPNFRSMIGLIDGRTELKPLPAGGGPEDRRLQVVGVSAAGSDDYYVDVESGGGGGSSTGTAAVPLVQQQYVNGRLIRLRTFSVFEVSMMAAKIAYENAAYIENVVNNVWKFHFVGFYNCWNKFVGDHTTQAFVFTDKANDASVIVVSFRGTEPFNMRDWSTDVNLSWLGMGVLGHVHVGFLKALGLQEEDGKDAAKAFPKAAPNAVAGKPLAYYTLREELRAQLKKHPNANVVITGHSLGGALAAIFPALLAFHGERDILDRLLSVVTYGQPRVGDKVFAAYVRGNVPVEPLRVVYRYDVVPRVPFDAPPVAEFAHGGTCVYFDGWYKGREIANGGDAPNPNYFNPRYLLSMYGNAWGDLFKGAFLWTKEGKDYREGAVSLLYRATGLLVPGIASHSPRDYVNAVRLGSVVVAGKEEEVV

SEQ ID NO: 594 - protein, 100 aa, Sorghum bicolor
DVAYDRSTAPKDCLVSGWYEETPGETQLGHAAKMALVEFTYDLEKNNVQTFDVSAPDVGVINMIRLDFNSNHGSSQLTCIYRLRVHGHEPVSPGTAGSQA

SEQ ID NO: 595 - protein, 93 aa, Sorghum bicolor
MAAVVEVTFDAQKHINVSKGSIVGEDGGIGYLVYPMPPAGTFDLSTDKELLKNINQELVGCKGGDNARAGSPKTLRKAREKAVRRAFLAYLGQ

SEQ ID NO: 596 - protein, 83 aa, Unknown
  Sequence found in Organisms: Sorghum bicolor, Saccharum officinarum
MAGKGGPTNLEKEQMFGMAEKEMEYRVDLFNRLTQTCFDKCIEKRYKEAELNMGENSCIDRCVSKYWQVTNLVGQMLGNRPQM

SEQ ID NO: 597 - protein, 205 aa, Sorghum bicolor
MPSPTPPPMSTPHKSCSSPSPPPPKLQRAPDIRHRPICRAGGGACRLPITRRAHAASLLLLGLAPAPAPVRAEEDGSGGEEGVLGAIKSIFDPNEKTKAGKTLPKAYLKAAREVVRTLRESLEEDDGGDMARFRRNADAAKESIREFLGGWRGQQTVAAEESYVALEKAIRSLAEFYSKAGPFAPLPQDVKNKILDDLSAADACL

SEQ ID NO: 598 - protein, 400 aa, Sorghum bicolor
MAANGKSSLANGASSTQGKPINCKAAVAWAPGEPLVMEEVEVAPPGRLEVRVRVLFTSVCHTDLSFLKGENELQRKFPRILGHEAAGVVESVGEGVQDLAPGDHVVPIFNGECGACAYCESDKTNLCGTYRVNPFKSTMSSDGGTRFSVVDRNSGLRQPVYHFLNTSTFAEYTVLDAACAVKINPKAPLHKMCLLSCGISTGVGAAWNTANISAGNTIAIFGLGAVGLAVAEGAKLRGAARIIGVDVNPEKFAKGKEMGVTDFVNSKACDKPVHEVIREMTDGAGVDYSFECTGINDVLREAFLSTHDGWGLTVVLGIHATPKMMPLHPMELFDGRRITGCVFGDVKGKSQLPAIVDKYVNGDLNINFDGFITHNMPFSDISKAIQLLEEGKSLRCVLHL

SEQ ID NO: 599 - protein, 418 aa, Sorghum bicolor
MTYTSSLHLPKHLLLPSPRRTRHRSPSSFVPVSAAANKINGGVHGHHAPEKPALPNGKAPQHINGHGNGHGKKGVNGHVNGRHAGNNRIHLSVSTGGGGGQDGSGLRVAFQGAPGAYSEFAAKTALPGCETVPCRAFADALAAVERGAADRAVLPVESTMEGTALRNYDLLLRHGLVVVQEINLFVHYCLLAMPGVRAAEVRRVISHPMALAHCGRALARLGVDPEPVEDTAGAVEMLRSGRMLDTAAIASPRAADLYGLDVLAHGLQDESWNVTRFLLLSRPSAVAALPVDAAAGGATKTSMVVAHRGGSMMVVLKVLSAFSSRGINLTKLEVINNDGAAAADAGSGAGARPPVVILDTSARGKPTLRAFPHVLYVDCEGAAHDPRVHEAIQEIETFAVFVRVLGCYAADSTVYDLQ

SEQ ID NO: 600 - protein, 618 aa, Sorghum bicolor
MAATAASSAAADAASNSDEEANYEEYIPVAKRRAMEAERLRQLRLNKSAPTSAASTLPLPPPPPLLPAQASVPDAAAKPSLLVKATQLKRAAPEVTATEQRIQQEKEVIENLSDNKSLRSVREIAKGIIYTDSIQTGWKPPLRLRRMPLAKANELRRKWHIIVDGDDVPPPARDFRDLRLPEPMLRKLRERGIVQPTPIQVQGLPVVLSGRDMIGIAFTGSGKTLVFVLPLIMVAVQEEILMPIVPGEGPFGMIICPSRELAKQTYDVIEQFLIPLKEAGYPEIRPLLCIGGVDMRTQLDVLKKGVHIVVATPGRLKDLLAKKKMNLDNCRYLTLDEADRLVDLGFEDDIKEVFDHFKDQRQTLLFSATMPQKIQNFAKNALVKPVTVNVGRAGAANLDVIQEVEYVKEDARIIYLLECLQKTPPPVLIFCENKADVDYIHEYLLLKGVEAVAIHGGKDQEERQNAIDSFKTGRKDVLVATDVASKGLDFPDIQHVINYDMPAEIENYVHRIGRTGRCGKTGIATTFINKNQTETTLLDLKHLLKEAKQRIPPVLAELNDPLEDEEIIAKESGVKGCAYCGGLGHRVSDCPKLEHQKSMAIAGSRKDYFGGGGYRGEI

SEQ ID NO: 601 - protein, 871 aa, Sorghum bicolor
MAASAGKLAAALHRRTRRVTSALAYAALEWVLIALLLINGVLAYAIARFADYFGLSPPCLLCSRVDRLFLQAEGGDAEAGAARWLRDALCGDHAAEISALGYCLRHHRLAEAGEMCDGCRSEWKEKTSDAAGACTCCKAVVRTSLREQEDTITRDQHVLEKITEEVEDDDQGYVLLAQDDHEEDEEEPDEVESQEQEQQSEVEGQQQEDEVMASVQDESLEFMDQVEDITAIGDDRLVSVVALDEMTIADDSGLHRDVEEEDGVNRVVEDEQDSRDVDIGVVLEEKRMLDSSVATPADVIEDSVMPISPVPCPEILTNPSHPDHNSISQDDGDVPEDTAEIGDSTAEEEHIFVPQEANFEDDNRTAEVDTNCEVSIGSDICEREQDDHVVPFQDLAALEEPVSPLSAADDLPLPLEILDPTEQEEAGEVEQEEVTTSTGLDLQPNEQSEIEEDKAPETPTNSAATQRSDRMFLLERKRSLSLSLDGSVASEMEGGEPSTVDQLKSALQAERKALGALYAELEEERNAAAIATNQTMAMINRLQEEKAAMQMEALQYQRMMEEQSEYDQEALQLLNELVTKREREKQELERELELYRQKVQHYEDRERRRTASFKANGVSVSPSGNGTSVSSSGEESDGHSDDYCELGESPDVGNVQSSSDAALGSMRDQEGTKHLAALDDSLTYFEMERLSILEELKTLEERLFTLEDDDTNTGKQAIGHSSIDFDLSAGGLQSPDYILSGDKARIGGRASISRGKSLLPLFDAVGDETCDQMPSAGVGEADQDDDSATKPVSVLVKEQERLAIIEEVDHVYERLQALEADKEFLRHCIKSLKKGDKGMDLLQEILQHLRDLRNVELHVKNAGDAIAANSA

SEQ ID NO: 602 - protein, 622 aa, Sorghum bicolor
MDGEEEREEGEVGEYKLQRVVGKGSFAEVHRAAHRRTGARVAVKAIDRRRVDKRVHDGILQEREILRSIDHPNILRLLDTIDTKKMMSLVREYCDGGDLDGFLHKHARLPEAIPKDLMRQLAEGLKVLRGRNIVHRDLKPQNLLLSTNGDAIVLKIGDFGFARSLVHENLAATMCGSPYYMAPEIWQGKDYDAKSDLWSVGVILFQLVTGKLPFTGSNAFQLHQNILAADDLNFPSEIEADLCADCIDLCRRLLQRDPKERISFEEFFNHKFLATRKCDESCQAIELRNNCQTITSPVVLKTKSESIESKNSKVFDSWEWIEREYVLVPVNCTSMEMSSLNINKSTKDDTDIRTASYDRPAAKGSAQNQIRDLTDTATGIQSHGCAPVLISQESATVDCRRGKLPDYITRFHSLNQYVLVLTELAREKLSKGLYLEALSIELVLLAIWKEALDACSLLMDASDGENFSKSSQEHSLPMSGHSPLNVVRGLDFTRTASVFSWVESGFMKAYDRAEKISHVLRKSDDNTEMPDAMDVVFQTALEYGKTGAANEVLGHQSRSTALYSKSIILLTFLVQEAPMLPLNPPLSLSPSDQQRIHRYIANLKSHLCCAQVAGQQQRSVYN

SEQ ID NO: 603 - protein, 303 aa, Sorghum bicolor
MNNLLTDSFELPRRDSSRDADIEMGMHQADASDNLKDFLKKVDAIESLIAKLTNLLNKLQTANEESKAVTKASSMKAIKQRMEKDIDEVGKIARQAKTKVDELEKDNLLNRQKPGCGKGSAVDRSREQTTGAVKKKLKERMDDFQTLREAIRQEYREVVERRVFTVTGNRPDEETIDDLIETGKSEQIFKDAIQHQGRGQILDTVAEIQERHDAVRDLERKLLELQQIFMDMAVLVEAQGDMINNIETHVSNATNHIQQGVTALQSAKKLQKNSRKWMCYAIILLLVIVVVIVVAVIQPWKKG

SEQ ID NO: 604 - protein, 555 aa, Sorghum bicolor
MASAAARGAAARSPLLVHHHHHRRRGLPLVHPGGGGGGSLRVGGPGIEPRREGRRRARVGVRVFARYSQAQDFSTRLQDRVGELPKLVEDLLQTSISTGPRGAFRMAQGIQAVLGVGGEWLNDLSKTANTAAGIPSQMQLGLLSPVYLRRLFERMGATYIKLGQFVASAPTLFPAEYVEEFQKCFDQAPAVPYDVIESILREELQRPLDSVYEYIDPVPIASASIAQVHGARLKSSQKDVVIKVLKPGIEDTLVADLNFIYVVARVLEFLNPELQRTSLVGIVKDIKESMLEEVDFRKEAANIQAFQGYLDAMGFDRQAKAPFVYQHCSTKRVLTMERLYGVPLTDLDSIRSLVPDPELTLVTALNVWFGSLISCESFHADVHAGNLWLLRDGRIGFIDFGIVGRISPRTWAAMEVFLASFATEDYDAMASALSEMGATGNDININEFAKDLQKIFSSIQDLDTEIIVATARTPDATAVSANVVLDERQMNALFLDLVRVSESYGLKFPREFALLMKQLLYFDRYTRLLAPSMNMLRDERINISTNRQLRRTDRF

SEQ ID NO: 605 - protein, 366 aa, Sorghum bicolor
MEPALRELWAESRDLLGLPSSSLDAAAAAAVPRVDLPPTPLAFLRDHVSPGRPLLVSAAATRHWPAVSLWPTASYLTDALRSTAVSLHLTPDGRADALASHPRRPGGPGPSRCFASAHVRRVDFPTAVRLIRASDPAAGLVAYAQQQDDCLRGEYAAVAGDVDAHVPWASEALGCLPEAVNLWIGNAHSVTSFHKDHYDNIYVVVSGEKHFLLLPPTEHHRLYVREYPAARYVAAEQDSEGEHQLRLKLEMEEPERIVPWSSVDPCPASPEEMAVQASSFPLYFDGPAPMRCTVRAGEMLYLPSMWFHHVSQSPGSNGLTIAVNYWYDMQFDIKYAYFNFLRSLDIDGCSSGKAGALEGDLEEKKD

SEQ ID NO: 606 - protein, 652 aa, Sorghum bicolor
MDSGGGEVGSTGGRFPILQANRDPESNWELDVAKSLEEYLLKICSGEVSGEDGAHSVNFAEAALLLQGSVQVYSRKVEYLYSLVLHVLEFLSQKKQDQLENGLVQANQNDPSMIPSEEDDIFMGLDDVPVETRTSLDNNVNRDDLQRKNVRPPANLLVFEGDCLDSEASELDTYLLATCDFYGDFLLLDPCDAPAIFDFLQGKHSGKENSVAHPGSSAPSKSRANVFSSPNLRSAGTGRKSAAGKVLGGLDPTQENPDQSTQGTSPDNNHWSDPVEPSFADDVEMPNPDYIEDPVGDYSDDEDPWKPLNPHEPGNLKIRPYRRVKGSPRGVIGTQKKKTLTFLFPMAKMDGVVIPEHAKSFEAQQCQQEEHYEKFLRSFEFGEENPNVFGDLKDDNGSNTGINFDDDDPDMPNDIDVDPDVPAYPDEPIAATPNGTQDDIDTHASLDDLCRSHLNALLASIAEVEKQSEMDARVSTWKERIEDALEEQDKNPPFDIGSYGEQILDTLSSRTDNTGTASFSEIVSGRPKYEVARTFSALLQLVNGRSVDLDKGQATNELVCYTAENPFHVRLIGPNRRPEMEARFARKRVKSPLQNTGKSGGSSLAQHECSKKPLHKNGKIPVKTAIRLTPDGKRRRRSATHLMQPINLEYSG

SEQ ID NO: 607 - protein, 131 aa, Sorghum bicolor
MRLLTHNMLASNVRGATTGYPLTLEATKWCTKEVELNADFIRGLLPKIDWRALVDATRALGLPELLPEEQPPEEEIFAEGAADVEGSAIRRIHHALLEVHVQEGSLVCPDTSRCFPINKGIPNMMLHEDEV

SEQ ID NO: 608 - protein, 352 aa, Sorghum bicolor
MATTASSLLKSSFAGARLPASTRTPSSPAVVATPRGAGAIRASSISSSNPPYDLTSFRFSPIKESVVSREMTRRYMTDMITYADTDVVIVGAGSAGLSCAYELSKDPSVSIAIVEQSVSPGGGAWLGGQLFSAMVVRKPAHLFLDELGVAYDEAEDYVVIKHAALFTSTVMSRLLARPNVKLFNAVAVEDLIVKGGRVGGVVTNWALVSMNHDTQSCMDPNVMEAKVVVSSCGHDGPFGATGVKRLQDIGMISDVPGMKALDMNTAEDEIVRLTREVVPGMIVTGMEVAEIDGAPRMGPTFGAMMISGQKAAHLALKALGRPNAVDGTIKVVSPALRQEFVIASKDDEVVDA

SEQ ID NO: 609 - protein, 359 aa, Sorghum bicolor
MGRRGSSDRLEALSLEIERKLQKALVSNSQRLQILQQLFADIALKVDDRARDAIMSENDDGIAPVDEREDGWLCFYEILSSHFVRVPESGRRILELIVQLWSQSFASNIFALLFHKWLFEAPLDEKEISLRYSSALVQGATNVFWIDIQTNTRHFLSLYHYLLEDVALVPDRLTKISLQAGRDLFLLLSRFMFFYDQDHLLSSFLEHFPTFPNSFLVGGPADYFVIELTDQLQKLKIEPVLLHYLSRMSILQGLELRLSTSTRLKACLYSFTSPGGPTYPTRAVRHAAWNTLDLLFPIGRYPRHVISLFFRLLYPWYWPSSCWNFVMTCAMTVYYYILNLLVSSWEKLRRPSHQRRHGE

SEQ ID NO: 610 - protein, 354 aa, Sorghum bicolor
MGEADASAGGSGAGGDPQRLKRIAAAAYDYENDARWAGYWSNVLVPPHLASRPDVVDHFKRKFYQRYIDPGLVVEPMSSMTSTQSSRPAARSSATPSGENVRSRDSASSTRSTGASQQPSAERTANSLRLDGRTIHFSINAWVLVVASVGILPVLPNHISSKAYRLSLLGTICSSAYSLYSTYGKPRAWNMPAIQSWLQSIIVAKDFVHLMFSLMMFTSNVHFKIALLPVLCWALDHVARFLRRNFTHSSLYRKYLEDPCLWVETNNTTLSLLCSNAEITLGFLMIISLFSSRRNIIQTFMYFHLLKLMYHSPVTSGYHQSVWARIGRAVNPYIYRYAPFLNTPILAVQRWWLR

SEQ ID NO: 611 - protein, 239 aa, Sorghum bicolor
MESRKPAPSPLVDNYVVPGDVVLDLSEMNNQTIKLGAGLRQECDTIQATSAGKLRLLKPNKYWIENSQKRYIPSVEDTVLGIVVDTKPDNFLVDIKGPNLAFLPVLAFEGGTRRNIPKFEIGTLIYARVVKANSIMNPELSCMDASGKAAEFGQLKDGYMFDTSTGMSRMLLSSPTCPVLEALGKKLSFEIAVGLNGRVWVNAPAASTVILVSNAIMRSESLSGIKQRAMVENLLERLS

SEQ ID NO: 612 - protein, 506 aa, Sorghum bicolor
MGKGAVVGTAVVVGAAAAAAVGVAVVSLSRRRRRRREAEDERKRKAAAVIEEVEQRFSTPTALLRGIADAMVEEMERGLRAEPHAPLKMLISYVDNLPTGDEQGLFYALDLGGTNFRVIRVQLGGRDKRVVKQQYEEVSIPPHLMVGTSTELFDFIAAELEKFVRTEGEDFHLPNGKQRELGFTFSFPVHQTSISSGTLIKWTKGFSINGTVGEDVVAELSRAMERQGLDMKVAALVNDTVGTLAGGRYADNDVVTAVILGTGTNAAYVEHANAIPKWTGLLPRSGNMVINMEWGNFRSDKLPMSEYDKSLDFESLNPGEQIYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLSDFSQQRTVVAIDGGLYEHYKKFSACLEATLTDLLGEEVASSVVVKLANDGSGIGAALLAASHSQYAEVA

SEQ ID NO: 613 - protein, 398 aa, Sorghum bicolor
MEPDSARKRLALLALLLLLAAPARPASAAPVEDGLLSNGDFETAPAGGFVKSASVAEGASSIPGWTINGTVELISAGQHQGGMILIVPQGDHAVRLGNDASVGQVVDVEKGSEYAITFSAARTCAQLESLNVSVLGGISQTVDLQTLYNIEGWDAYALAFQATEEQAHLQFMNPGMEDDPTCGPILDNVAVKKLFTPDKPKDNVVLNGDFEEGPWMFPNTSFGVLLPTNLDEQTSAIPGWMIESNRAVRYIDSDEYKVPQGKRAIELLSGKEGIISQMVETTPQKVYSLTFTLGTAGDSCQPPMAIMAFAGDQAQNFHYSPIGNATSQAANVTFTARAERTRVAFYSVYYNTRSDDHSSLCGPVIDDVRVWGLNAAAGLKASIGLVLGIVGLAGMVLF

SEQ ID NO: 614 - protein, 368 aa, Sorghum bicolor
MAAAAHEVSAVIFDLDGTLLDTERATRDVLNEFLAAYGKVPDAQKEEKRLGQMYLESTTGIIRDYGLPLTVEEYSKAMHPLYLRRWQKAKPLPGVKRLVKHLHKNGVPLAIASNSVRRNIDHKLPKLEDWGECFSVILGGDQVPNGKPSPDIFLEAAKRLGVNPSSCLVIEDSVVGVKGAKASGAKAVAVPSLQSQRKHYYIADVIIYSLLDFDPELWALPPFEDRIQGVLPIDPLLSNARIGDKIVNNLHWVISDDCTYECIPDQISGIYLGWAESKVHGLSKVIIGTGWDFSQQTVERVMQVDFLDSSGRIETEPVKLLVIGYIRKLQSADDILQALSITDEDRSIAREALDLPTFSEYANDLHLA

SEQ ID NO: 615 - protein, 325 aa, Sorghum bicolor
MAAAGDAGGLLVCVTGASGFIGSWLVRCLLDRGYTVHATVKNLQDEGETKHLQAMGGADARLRLFQMDLVDPASVQPAIEGAHGVFHLASPMILQAEDPEKELLEPAVKGTLNVLRAAKDCGVGRVVLMSSQAAMVPNPNWPPGKVIDDDCWADVELLKKLQLWYSVSKTLAEKAAWDFAEKEELQIAVLNPGMVLGPMLTPSVNASLRLLLQILGGERIDLDDIYMGCVDVRDVAHSLIMLYENPSAQGRHLCMESAERLVDLANKIADLYPEHPVQRIREDKQGWVVRAKDPSKKLIKLGVRFTPLDKTIRDTVDCFRSKGLI

SEQ ID NO: 616 - protein, 349 aa, Sorghum bicolor
MCEAPRLGYRAAGAGDADAADVDVVTTGGRRRIPAHSSVLASASPVLGSILERRLQKDRESGKPGRSVVRIRGVTDDAAAAFVRLLYAGRCGDGGEEEEEDDAMEKHAVQVLVLAHAYQVPWLKRACEGAIGARLTADSVVDVLQLADLCDAPRLHLRCTRLLAKEFAAVERTEAWRFLQENDPWQELHVLQRLHEADMRRRKWRRKRAEQRVYVELSEAMDCLDHICTEGCTEVGPARRAPAPAPCARYATCRGLQLLIRHFSQCHRKSCARCQRMWQLLRLHSALCDRPDRCNTPLCMRFKQKEQEKVAAKAGDDDDKWGLLVKKVKAARVFSSLANRKQTSTSTQC

SEQ ID NO: 617 - protein, 345 aa, Sorghum bicolor
MGSLPVPASAECAPQGRATVSASDLAPLFSAQRRHLDHFFDSLDMSQAAAFAQALIDAPGAVFFTGVGKSGIVACKIAQTLASLGFARAGFLAPVDALHGDIGALFPGDVLVLISKSGASDELLALAPCARAKGAYLISLTSAASGAECPLAAACDLNVHLPLQGEVCPFGLAPVTSTAIQMVFGDTVIAAIMEARRLSRDQYASNHPAGKIGKTLIFKVKDVMKKQNELPLCKEGDMIMEQLTELTSKGCGCLLVVDEEHHLIGTFTDGDLRRTLKASGPAIFSLTVGEMCNRNPRTITAEAMAVEAMEKMESPPSPVQFLPVINDNNIVCGIITLHGLVSAGL

SEQ ID NO: 618 - protein, 467 aa, Sorghum bicolor
MAAPTAAPLDEGKAKKVLRQVEFYFSDSNLPRDKFLRETVEQSDDGLVSLPLICSFSRMKSHLGLDADVKAETLPEETVLAVAEVLRRSPVLRVSEDGKKIGRASELLKPDEIIEQVDSRTIAVSPLPYNVKLEDVQSFFTNYAKVNSVRLPRNIVNKKHFCGTALVEFSEEEEAKSIMDSSLVFAGANLEIRPKKEFDAEQESKKEAYEKERPRKDNQDEGYPKGLIVAFKLKKTTVDSVVQQDNIDERNDSATKLEDSSSMEKLSGQVPESTLESDGTKQGKSSDEITKEKELNTAEATESEKCIGDAPVESEKHGDSESLSRDGKSISGNVNAKNQISREDLKEAFKKFGTVRYVDFSIGDDSGYLRFEDSKAAEKARMSAVLADEGGFIIKDHIVTLEPVTGEAEKDYWNRIRGIQGKYKDSRSYKGRALKNQRGGKHFNGKRDRNPDSEKNSNKAQKVEAAA

SEQ ID NO: 619 - protein, 332 aa, Sorghum bicolor
MAENTHGSGRCALGDLTNVLCKRPATSDLEKSTGGIKIRRIEKDTGTGKGFDENAKTSSRGKGIVFGHLFDGVAKENFERPSIFQNTRVQHMAAEAAGLLSKEASDLKNHYASIDSFDLSDKEQDSSLESEGDYDDEDNDEMNGELPHHFCTSELANKTSTNDDECLTQEEIVGSSGNQKPLSSLDAMAGGDMPSSSIQHASMRTGGLEEAVATKSCACSFCLKAAFMWMDLHYQDARSRLSVLKKNIKFARLLEERSRGSEYAANVAGYNSKRAVGMEFELSQQQRSLFLYTENALVRESTQLHSTFVKLKELRENCKTNLETISKSSMRK

SEQ ID NO: 620 - protein, 1265 aa, Sorghum bicolor
MLQGVANPVRSAGLRVPMETSEAAAAHPQKDSVKVAVNIRPLITAELQEGCTDCVTVTPGEPQVQIGPHVFTFDHVYGSSGPSSSLIFEQCVHPLIDALFSGYNATVLAYGQTGSGKTYTMGTDYSCEGNSGGIIPQVMDTIFRKVDTSKDGSEFLIRVSFIEIFKEDVFDLLDANQAAARPDAGSMAKASAPGRVPIQIRETATGGITLAGVTEAEVKSKEEMASYLTRGSSSRATASTNMNRQSSRSHAIFTICVEQKRISGTSDKSASSDYDIISSKFHLVDLAGSERAKRTGADGLRLKEGIHINKGLLALGNVISALGDEKKRKEGAFVPYRDSKLTRLLQDSLGGNSKTVMIACISPADINAEETINTLKYANRARNIQNKAVVNRDPATAEMQKLRSQLEQLQTELLFSRSGSAALEELQLLQKKVSLLELKNSELNNELKERELSCEQLAERARAAQLERDQLMLKIESARNGKSWDDIENADNDQDMDLLKGYISKVQQLESELMRQNFSNACRHGLNDQLAMERDILLNELGSGCEVGTPDASSEVDEEEKEREHSSMQDQLDKELQELDKRLQQKEEEMKQFAKSDTSVLKQHYEKKLNELEQEKKALQKEIENLRHALTNISSSTDDNAQKLKENYLQKLNALESQVHELKKKQEAQQQLLRQKQKSDEAAKRLQEDIHRIKSQKVQLQQKIKQESEQFRSWKAAREKEVLQLKKEGRRNEYEMHKLLALNQRQKMVLQRKTEEAAAATKRLKELLEAKKSSRETYGGANGSGMQALIRAIDDELEVTVRAHELRSYYERQMQERAAISKEIAKLKEESKHKMSDCPQAMSPSARSSRISALENMLSSSSSAMVSMASQLSEAEERERVFNGKGRWYHVRSLPEAKNIMNYLFQSASSARCQVLDKEVICNEKEHTISELKEKVVVLNSGMRQLETQLMDLRSQNTQLFTALNNAKKSARSNGTGFAQRKSVRSSQHFGCSKDNFINWVDDMDISDGEHSDELESMSDGSDSDWVQSNRKAKKHQRRVSSNSNHKLDCQNTQDNAEPEKPSDEKCILPKNLPSDGCSCSKSSSCKTNKCECRGSGAQCGAGCGCKDSKCSNRDSSSTKEKANQGAMLLQNAFSEKEAQDAKPRKPLANIGNNVVNQTAETEKKPRKNWRKSTVQLVPGPLLPSEPETTEAAPRDRADIPLKLPRAMSSGTPAESNPPPLTDRNAAKPHQSVSTGNKDSTGTAATRPPSQLRKNAATEKENQLR

SEQ ID NO: 621 - protein, 176 aa, Sorghum bicolor
MATTTLFLLLCAAAALASAAAAADDTGFTTFKLYFHDIVAGTSSPTAVRIAQAASSNTSSTSFGAVVAIDDPLTTGPTRSSGTEIGRAQGTYTFADQTTFGLLMVMNFVFTAGDHNGSTLSILGRNEVLTDVREMSIVGGSGKFRMAKGYVQAHTIDSGATTGETVVQYTVNVKTP

SEQ ID NO: 622 - protein, 532 aa, Sorghum bicolor
MAFRLQARPGFRDRSIQGLAHRGGRDPQELEALFGRVLSYIHHALPTPPVSVDGDLCILFDADGGGVDRLSRLPDKLLCDIVSRLPIKEAARTAVLSRRWSPIWRAAPLVLVDTHLLPAGDDEIPIDLDHAHSDAVAAAVSRILVAHPGPFRCVRITCCYMEEDRARVERWLKLLASKGVQELFLINRPFPLTIDKHLPATFFSMTTLTRLYLGFWRFPDTTTLPRSAAFPCLRELGLCGTVMDSHDMDFVLARSPVLEILNIEGHLLPPLRLRIISRSLRCVQINGSRVDSITVVDAQRLERILLGYGRNEDSCFKIKITHAPALRMFGKIELAKDELQVGNTIIKAGTMVNPSVMLSAVTILDLHVRFGVRNDSKMLPTILRCFPNIETLHIHSKKTTESTGRLSNKFWKESGAIKCVMSSINMLQVHDFRGERSELAFLKFFIESAQMLNVLVVVYANGFFSSRGEANSKVKALFAGRKATQSCKVVVCESRFSEGGSRWDFEQGSDFSFDDPFGIIGCSSFGVSQWFV

SEQ ID NO: 623 - protein, 154 aa, Sorghum bicolor
MDPEAVRKSLEPTATAEKITGSTPARLHFYDPFVLSGVSIEAAEHGRLLCSFVVTPRLASPVGYLRSGVTATLADQLGSAVFFCSGLPSSGVSIEISVSFVDAAAVGEEIEVEGKLLRAGKSVGVVSVDFRKKKTGKLMAQARHTKYLVASSKL

SEQ ID NO: 624 - protein, 141 aa, Sorghum bicolor
MDGGGGGDLRSAIKKWNVIYPVYLNSKKTVAEGRRIAAAKACPDPTCVEIADCCSHLKIPHAIELDKAYPRDFFQVGRVRVQLKKDDGSPVNPAIKTKKQLMIQIAELVPKHHGRTKKQEAATSSSAGGSSKNTKGGKKKK

SEQ ID NO: 625 - protein, 368 aa, Sorghum bicolor
MVMGASGSKLEKALGDQFPEGERYFGLENFGNTCYCNSVLQALYFCIPFREQLLEYYANNKTPGDAEENLLTCLADLFMQISQAKKKTGVIAPKRFVQRVKKQNELFRSYMHQDAHEFLNFLLNELVDILEKESSAAKDSPQLSSPEKAPNGPVQPLANGVKKEPPVTLVHKNFQGILTNETRCLRCETVTARDETFLDLSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 626 - protein, 386 aa, Sorghum bicolor
MDGLLSKLRSLDAYPKVNEDFYSRTLSGGVITLASSVIMLLLFVSELRLYLHAVTETTLRVDTSRGETLRINFDVTFPALQCSIISLDAMDISGQEHLDVKHDVFKQRIDAHGNVIATRQDAVGGMKMEAPLQHHGGRLEHNETYCGSCYGAQESDGQCCNSCEDVREAYRKKGWGVSNPDLLDQCKREGFLQSIKDEEGEGCNIYGFIEVNKVAGNFHFAPGKSFQQSNVHVHDLLPFQKDSFNVSHKINRLSFGEYFPGVVNPLDGASWVQHSSYGMYQYFIKVVPTVYTDINEHIILSNQFSVTEHFRSGESGRMQALPGVFFFYDLSPIKVTFTEQHVSFLHFLTNVCAIVGGVFTVSGIIDSFVYHSQRAIKKKMEIGKFN

SEQ ID NO: 627 - protein, 317 aa, Sorghum bicolor
MAASPALLSLTPAVSRHPHLLFSPCPPPRHVRLAPPLAAATPSPGGNGPGPGPGVFLSPRALSQLDELAAFRYEHAFPHGLLTVRALTRGPDDDAVAEALVRLLASSFSETVRWAPAQRYAQLLTFVIRRYLHDRRGLAPHAAVLVGFYRPADAGSDDSAASEEGGRDDEGGEGEGGDEGEMACTAEVSFDAVGAPGAPPTPTPPLDFPYICNMTVKTPLRRRGIGKQLLKACEDLVFKMNARRRVYLHCRIIDQVPFNMYRKAGYIIVQTDSILVWLSLQKRKYLMSKELPQASVVSETSTKNFDDNIDKLNVLRD

SEQ ID NO: 628 - protein, 63 aa, Sorghum bicolor
MCKLKFSKEHVGCYLLVILVICLLVGVLFGLGIFRHGYDRIKDLGRNHTCFDCNTTARYQLTN

SEQ ID NO: 629 - protein, 388 aa, Sorghum bicolor
MGRAAMAASSGTTTRSVRLLLLSLLGFCVALSHQESSSSSTDSCATAKVAVASLVPFDSTSFRCTAAWKQQDFVLRYKNTGPSEWSFILSAPDKGSYVAVGFSGKGAMVGSSAVVGWASNGKGTVKQYYLGGKSPEDCAPNKGLLKLVKNRSVVVSRSGRLYVAFQLSTDYPQPYLIFAVGPDGNLPQSDSLRLPMHQNMASRSFNYTSGMSYNTAGSSGDQAAFPTERKHGLLGMMGWGVLMPIGMITARYFRQLDPCWFYTHMAIQVCGYAIGIAGIVLGFRINEDGLKNVDVHKALGIAVLAMASLQVLAILARPDKTSKVRRFWNWYHHNIGRATILLAIGNIFLGLSIAQEVSAYVVSYGVFVAVWVVAVAAFEMKRCYADDD

SEQ ID NO: 630 - protein, 299 aa, Sorghum bicolor
MSEQLKRDYEIGEEIGRGRFGVVHRCVSRATGEPFAVKSVDRSLLADDLDRALAELEPKLARLAGGEGDENPGVVQVRAVYEDDAWTHTVMDLCTGPDLLDWVRLRRGAPVPEPDAARVVAQLAEALAGCHRRGVVHRDVKPDNVLLDLDPAGETPPRVRLADFGSAAWLGGGEGGGRRRGAEGLVGTPHYVAPEVVAGGEYGEKVDVWSAGVVMYALLSGGALPFGGETPADVFAAVLRGSLRFPPALFAGVSPAAKDLMRRMMCRDVSRRFSAEQVLRHPWIQSGGGVREVVRPTPT

SEQ ID NO: 631 - protein, 507 aa, Sorghum bicolor
MDSPPLSPALLALSLLLLLALYIARRRRGGGRNRNYPPVAGTVFHQLLNFGRLMEYQTELAQRYRTFRMLTPTCNYVYTVEPANVEYMLKTNFANYGKGVMTHDVLEDLLGDGIFNVDGAKWRHQRKVASHEFSTRVLRDYSSGVFRDTAAELAGIVAMAAGAGERLDVADLLLRSTLDSMFKVGFGVNLGSLSGCSDEGAAAFARAFDDASEQVLYRFFDVSWKLKRLLNISSEAAMKGSIRTIDGFVYGVIDRKIEQMGRDQQEFAKKEDILSRFLMERESDPGCFDNKYLRDIILNFVIAGRDTTAGTLSWFLYMLCRNQHIQDKVAREVRAATTGDRDVGVQEFVAFLTEDAISRMQYLHAVLTETLRLYPAVPIDVKYCFSDDTLPDGYAVKKGDMVNYQPYQMGRMKFLWGADAEEFRPERWLGDDGVFVPESPFKFTAFQAGPRVCLGKEFAYRQMKIFAAVLLYLFRFEMWEANATVGFRPMLTLKMDGPLYVRATLRQ

SEQ ID NO: 632 - protein, 523 aa, Sorghum bicolor
MKGGGGGKETLTASFLRFLLLLLLPLTALYFFYTLHLLLTSASSAASNCAPDAASVSRVSANLTAATASASTAAAEKQLPPSPLAVPSATTLQHVVFGIAASSRFWDKRKEYIKVWWRPRGAMRGYVWLDREVRESNMSTARTGLPAIRISSDTSAFPYTHRRGHRSAIRISRIVSETFRLGLPGVRWFVMGDDDTVFFPDNLLTVLNKFDHRQPYYIGSLSESHLQNIYFSYGMAYGGGGFAISRPLAEALARMQDGCLRRYPALYGSDDRIQACMAELGVPLTKHPGFHQYDVYGDLLGLLASHPVAPIVTLHHLDVVKPLFPDARSRPAAVRRLFDGPVKLDTAGLMQQSICYDGANRWTVSVAWGFTVLVARGIMSPREMEMPARTFLNWYRRADYTAYAFNTRPMARSPCQKPAVYYMSSARRQAGRGGETTVTRYERWRHPNETRPACRWDIADPDAHLDHIVVLKKPDPGLWDRSPRRNCCRVVSSPKDGGENGEKTMTIDVGVCREGEFSQVAGA

SEQ ID NO: 633 - protein, 411 aa, Sorghum bicolor
MASEGNKDVPNETLSVDQSSISGVKRKRGRPRKYEYPVYELPQKVQPLQSAPPLLHCTQDGSSMASHTSGGSVHGNWSAQPRNSANVSLQGNSGKDNVLGKHFVGKLTKKVPGFSLITVKVKDNQVLKGWVPDEINLRPITPKDDLAPELPMLRPSQVRKRASAIHMQPALPVPMHLEDVTLAKPLQMRRPVEKTIAKHAVPLAPRPYIGSGVVAAVPISVAPSNPEMRTLARQDAELVIPQSSVAAVPIKSVCPVSVPCKQPANQKEFTGKKSVDEVQKDSEPPNVTKESPVKAEKPNIALVDVVVKDSPGERQQLNDQVTDVIRESSGQTQNVDVTMSDEIKIASGARDQPNSANSEQQSSKEASDITEQSEQLKTETDVNKGVDASKSNASDDIQPAHDEQEMKVGGK

SEQ ID NO: 634 - protein, 308 aa, Sorghum bicolor
MPPTTMPSTSLALPTAARAGARRHAFFSNRSPSSVPIARRRRAPRFVMVSASASLEALIFDCDGVILESENLHRQAYNDAFANFGVRCPPASADPLYWDEAFYDELQNRIGGGKPKMRWYFGENGWPSSELFETPPSTDTDKEKLVDIIQDWKTERYKEIIKSGTVKPRPGVLRLMDEVKNAGIKLAVCSAATKSSVIMCLENLIGLERFNGLDCFLAGDDVKLKKPDPTIYITASEKLGVGSKNCLVVEDSVIGLLAAKGAGMSCIITYTPSTASQDFKDAIATYPDLSNVRLEDLKLLLQKTLVTG

SEQ ID NO: 635 - protein, 124 aa, Sorghum bicolor
MDILLGSGRFLARRLPPLALVPRCSRGSPDKSGSDKGETSTDWDKAWASFKNKGKRTLFSDFSPNKYVTWNPRRSEYPLSEEVDPIKRTERSNLMLWTSPQFTLVGAIIIVLTLLIYTLVVPPK

SEQ ID NO: 636 - protein, 757 aa, Sorghum bicolor
MATPVPAEADAGEARELLYEAYNELQALASELGGAAVAPAVVVVGHQTDGKSALVEALMGFQFNHVGGGTKTRRPVALHLRFNPRCDEPQCRLLSATGDADEHDEAGVAARPMPLADIQAYIEAENLRLENDPCQFSEKEIIIKVEYKHSPNLTIIDTPGLILPAPGRKNRVLQSQASAVERLVRAKIQHKETIILCLEDCSDWSNATTRRVVMQVDPDLARTVLVSTKLDTKIPQFARPSDVEVFLHPPTCVLDVSLLGDSPFFTSVPSGRVGSCHEAVFRSNEEFKKAILSREMEDIASIEDKLGRSLTTKERDRIGVGNLRLYLEELLQKRYVESVPLIIPLLEKQHRNTTSKLREVSHELSDMNEAKLKEKAQLFHDSFLTKLSLLLKGMVVAPPDKFGETLVNERINGGTFTGSENFQLPNKMMPNGGMRLYGGAQYHRAMAEFRLVVGSIRCPPITREEIVNACGVEDIHDGTNYSRTACVIAVAKARDTFEPFLHQLGFRLLYILKRLIPICVYLLEKDGEGFSSHEVLVRRVQEAFKRFAESTEQSCRQRCMEDLESTTRYVTWSLHNKNRAGLRHFLDSFVAPEQLSVNTLNEQFSGLNDNKQDRAKGDSKSNHSDTNSSSAVPETRLVDLLDSTLWNRRLVPSSERLVYALVHQIFLGIKEHFLVTTELKFNCFLLMPIVDKLPALLRQDLESAFEEELDSIFDVTQLRQSLGQKKRELEIELKRIKRLKDKFGEINKKLNSLQVRQ

SEQ ID NO: 637 - protein, 188 aa, Sorghum bicolor
MASTSSSYPLLLLLLLLAAPAAAAAEASVGVGVVGGGNATTTTSSSPTAYEMLERYDFPRGILPAGVSGYELRGDGSFEVYFPRRCEFLLAGTWLVRYEPRVRGSVAAGSLTALDGISVKVLFLWLGVGEVDRAGDTLSFYIGPVATSFPLDDFAESPRCRGYDYDGDGDGAAAGDDLFPAAAVAASS

SEQ ID NO: 638 - protein, 194 aa, Sorghum bicolor
MATSFQGTTTKCTACDKTVYLVDKLTADNRIYHKACFRCHHCKGTLKLANYNSFEGVLYCRPHFDQLFKRTGSLDKSFEGTPKVVKPERNVGNENAVKVSSAFAGTREKCVGCSKTVYPIERVTVNNTMYHKSCFKCCHGGCTISPSNYIAHEGKLYCKHHHIQLIKEKGNFSQLENDHEKTSQAGSLEDEEEY

SEQ ID NO: 639 - protein, 195 aa, Sorghum bicolor
MALSAPIRISLIVSFFGILSFILGVIAENKKPASGTPIPGKDVVICKFPSDPTLAMGSLSIVALVVAAIVGHVAIFFPYSDKSVPRGALFQSTSLTVFFVVAELVSALAFAMLLWATITEGLHRSKNIHHDMNYQCPTAKTGLFGGAAFLALDAALFWLVCQMLALNARADYLDEDDNKGEYGQVYADEVDGSKV

SEQ ID NO: 640 - protein, 294 aa, Sorghum bicolor
MLRGGTSVLGIINFITFLISIPILGGGIWLASRANSTDCIRFLQWPIIVVGLVLMVISLMGFAGACYRQTWLLRLYLFAMFFVVLALLFFIVFAFAVTDRGDGQVVMNRRFPEYQLSDYSGWLRDRVADPEYWATISACLRDGHACAGMRRLARDPNTGMLVPETPAMFYGRNLSPIQSGCCKPPTSCAFTYMNETYWTQNPGVPTVMNDPDCSRWSNDQQMLCFQCDSCKAGVLAGIKKSWRKVAILNIVVLIILVIVYVAGCAAFRNAKRIENDEPIGMARMTKSHPSRFQF

SEQ ID NO: 641 - protein, 357 aa, Sorghum bicolor
MTTKRCCLLVATLLAALLVSVTARLDVGFYNKTCPSAESIVQQTVAAAFGNSSGVAPALIRMHFHDCFVRGCDGSVLIDSTANNTAEKDSPANNPSLRFFDVVDRAKASLEAQCPGVVSCADILAFAARDSVVLTGGLGYQVPSGRRDGRVSNATQATNNLPPPFFNATQLVDRFASKNLTLEDMVVLSGAHTLGVSHCSSFAGPANLGDRLYNFSGSADGIDPALSKAYAFLLKSICPSNSSQFFPNTTTFMDIITPDKFDNKYYVGLTNNLGLFESDAALLTNATMKALVDSFVRNETTWKRKFAKSMVKMGKIEVLTGTQGEIRRNCRVINPASATDVLASQSGSSGFTGVAAS

SEQ ID NO: 642 - protein, 535 aa, Sorghum bicolor
MASVRSCVSVKSAVSPVRYRSTRARAAGLGAPGRLRVRSPSLALGGDGGCASASSSGRGSVVVSGGGLGVLGGDGPRIIRRGGGREVLAMCSASFDGVRPAAGAGAAVASAVQPVPAAFPERVKVVALVAAIMLLCNADRVVMSVAVVPLAAQYGWSSSFVGIVQSSFLWGYVFSSMVGGALADKYGGKKVMAGAAALWSLATILTPWAASRSTIMLLAVRALFGLAEGVAFPTMSTFLPKWFPTHERSTAVGISMGGFHLGNVISFLATPIIMSHIGLSGTFAFFASLGYVWLFVWMLNVESDPLDSRTISKSELELILAGRTGSKVQGSKFPSLRELFSRTEFLAVTLANVVNNWGYFVLLSWMPVYFKTVYNVNLKQAAWFSAIPWAVMAMSGYVAGASADFLIKSGYSIGLVRKIMQSIGFMGPCVSLLCLRFAQTPSVAAVLMTTALSLSSFCQAGYFCNIQDIAPKYAGSLHGLTNGIGTVAAIVSTIGTGYFVQWLGSFQAFLTLTAALYFSATVFYNIYATGDLIFD

SEQ ID NO: 643 - protein, 267 aa, Sorghum bicolor
MWPLCVISEKLFKMAGDDAVQGAAGSPSLDGQIPLARRSYYVDVPHVQQAFTWDCGLACVLMVLRTLGIDCCDGIAHLERLCRTTSIWTVDLAYLLNKFSVSFSFFTVTLGANPQYSAESFYREQLQEDINRVDELFGKALDAGISIQCRSITAYDIAFLLLSGHCIAIALVDKSKLNLPCMSDHDVQQFNEESDYMGHYVIICGYDADDCEFEIRDPASSRKRERVTMKSLDEARKSFGTDEDILLVSLTGKSGMKLSRKLLACSM

SEQ ID NO: 644 - protein, 1001 aa, Sorghum bicolor
MDTLKRKAPDGPEAADQASPLKAPRVVAPTSEPPAPTALATAEPVACVHDVSYPEGYDASASTSRAIAGGADASEPARKFPFQLDPFQSEAIRCVDNGESVMVSAHTSAGKTVVALYAIAMSLRNQQRVIYTSPIKALSNQKYREFKEEFSDVGLMTGDVTIEPNASCLVMTTEIWRSMQYKGSEVMREVAWIIFDEVHYMRDRERGVVWEESIVMAPKNSRFVFLSATVPNAKEFADWVAKVHKQPCHIVYTDYRPTPLQHYVFPSGGDGLYLVVDEKGKFREDSFQKALNALVPASDSAKKKENGKWQKVIMAGKSSEESDIFKMVKMIIQRQYDPVILFSFSKRECEFLAMQMAKMDLNEDDEKANIETIFWSAMDMLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMMLKGSADSLNSAFHLSYNMLLNQMRSEDGDPEKLLRHSFYQFQADRSLPDLEKQIKELESERNSMVIEEEESLKDYYDLLQQHRSLKKDVHDIVLSPKHVLPFLQPGRLVRIEYSTDEPANFSIDENVTWGIIINFEKVKSHGEDRRPEDSDYTVDVLTRCSVTKDNNGKKTMKVVPLKARGEPVVVSLPLSQIDGLSSIRMYIPKDLLPVEARENTLRKVEEVLSRFAKDGVPLLDPEEDMKVQSKSFRKATRRIEALESLFEKHDIRNSPHIQQKLKVFHAKQELSAKIKSIKKTMRSSTALAFKDELKARKRVLRRLGYVTSDDVVEVKGKVACEISSADELTLTELMFSGALKDATVEQMVALLSCFVWQEKLQDAPKPREELDLLFYQLQETARRVANLQLECKIQIDVESFVNSFRPDIMEAVYSWARGSKFYQIMEMTQVFEGSLIRAIRRLEEVLQQLILASKSIGETELEAKLEEAVNKIKRDIVFAASLYL

SEQ ID NO: 645 - protein, 181 aa, Sorghum bicolor
MATTPPPPPAPAAAHTVFVYGSLMADEVVRTILKRVPPAAPALLPNYHRFNIKGRIYPAILPVESKKVAGMVITGVTDEELQLLDAFEDVEYTRTRVEISLTDSLEKILADAYVWSDAEDPNLYGEWDFEEWKKLHMKDFLAMTNGFMHELEQPESKTRVETYESFMQQQEQPVPGTQVEG

SEQ ID NO: 646 - protein, 642 aa, Sorghum bicolor
MGKGKKSKEKEMEKKPVDILAGSDEDSDGGEDLSKVQINEEYARRFEHNKRREALQRLEERRKQGLVPASDDGESDSESESTEEEDEEAAIASRLVDRRVFEVIRRIRSGDPRILDKDAKVYSESEEEEGGEEGEDAEKEEESKQGKKKTKKEKPLYLKDVNARHLLEEGPEFAAQASRSSSKFERIAYDEQQKKGLEAFLEAQKEVLGDDDDDNLFQVKPKVRAGADDEVEEDEEEKQTKELAGEVFGNDEELDENEKFLKEFFLKRPYLEAEKRKSYLDDIQELSDDEEELEIQEEYEHGYNYRHEEAMASGAVVADRVMGHSRVVEGSVRKKESSRKQQRKSKEERMARIKQQQAEELKHLKNLKKKEIAVKLERIRMIAGIEGDAACKLGADDLEEDFDPEDYDKKMQEMFDDSYYDADDVDPEFGSGVEMDLEKPDFDKEDELLGLPKGWASDQSKEESTAADAKGAKGKISLKDKVELEKEMEEYYKLDYEDTIGDIKTRFKYKQVKPNSFGLSACDILTSDDKDLNQYVSIKKLAPYREDEWKVTHHKMQSKDLILGGQKEGKKDKSVKKSRSEEGGPSSSKTEKDRLTNGQESTDDKKKTTRSERRKRRNADLKISDDRLAAFGKTNSKRHKSH

SEQ ID NO: 647 - protein, 158 aa, Glycine max
MDIRLMDLDSPLFNTLHRIMDLTEDAEKNLNAPTRTYVRDAKAMAATPADVKEYPNYYVFVIDMPGLKSGDIKVQVEDDNVLLISGERKREEDKEKEGAKYLRMERRVGKFMRKFTLPENANTDAISAVCQDGVLTVTVNKLPPPQPKKPKTIEVKIA

SEQ ID NO: 648 - protein, 183 aa, Glycine max
MVNGNVKITSWVQKKITDPLLSIIRRGTEPNQLAFSAALGITLGLFPICGVTVFLCGMAIALLGSFCHAPTVMLANFIATPIELSLVVPFLRLGEVISGGSHFPLTSDALKKVLTGQASREVLLSVAHALLGWLVASPFILGTLYIVLLPCFKILVHNFSSVPLSPKKPLNPHSEVKLKVRDV

SEQ ID NO: 649 - protein, 136 aa, Glycine max
MSAYDNVVGGKLKLKGKALDVAGGVKKKKKKNKRNQEQLLQVAEDEVSAGGSKEQAKDSNDEDINDVSELSGEGKTAHYDDHLTPVERRYIEQREQLDVHRLAKISNKSHRDRIQDFNQYLANMSEHYDIPKVGPG

SEQ ID NO: 650 - protein, 791 aa, Glycine max
MGRRNGGRSLQETLRRRLESCKSKYSTAEEFANHLRSTYPDYHRTKHQTLIRFVQEALHSTAKLNHTPTPKHCDGDDDDDEEGEAQSASRKRRKKIDGSEERLQRMEALHVRSKVQRSSSSSSASESDDEDEEETVSTSEDAIYGEKVEPEFDLMKTMLRKSYTPKKVAAEEKNVELEVGNSSKDTLVNEERKEVKGSSSGSVSNRKDGPRFKDLGGMKEVLEELKMEVIVPLFHPQLPRQLGVRPMAGILLHGPPGCGKTKLAHAIAHETGLPFYQISATEVVSGVSGASEENIRELFAKAYRSAPAIVFIDEIDAIASKRENLQREMEKRIVTQLMTCMDQSNRLLQPADDVESSGDDHHPGYVLVIGATNRPDAVDPALRRPGRFDREIIIGNPDESAREEILSVLTCDLRLEGLFDLRKIARATSGFVGADLAALVDKAGNLAMKRIIDERKRELSQDLTSEHAEDWWREPWSVEEINKLAIKMSDFEEAANKVQPSLRREGFSSIPNVKWDDVGGLDLLRKEFERYIVRRIKYPEDYEELGVDLETGFLLYGPPGCGKTLIAKAVANEAGATFIHIKGPELLNKYVGESELAVRTMFSRARTCAPCILFFDEIDALTTKRGKEGGWVVERLLNQLLVELDGAEQRKGVFVIGATNRPEVMDRAVLRPGRFGKLLYVPLPSPDERVLILKALARKKAVDASVDLSAIAKMEACENLSGADLAALMNEAAMAALEERLTSIETTCDTLTIKRTIKRHHFEVALSKVSPSVSDRQKQYYQHLSEGFKAA

SEQ ID NO: 651 - protein, 208 aa, Glycine max
MGWLSRFITAVAFLAIGVIFSPETLGSKSTTLSTYLKLAHLLCFSTAFGAALWVTFIGGIIMFKNLPRHQFGNLQSKMFPAYFSMVGVCCAVSVASFGYLHPWKTSSTTERYQLGFLLSSFAFNLTNLFVFTPMTIEMMKQRHKVERENNIGEEVGWSKNVEVAKSNPKLAAMNKKFGMIHGLSSLANIMSFGSLAIHSWYLAGKIDL

SEQ ID NO: 652 - protein, 275 aa, Glycine max
MSTSAASLALPTLTLRTRQPLCSPQCFSSSLSLTPNNKPISISAVFLKPTTLSSSRFVPHVVVSSDLGQEEDTFSDGDGPSFSPDLKLFVGNLPFNVDSAQLAELFESAGNVEVVEVIYDKTTGRSRGFGFVTMSSVEEAEAAAQQFNGYELDGRALRVNSGPPPARNESAPRFRGGSSFGSRGGGPSDSENRVHVSNLAWGVDNVALKSLFREQGNVLEARVIYDRESGRSRGFGFVTFSSPDEVNSAIQSLNGVDLNGRAIRVSLADSKPKQF

SEQ ID NO: 653 - protein, 210 aa, Glycine max
MRSAKMWTVLMCLMVSFFARIESLSVTVNDVECVYEYVLYEGDTVSGNFVVVDHDIFWNSDHPGIDFTVTSAAGNTVHNIKGTSGDKFSFKAPTHGMYKFCFHNPYSTPETVSFYIHVGHIPSEHDLAKDEHLDPINVKIAELREALESVTAEQKYLKARDARHRHTNESTRKRVVFYTVGEYLLLAAVSALQVIYIRRLFSKSVAYNRV

SEQ ID NO: 654 - protein, 225 aa, Glycine max
MINHALCFLVFLSALHATHGVEYTVTNNALSTPGGVAFRDKIGAEYAKRTLDSATQFIWRIFQQNNPSDRKNVQKVSLFVDDMDGVAYTSNNQIHLSARYVGNNKGDVKTEITGVLYHEMVHVWQWSGNGRAPGGLIEGIADYVRLKANYAPSHWVKAGQGQKWDQGYDVTARFLDYCDSLKSGFVAQLNKLMRTGYSDQYFVQLLGKPVDQLWRDYKAKYGNIA

SEQ ID NO: 655 - protein, 265 aa, Glycine max
MASLNLLPHPPLFSSFLHRPHCNTHLLLTPKPSQRRPSLVVKSTVGVADPSPSSSSYAGDTSDSISSLKLNLLSAVSGLNRGLAASEDDLRKADDAAKELEAAGGLVDLSLGLDNLQGRWKLIYSSAFSSRTLGGSRPGPPIGRLLPITLGQVFQRIDILSKDFDNIVELQLGAPWPLPPLEATATLAHKFELIGSSKIKIVFEKTTVKTAGNLSQLPPLEVPRIPDALRPPSNTGSGEFEVTYLDSDTRITRGDRGELRVFVIA

SEQ ID NO: 656 - protein, 307 aa, Glycine max
MVSASLQFWSWIAPTPISHRYTHKFASLTSLKLATPVSSTNTVYLPKPLVVRFALTESDSPKSIEPDPQTLLQEIADSFDLPSDYFSKLPGDLRLDLNDAAFDLSNGPVLDECGQELGETLLNLSRAWELADTSTSHSLVKKLPLIEAKLTGYAKSALGKRLVSAGRRFQSMGQYGQGELQKIAKAMIAAGRVLTASSTSAVIVEEPKEEARVLKFGELQVEVTPDKANIGAVIGFLFGILCWQIARGVQNVPDSSLQYANDNALLLAKSLKGALLAIFYSSTFLSAFTSVGLVLLGLQLKSKKNKD

SEQ ID NO: 657 - protein, 132 aa, Helianthus annuus
MASTVTISSVFIILLTIATVFTSNTEASSVDFVKKTVSSHPIVIFSKSYCPYCKRAKGVFKELNVKPYVLELDEREDGSKIQDALSEMVGRRTVPQVFINGKHLGGSDDTVEAYQSGELAKLLGIESHKTDL

SEQ ID NO: 658 - protein, 434 aa, Helianthus annuus
MGEWVIGAIINLFGSIAINFGTNLLKLGHDERDRHAMLGEGIDGKTILRPIISFQSWRIGILFFAFGNALNFISFGYAAQSLLAALGSVQFVSNIAFAYFVLSKTVTVKVLVATIFIVLGNTFLVAFGNHQSPVYTQEQLAEKYSNITFLFNCLFLVVVVVMHHYVYRRGELLLAIPEKELTPYWKLLLPFSFAVVSGAVGSCSVLFAKSLSNLLRLSMSSSYRLDSWFTYSILVLFLCTAGFWMARLNEGLSQFDAILIVPMLQIAWTFFSICTGFVYFQEYQVFDALRTVMFILGMISVFIGISLLAPDDSKGEVKDSPSPSSKVNTDVERLIEDSSIKDMKSLARAMATKASAAVIRAKSACTLLLGMGDDTMHASSVFAMPMVSSKMTGFRAVNGDRSKLLSLRSPSGWNRIPVVEETVNMMDSMSSEED

SEQ ID NO: 659 - protein, 188 aa, Helianthus annuus
MGDLSRRSGLRGIGTWFTKQVVEPFVEIISRGAQPKELALSAALGITLGVFPIVGVTFFLCVLAITMLGTAVNAPTVMLANFMATPIELSLIIVFLRFGEFITGGAHFPLTADALKKVLTGKASKEILLSIVHALLGWLVLAPFILGLLYIVLVPCFTMLVRRFSPSISLENEDEASYTEVMLKVRDA

SEQ ID NO: 660 - protein, 427 aa, Helianthus annuus
MEEITNGGNKNEPQLLKLKCSVQNYDWGRIGYDSRVATLFEKNCGVQIDEKKHYAEFWMGTHVSGPSVVDAGDGDNVSLKVWIVQNPKVLGDVVVDKWGVDLPFLLKVLSVGKSLSIQAHPDQELAGFLHKTQPNVYKDANHKPEMALALTEFEALCGFISSEELDVVLETVPEINEVVGNASANQILTVDKHIGELKEERALQSIFTKLMSVDQEVISEALSKLVNRLTHEKEKGRLPSKEELVLKLEKEYPNDVGVLAALLFNHVKLEPGDGLYIAANEPHAYLNGECIECMAASDNVVRAGLTPKYIDVKTLCSMLTYKQGLPEILKGVPMNQYVRRYTPPFEEFEVDQCVLDQGASVVFPALPGPSVFVVISGEGTMATASREDRVSEGDALFAPAGTEVHVSTDTELQLYRAGVNHKVLLNP

SEQ ID NO: 661 - protein, 190 aa, Helianthus annuus
MKQPMMPNPMMSSSFPPTNITTDQIQKFLDENKQLILAIMTNQNLGKLAECAQYQALLQKNLMYLAAIADAQPPTPSPAPTISSQMGPLAHAGIPQQGGFFMQHPQAAVMAQQSSSFPQQMPAMQFNSPQVMQPQMGVRPGGPSGPSSVPPSSAASDIWRGGMQDGGGADGSGAGKDGHGAAAGGPDEAK

SEQ ID NO: 662 - protein, 503 aa, Helianthus annuus
MPFLDSLTAISLLLFVRVLTVHASVHNYAGVKFARKGNAYVVHGGSEGIYYSHPNLNGSDASSNGDAYIKFEEIIFRRPQEASNFSTGMIYAILFEVDDRETIGGSAYGGQRAICCTADLAKLGACKEGEVIHRLSTSNPGWPEIFGVSFDVNDETSTMQPRSVQITRTGMYNLYFMHCEPRLADMVVEGKTIWKNPNGYLPGRMAPLLNFYGFMSLAFLVLGIFWFSQYARFWKEVLHLQNCITLVITLGMLEMALWYFDYAEFNESGVRPTGITIWAVTFGTIKRTISRLIILTVSMGYGVVRPTLGGLTSKVVMLGGTFFLASEVLELVEHVGAVSDFSGKAILFLSLPVAVLDAFFVLWIFTSLSSTLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKDDTLTLIKPSPVPISAKDVGDVRSEDDVDLEEDKTE

SEQ ID NO: 663 - protein, 366 aa, Helianthus annuus
MHPLYNKVKNTLHKTLPSKPFLGIMCLLLLPFIIFLHLLPATIPSAAPPLHPGYYANSCPNAELIVRNVMKKAMIREPRSGASVMRFQFHDCFVNGCDGSMLLDDTPTMLGEKLSLSNIDSLRSYEVVDEIKEALETACPRTVSCADIIIMASRDAVALSGGPDWEVKLGRKDSLTASQEDADAIMPSPRANATTLIDLFAKFDLSVKDLVALSGSHSIGNGRCFSIVFRLYNQSGTGRPDPSIEPKFRQKLDKLCPLGGDGNVTGDLDFTPRIFDNQYFKDLVNGRGFLNSDETLYTYWKTREYVKRYSEDQDEFFRDFVEGMIKMGDLQSGRPGEIRKNCRVVNGGPPMDLVMDGYKDRRILSY

SEQ ID NO: 664 - protein, 299 aa, Helianthus annuus
MGLPFRSLSMLLLLVLIWWSTSEAQTHRALDAILQDYAYRAFHRPRTGRPYDGVPPANLSGIQISALRLRSGSLFTRGVRQYKQFSIPVGVIGNPYVERLVLVYQNLGNWSTRYYPLPPGYMYLAPVLGLLAYDASNLSATNLEELDIHASEDPISIEFTQVQPVRDAQCVRFDLDGRTNFTKVVSGNKCLTYEQGHFSIVVESTAPSPAPVTQPPPHQGGGGKGWIIGGSVLGGVALLVLLALLILWVWRFNKRKKVHKMEKAADAGEALHMTAVGNTKAPAATTTRTQPSLETEYVP

SEQ ID NO: 665 - protein, 285 aa, Solanum lycopersicum
MRTSNHLIGLLNFFTFLASIPILSGGIWLSSRANNTDCLKFLQWPLIIIGVSIMVVSLAGFAGSCYRNTFLMYIYLWAMFFIIAALIGFVIFAYAVTDKGSGRPVMNRAYSEYYLQDYSGWLEQRVSSQNYWVKISSCIRDSRSCGKMRRIYNGAPESVEMFYLRKLSPIESGCCKPPTECGYVYQNETVWVPGGGLVGADPDCVKWSNDQEQLCYNCDSCKAGVLASLKKSWRKVSVINIVILILLVIMYMVAIAAFRHNKRIDNDEPYGETRMEKAQPSRIHF

SEQ ID NO: 666 - protein, 359 aa, Solanum lycopersicum
MEATRSCSQAHLPLQSISFPPQFYKKFQFTKSKPSNSHPRLVIAKALGTGDNGDFEHFTATPNKIFMEEAIGAEYGEGFETFRPNGLLKVDVDFLNDRLQEGFLRRIRYAMKPDEAYGLIFSWDNVVADSRALMLDAWNQLASEEGLELPEDDSVQRLLLYATADHILHKALAGEKNEADQDRLKTRLSHLYQDKLLKISEPIEGLKEWLDAVSTARIPCAVVSSFDRRNMVEALERMGLMKYFQAIVTEEDGMESIAHRFLSAAVKLDRKPSKCVVFEDDPRGITAAHNCTMMAVALIGAHPAYDLGQADLAVGSFSELSVINLRRLYAHKGSNFMDLEKQIAEKAPRRRKLTIDTIF

SEQ ID NO: 667 - protein, 302 aa, Solanum lycopersicum
MQRGRGDNFNSPFGGIMSSIFGFGGRDPFDDPFFSRPFPNLSRTSILHPTTPHDDESNRPVIQEIDTEDDDEDAPLEPDEESGDVNGCNKERDRAYANRNPLVEHPEDLTDDHSKSSKIISKDVTRGMEDMKLEGTQSKPQSMSYRRVTYGGINGTYYTATTTRRAGNDGRVLEESKQADSTTGQATHRISRGIQDKGHSLTRKLASDGKVDTMQTLHNLEEDELAGFEQTWNGNANNEIPGWNSGFDFHANAGTSSNWLTNWEAGFRDPFSGARPSDNSAQSAQRRTQSGRPKKVVRINIE

SEQ ID NO: 668 - protein, 478 aa, Solanum lycopersicum
MAGIATAGDTSTSTSSNLAPTRSLSKKENQGLLLGRYEIGKLLGHGTFAKVYHARNVKTNESVAIKVIDKEKILKVGLIDHIKREISILKRVRHPNIVELYEVMATKAKIFFVMEYVKGGELFNKVAKGRLKEEVARKYFQQLISAVAFCHARGVYHRDLKPENILLDEDGNVKVSDFGLSAISEQIKQDGLFHTFCGTPAYVAPEVLGRKGYDAAKVDIWSCGVILFVLMAGYLPFHDQNIMAMYKKIYRGEFRCPRWFSPELTRFLKRLLDINPETRITVQEIMNNRWFKKGFKHVKFYIEDDKLCSINDDEYGGIDYSSDRSESESEIEIRRRSASLPRPASLNAFDIISFSRGFDLSGLFEEGGDGARFVSGAPVPKIINKLEEIAKVVSFAVRKKDCKVSMEGSKEGAKGPLTVAAEIFELTPSLRVVEVKKKGGDSLEYEEFYNRELKPGLQNLAHEVGYPVNSSYLPSDTE

SEQ ID NO: 669 - protein, 399 aa, Solanum lycopersicum
MGIKFIMFSFILTSLFLILIYIPTQFSHSPITIFKPKRSFIISNTTTNPYPVKFAYLISASKGDVAKLKRLLFSLYHPGNFYLIHLDLDAPENEHQEISRFVSENSVFGEINNVWVVGKPNLVTYRGPTMLATTLHAMAMLLKIAKWDWFINLSASDYPLVTQDDLIHAFSDLPRDLNFVQHTSHMGWKLNKRGKPVIIDPGLHSLNKSEIWWVIKQRSLPTAFKLYTGSAWTILSRSFAEYCIIGWENLPRTLLLYYTNFVSSPEGYFQTVICNSEEYRNTTVNHDLHYITWDIPPKQHPRSLGPKDYRRMVLSNRPFARKFKNNNLVLNKIDRDLLRRRNGQYFSAGGWCSNDDDRGCLNLQVEKYGVLKPGMGARRLRTLLKKLVSAPHFAKRQCR

SEQ ID NO: 670 - protein, 208 aa, Solanum lycopersicum
MFKLLFLLAILLLSSDAAVQDFCVADLKAPESPSGYSCKSVTNVTVDDFVFSGLSAAGNTASIIKAAVTPAFAAQFPGLNGLGLSAARLDLAPSGVIPFHTHPGASEILLVVQGSITAGFVSSANSVYLKTLKKGDLMVFPQGLLHFQVSDAGYTSVGYVFFSSSNPGLQITDFALFANDLPTKLVAATTFLDEATIKKLKGVLGGTN

SEQ ID NO: 671 - protein, 265 aa, Solanum lycopersicum
MRCFTLLLFFSSIVAVALASNVEEALISQVVEIHRLRPQTGSAGYTVPQLDCLSWRLAIETNNLQNWRSVPKECTNYLGHYMMGKQYRHDCEYVAKQAIEYAKSLKLSGDGKDVWVFDIDETTLSNSPYYARSDVAFGAKPYNATKFDAWIAEGKAPAIPSILEVYNTVLSLGIKPIFITGTKQNFKQVRIVNLKEAGYTNWAALILKGANDTGSAVKFKSSKRTALVKAGYRIIGNIGDQWSDLIGENVGARTFKVPDPMYYIG

SEQ ID NO: 672 - protein, 240 aa, Solanum lycopersicum
MDFSFFGNFPWFKPHSANDMASTVASTSTLMQTPKQNAQFWKWTVFSFLPWAKVAEGNIQMPTTVNKKLKRRPSREGVDSLARKSAIRFRPYVSKVPWHTGPRAFLSQLFPRYGHYCGPNWSSGKDGGSPIWDRRPIDWLDFCCYCHDMGYDSHDQAELLKADLAFLECLEKPNMSTRGDPHVALLYKTMCTSGLRNILIPYRQQLITLQSKQLCFGFGWLGGIMEPAKCLKDRFVWLQK

SEQ ID NO: 673 - protein, 173 aa, Solanum lycopersicum
MSFTFIKPSIPSPTSELLHPFSKSRLRHCPTSPFGNNAGRRHQIERNRVKALPDWPLMAVLVEHMEGQRDLITHKSVWHLSDEAMKNVYTFYIMFTVWGCCFFGSTKDPYYDSEQYRGDGGDGTGHWVYEKQEDIEEEARAELWRDELIEEIEQKVGSLRELEEAGKKEQLVK

SEQ ID NO: 674 - protein, 195 aa, Solanum lycopersicum
MAIGMKQMSMIIATLGVLSFIFGVIAENKKPAAGTAISGKGVVICKYKSDPTVALGYLSFVFLAASSVAGFLSLFYPYQGKSVPQAALLRNTSFLVFLNIALGTTGLAATLLLWPTITEQLHITRNIHHNLQTDCPTAKTGLLGGGAFLSLDSALFWLVALMLADNAREDYFQETDIKGEPKASYADDEIIKTSA

SEQ ID NO: 675 - protein, 135 aa, Solanum lycopersicum
MDGEIKNIKKWNILYPVYINSKKTIAEGRRICVTKACENPTCTEISDCCNFLKIPCAIELDKAYPRDFMQRGRVRVLLKREDGTPYNPVIPSRKQLMINVAELVRRHPNRTKKQEPAASSAAGSSKSGKGGKKKR

SEQ ID NO: 676 - protein, 346 aa, Solanum lycopersicum
MGGGEEDQQKLKNTAAAAYDYENDPRWADYWSNILIPPHMASRSDVVDHFKRKFYQRYIDPGLVVEPMTTSSSSQPAKPSAAQPSSSSSTPSNNQPRQRNSGQASRTSGTPTTPTSNPTSLRWDRNTIQFSVNAWVFVVAVLSIFPLTPANLSNRAYRLSFLGTACSSLYSLYSVYGKPRAWNLQAVQVWFQSVIVTKDFISFIYCLTFVTSHLYLKFSLIPVLCRSLEHVGKFLRRNFGRSSLYRKYLEEACVWVESNVTTLNILSSQAEIGLGFLLVVSLLSWQRNIIQTFMYWQILKLMYHAPATAGYHQNVWAKIGGLVNPVVQRAPFLNTPISTIQRWWFR

SEQ ID NO: 677 - protein, 343 aa, Solanum lycopersicum
MDKEAANHHQNHEISNKDEFSPRIKPLQNYHVPTGNSDRLKRDEWSEGAVSCLLEAYEAKWILRNRAKLKGQDWEDVAKHVSARVYSTKSPKTQTQCKNKIESMKKRYRSESATAADASSWPLYPRLDLLLRGNNASAASSSLIPPPPLPPNTNCVIDAVEPPPQQPILLPPPPATLPPPPPLPPSPALPFGNGDQNSHGSNGLDRGIKEDILMDAKLSDNAAAPDQKNATATNSSSTPALYSDNKSKSKLRSKNKRKRAVEGWEIGESIRLLAEVVVRSEQARMETMRDIERMRAEAEAKRGEMDLKRTEIIANTQLEIAKLFASITKGSVDSSLRIGRSSS

SEQ ID NO: 678 - protein, 189 aa, Solanum lycopersicum
MLGRRFISFLRRSPSASGKVVAEEGKAKTWGRRIVSGTLICLTGGVALSALDDLSIYHSCSSKALERASKNKPIIDAIGEPIVRGPWYNASLAVAHQRQSVSCTFPVSGPQGTGIFQLKAVRNGEDKWSSFLRASDWEILIMEALVHVPGNEEKQQTFRIKVSDYLPPPASNACTDCIPQESSGNVDKK

SEQ ID NO: 679 - protein, 529 aa, Solanum lycopersicum
MANNAAACAERATSDMLIGPDWAINIELCDIINMNPGQAKDALKIIKKRLGSKNPKIQLLTLFVLETLSKNCGENVFQQIVEREILRDMVKIVKKKPDLNVREKILILIDSWQEALGGPGGRFPQYYAAYNELKAAGVEFPPREENSVPLFTPPQTHPIVHTPSAYEEAAVEASLESDPSGLSVAEIQSAEGLSDVLTEMLGALDPKNPQSVKEEVIVDLVEQCRSYQKRVMILVNNTVDEDLLCKGLALNDNLQRVLRRHDDIAKGTSTITVPPRETPVAPLMNVNHEDDESEDDFSHLSRRTSRDPSQGQGRKTIDVKSEPMRITPTLPPPPSSRRPVFTDGKMVDYLSGDRFESERSMGTEGSSPIAASTNSNNASSIPWSSPKPSSSAPPPDDLLNPTADEDFLNPTASMFTGKNNQNESNSKAKSADNLPPAPWDAPPPTAIPPPPARYDQRQQYFEKHVSGGSPPARTGSSSYDSIVGQTKNLSINSSSPSKPEKPEDALFKDLVDFAKAKSSSSSNQSNRSF

SEQ ID NO: 680 - protein, 130 aa, Solanum lycopersicum
MDMPKGDKLVLRGLKFHGYHGVKQEERKLGQKFLVDVDAWMDLRSAGESDCLSDTLSYTDIYRLVKEVMEGPPKNLLESVAQLIASTTLTKYPEVSAVRVQVGKPHVAVQGPVDYLGVEIIRYRSLDVQN

SEQ ID NO: 681 - protein, 673 aa, Solanum lycopersicum
MKSRLGVPFKGISEDIRGRVSCYKQDWIAGIRSGIGILAPTTYIFFASALPVIAFGEQLSRETDGSLSTVETLASTAICGIIHSILGGQPLMILGVAEPTIIMYSYLYKFAKGREDLGQTLYLAWAGWVCVWTALMLFLLAIFNACSVISKFTRIAGETFGMLIAVLFIQEAIKGLVSEFSIPKAEDPSSEKYQFHWLYMNGLLGIIFTFGLLYTALKSRKARSWWYGTGWMRSFIADYGVPLMVLMWSSLSFIVPSNVPSGVPRTLYSPLPWESASLYHWTVMKDMVKVPPVYIFAAIIPAVMIAGLYFFDHSVASQMAQQKEFNLKNPSAYHYDILLLGFMTLLCGLLGLPPSNGVLPQSPMHTKSLAILKKQLIRKKMVESAKESIRQKASNSEIYGNMQAVFIEIDSSPISAVAKELEHLKEAIMKCESDNANDEKSSGIFDPEKYIDAYLPVRVNEQRVSNLLQSLLVAASAGAMPVIKKIPTSVLWGYFAYMAIDSLPGNQLWERMLLLFISPGRRFKVLEGVHASFVESVPFRCIAIFTIFQFVYLLVVFGVTWIPIAGILFPLPFFLLISIRQHLLPKFLHPRHLQELDAAEYEEIAGAPQRALSFSFRETEITLPRTEGEIEICDAEILDELTTSRGEFKVRTISFSEDKRPQVIYPTADTESE

SEQ ID NO: 682 - protein, 225 aa, Triticum aestivum
MKLQVATVASFVLVALAAAAQAVTFDASNKASGTSGGRRFNQAVGLPYSKKVLSDASAFIWKTFNQRAVGDRKPVDAVTLVVEDISGVAFTSANGIHLSAQYVGGISGDVKKEVTGVLYHEATHVWQWNGQGRANGGLIEGIADYVRLKAGFAPGHWVKPGQGDRWDQGYDVTARFLDYCDSLKPGFVAQLNAKMKSGYTDDFFAQILGKNVQQLWQDYKAKFRG

SEQ ID NO: 683 - protein, 429 aa, Triticum aestivum
MKLPLSAGSPDAAPELAKPSLPATWLILHALFCATSMAVGFRFSRLVVFLLFLPTPPMNPSAHLVSLVTPPVMLASSNTTATITTTTTTTTTVTTTTTLAESEAGANAHHQVHHGPVFVGRHAIRVRKWPHPNPGELLKAHSILAAVQEAQRRSRNRMADPLRPVIAVTPTTTSALQAPSLTSLAHTLRLVDAPLRWIVVEPGHRTDAVAAVLARSGLDFLHLVASDGPSTARLRMHALREIRKEKMDGVVVFADENGILRTELFDEAQKVKSVGAVPVGILGEDEGTKESFLQAPACDEAGKLVGYHVSEETLLPAARSDMLLSTRLEWAGFVVNARVLWESASERPEWVRDLDAVDGGAHLDSPLALVTDAGQVEPLARCARAALAWSLRSDALHEVKFPHEWKFDAPLVSAASRQQSSVVNTEDGH

SEQ ID NO: 684 - protein, 715 aa, Triticum aestivum
MAALAAAAAFAGLLLALAPVVGADTDAAGVSALGNLYTSWNSPAQLVGWSAAGGGDPCGAAWMGVSCSGSAITSINLSGMGLNGTLGYLLPSLVALTTMDLSNNSLHDVIPYQLPPNLIHLNLARNNFSGNIPYSISNILSLGYLNVSHNSLFQEIGELFGGLNSLSVLDLSFNNLSGNLPVSFVSLSNLSSLYMQNNQLSGTVSVLSNLSLTTLNIANNNFSGLIPGELSSIPDLSAGGNSFINMPASPPRIIMPPSQSPVAQPDRPQVPTTFPNGPEDDIPIEEGDKKQGRQTGLLVGLAVGSVAAASCILFALVFCLHSVHKRKDGGTSEPKDFVGALAVNIDRDSNTNIHQDSPVAASVLPRPIGTPERAYGVNSSPAKKIKVPGAATSYTVASLQVATNSFCQDTLLGEGSLGRVYRADFPNGKVLAVKKIDSASLSLYEEDHFLEVVSNISRLRHPNIVSLTGYCADHGQRLLVYEHIGNGTLHEMLHFSDEANKSLSWNARVRIALGTARALEYLHEVCLPPVVHRNLKSSNILLDEECSPHLSDSGLAAFSPNPEREVSTEVLGSLGYSAPEFAMSGTHTVKSDVYSFGVVMLELLTGRKPLDRSRERSEQSLVGWATPQLHDIDALAKMVDPAMEGMYPAKSLSRFADIIALSVQPEPEFRPPISEVVQQLVRLMQRASMLRRQSGDDLGSSYRAPEHEGGAWDAV

SEQ ID NO: 685 - protein, 134 aa, Triticum aestivum
MAGDGEDEVPAMGGDKLILRGLQFHGFHGVKQEEKKLGQKFVVDVDAWMDLAAAGDSDDIAHTVSYTDIYRIAKGVVEGPSRNLLESVAQSIAGTTLLEFPQISGVRVKVGKPHVAVQGVVDYLGVEILRSRQA

SEQ ID NO: 686 - protein, 302 aa, Triticum aestivum
MSRGAAASGSLRTALSYCVQQVRSYDYHNYLCLLHLPPAMRKAAFTFRAFNVETAKAMDVVSDPRKGLMRLLWWKDVVDKVCAGKKVEHPVALALSSVLSEHKVSKHWLKRSLEAKINDGNRDEDAIPENVPELERYAEDTQSTILYMTLQAGGIQSTVADHAASHIGKASGLLLLLKALPHHVSKQGKIPYIPASVAEECGLLAREGGRTEVRMGDALPDAVFKVASVAEAHLQKARELATSVPAEAVPVLLPAVPAQVLLDSLRRREFNVFDSRLSSGVHGISPLWYQLKLNWHAWRNKY

SEQ ID NO: 687 - protein, 1228 aa, Triticum aestivum
MAAAAASVGHSSKGGGGRIHRLEVENFKSYKGTQTIGPFFDFTAIIGPNGAGKSNLMDAISFVLGVRSAHLRGAQLKDLIYALDDRDKEAKGRRASVRLVYNLPGTGGELHFTRTITGAGGSEYRIDGRLVTWDDYNAKLRSLGILVKARNFLVFQGDVESIASKNPKELTALLEQIAGSDELRREYDELEEQKTSAEEKSALVYQEKRTIVMERKQKKAQKEEAEKHLRLQQDLKLLKTEHLLWQLYSIEKDMEAIEAELEDDRRSLQQAREDNQSSDNGLAAKRKEQSAFLKKITLCEKSMSKKKVDIDKKQPELLRLKEQISRLKSKIKSCNKEIDKKKDDNNKHLEEMKRLQSALADVTSAIEELNEQGQDKGVKLQLADDQVQEYHRIKEDAGMRTAKLRDEKEVLDKELNADIEAKKNLEENMQQLRSRVDEISSQESELQTKLNKILHSIPKHEDELTRLREDHNKIAKERQSSGAKYLTLKQKVDEIDTQLRELKAVKHESERDARFSETVKSLKRLFPGVHGRMTELCRPSQKKYNLAVTVAMGKFMDAVVVEDESTGKECIKYLKEQRLPPQTFIPLQSIRVKPITERLRTLGGSAQLIFDVIQFDRALEKAVLYAVGNTLVCDKLDEAKTLSWSGERYKVVTVDGILLTKSGTMTGGVSGGMEARSNKWDDSRIESLKKKKSKLEAEMSELGSPRELQRKELAVSEKITGLEKKLHYSNVEQNNLKEKLHKLASEKRNIEKEIDHLEPGKEELESRLAKNEREVRKREKKINEIVDRIYKDFSTSVGVKNIREYEEKQLKDAQALQERKLSLSNQLSKLKYQLEYEQKRDMHAPIAKLNNTHETLEKELKGLQERETRAKADAEHISNQMEELKAEAEDWKLKSDECETAIEELKKQNDSVAAALAKLDRQVKLKEGQIVQLRSRQREIHEKCELEQLKLPTVNDPMDTGSSSQELVLDYNQLSEIYLKEVRLSDRDKLEAEFKQKIGTLMAEIERTAPNLKALDQYEALQTKEKEVSEKFEAARKEEREVADKYNSVKQRRYELFMEAFDHISKGIDKIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCERAGEEQDGDGGCGFQSIVISLKDSFYDKAEALVGVYRDSERSCSRTLTFDLTKYKEA

SEQ ID NO: 688 - protein, 722 aa, Oryza sativa
MGTERKRKVSLFDVVDETSVSAKLGRAATTNGSAAAAAANPSINRWTGRPYSARYLEILEKRRTLPVWQQKDDFLAVLRDNQTLILVGETGSGKTTQIPQFVLEAEGLSNRSMVACTQPRRVAAMSVSRRVAEEMDVTIGEEVGYSIRFEDCSSHKTVLKYLTDGMLLREAMADPLLERYKVIVLDEAHERTLATDVLFGLLKEVLKNRPDLKLVVMSATLEAEKFQTYFSGAPLMKVPGRLHPVEIFYTQEPERDYLEAAIRTVVQIHMCEPAGDILVFLTGEEEIEDACRKINKEINNMGDQVGPVKVVPLYSTLPPAMQQKIFEPAPAPSREGGPAGRKIVVSTNIAETSLTIDGIVYVIDPGFSKQKVYNPRIRVESLLVSPISKASAHQRAGRAGRTQPGKCFRLYTEKSFNDDLQPQTYPEILRSNLANTVLTLKKLGIDDLVHFDFMDPPAPETLMRALEVLNYLGALDDDGNLTPLGETMSEFPLDPQMSKMLVISPKYNCSNEILSISAMLSVPNCFLRPREAQKAADEAKARFGHIDGDHLTLLNVYHAYKQNNEDPQWCYENFINARALKSADNVRQQLVRIMTRFNLKMCSTDFNSREYYVNIRKAMLAGYFMQVAHLERTGHYLTVKDNQVVHLHPSNCLDHKPEWVIYNEYVLTTRNFIRTVMDIRGDWLIDVAPHYYDLSNFPSCEAKRVLERLYNKRERERAANRN

SEQ ID NO: 689 - protein, 439 aa, Zea mays
MASPSFAAAATSPASSPLTLDAIPLASRPAPGAAAAQRKRSVFLLNHRPHPVSPTPPLQPTAAASAQHARRKKTSHPPRPRWQTVLSIAAKNAALLAALLYLGDLAWRWSHPPPPSPPPDRAALEGYAARVDEVEASLTRTFRMIQVQLEAVDRKIDGEVGAARGDLLALLEDKRLALERQLTRLDARAGELGDALAGLKRMEFLRKDEFEKFWDEVKGSLGSSSESEVDLDQVRALAREIVMREIEKHAADGIGRVDYAVASGGGRVVRHSEAYVPKRGFMVWMSGVDVGPKPEKMLQPSFGEPGQCFALQGSNGFVEVKLKSGIIPEAVTLEHVSKDVAYDRSTAPKGCRVYGWYEETPGETQSGHAAKMALAEFAYDLEKNNVQTFDVTAPDVGVINMVRLDFTSNHGSSQLTCIYRLRVHGHEPVSPGSSAGSQA

SEQ ID NO: 690 - protein, 558 aa, Oryza sativa
MAAAAARGAAAARSPLVLHRHPHPAHHRRLRLLPLVAGGGGGSPPRVGRRIRASREKGRRVGIRVFARYSQAQDFSTRLQDRAGELPKLVEDLLQTSISTGPRGAFRFAQGIQAVLGVGGEWLNDFSKTANTSAGIPAQMQLGLLSPLYLRRLFERMGATYIKLGQFVASAPTLFPAEYVEEFQNCFDRAPPVPYSEIESILREELQQPLDSVYEYIDPVPIASASIAQVHGARLKSSQKDVVIKVLKPGIEDTLVADLNFIYVVARILEFLNPELQRTSLVGIVKDIKESMLEEVDFRKEAMNIEAFQRYIDAMGFDRQAKAPFVYRHCSTKRVLTMERLYGVPLTDLDSIRSLVPDPELTLVTALNVWFGSLISCESFHADVHAGNLWLLRDGRVGFLDFGIVGRISPRTWAAMEVFLASFATDDYNAMASALSEMGATGNDINVNEFAKDLEKIFSSIQDLDTEVIVATARTPDATAVSANVVVDERQMNALFLDLVRVSESYGLKFPREFALLMKQLLYFDRYTRLLAPSMNMLRDERVNISSRQQARRVDRFQ

SEQ ID NO: 691 - protein, 253 aa, Hordeum vulgare
ARGDFGVNMQAGFLLFGPPGCGKTLIAKAVAHDAGANFIHIKGPELLNKYVGESESEVRKIFTRARINSPCILFFDEIDALTTKRGKEGGWVVERLLNQLLVELDGADQRHGVYVIGATNRIDVIDEAVLRPGRFGKKHFVPLPGADERVAILKAHTEKKTLSEDVDLETIARREECNNLTGADLASLVNEAAMAALEERCEFLAKGDSSMSTDLTNKIKLQHFEHALSKVKPSVSEQQRKHFDALSKKYSAN

SEQ ID NO: 692 - protein, 222 aa, Hordeum vulgare
EFGTRDGEALSWGAAGGGRLGHGHKSSFLGFAMTSNEYTPRLIKNLDGIKIKRIAAGMLHSACIDEKVLGRSNDAPRPSVVEEIQFSEEVACGGYHTCAVTDRGDLYSWGSNENGCLGLGGTGMVRFPEVVSSSLFKLPVSKVSCGWKHTAVISGEDIYTWGWGGANGTFFEEGHSSGGQLGHGNDVDYCEPMMVELHKNARAVHVSCGFNHTGAILEYAEN

SEQ ID NO: 693 - protein, 320 aa, Hordeum vulgare
RNLNSLAKIMRNRRCERGALTLASAEVKFEIDSETHDPLDIGIYQIREANQMIEEFMLAANVSVAEKILQHYPLCSLLRRHPSPTKEMLEPLLRTASSVGLSLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFRTRPVDTEARIVKIKANGFIVFVPKFGIEGPIYLTAKGDKGADWVVDEVHQKVTKPGTNISYAVLQSVMIHMEVVEPQPHRPKLQLTLI

SEQ ID NO: 694 - protein, 401 aa, Hordeum vulgare
GTRLSLSLSLSLSLSLSLSLELLIEDGLESIAMGCIYTEAKNYPREPAAHVAIRTVRRFLEKQKGKIAGVIFCITSSSDTEIYKRLLPLYFPRDKQEEETAVSKLPADVGDENGETVIDERKIRIRPLPAGAADRTVPAAPLDLPVESGLASRNAFKLDSYLDPSFMSLIKDPDVRRKEQWEKSSQAQKGFNYARLLGYGDIGFPPLSAAEEYSLHSRYLAKANSLNLSEIAEMKIIYRGGVDSEGRPVMVVVGAHFLLRCLDLERFVLHVVKEFEPLIQKPYTIVYLHSAASLQPQPDLGFMKRIQQILGRKHQRNLHGIYMLHPTLGLRTAILGMQLLIDGEVWKKVVYVDRLVQLFRYVPREQLTIPDFVFQHDLEVNGGRGMIVDPRTKHIYQRPSG

SEQ ID NO: 695 - protein, 236 aa, Hordeum vulgare
FYEMEEQQQQMIVKEQLTDGSDHTTASISSENLQQDQETHVVTCDSLTENQLLLMRLLVKDRYLLETAKSIVRVDAPVSFMDDVASAPNWSDKGNELLSDVAREVTRRKGKRSEAMEEVSVARATNPRLRYLDDLVRELDGDVESLDMSKSKSSRHHGDNGAAENLRRILEGDIQNEHPDANSTWDFGWNRVWELPLEKADVVRDLEKNILGGIITDVARDLIGVSVRHGCCPCVA

SEQ ID NO: 696 - protein, 211 aa, Hordeum vulgare
MDMQPSSSDDVGGVLKALQRAKMSLREKLSRASPPRQDMLALPAPEDHYTDDDSQANDTEFSLCMSQRLSHEILALPVSGEYLSRISWPGDDAKIPVGPAGLFRLPTDSFPQNEVCSADGYGSRFSLASSRQTVFSGNPASNSMLTSSRPQYGSGFSPDPYYDLHSSMLLSMPTTRNASFIPEILRSSDDSRRGMSSGDAGMLSQYGNAYD

SEQ ID NO: 697 - protein, 89 aa, Hordeum vulgare
WGFMQGHMWRQDACLVNADGTINDAGQRFINLRQEWTSHARGKIDSDGNFKFRGYHGSYVVQLATATGKMHKAFSVDKGDTPLVLDMDV

SEQ ID NO: 698 - protein, 464 aa, Setaria italica
PARPASRSAAGRLRSPLAPARLLSAPRGPGPGWGGSRARGRIVAAAVAVAGSGLGLWLKPPSLADSGETEAGGQISVAGAGAGAAEARGEKGRFLFADSFRRRVFFNYEKRIRLLSPPEKIFEYFASVRKPEGEVCMLPADLMRAVVPVFPPSESTVVREGRLRGERSPGELHCAPSKFFMLFDTNGDGLISFAEYIFFVTLLSIPESNFSVAFKMFDVDHSGVIDREEFKKIMSLMRSFNRQGATHKDGLRIGLKVGQPVENGGVVEFFFGNDGNEPLHYDKFSKFLKELHDEIIRLEFSHYDVKSSNTIPAKDFALSMVASADMNHINMLLDRVDDLVNDPDLKDMRISFEEFKAFADLRRRLEPLSMAIFAYGKVNGLLTKQDLKHAAQHVCGVDLTDRVVDIIFHVFDTNQDGNLSSEEFLRALQRRETDIRQPTIPGPLGFLSCWFGGRKSSSLRQMVF

SEQ ID NO: 699 - protein, 326 aa, Zea mays
MPRSSAGASCTAVDHSEQSRKDDEYERLVTRAQHATSDVGTTILSEQPKSRSFIWWMKVLLGCFLLILVGYVFVKWGVPFVFEKVLLPIMQWEASAFGRPVLAIVLVASLALFPVILVPSGPSMWLAGMIFGYGWGFLIIMAGSTIGMVVPYWIGSLFRERLHVWLTKWPQQIALIKLAGEGNWFQQFRVVALFRISPFPYTIFNYAVTVTEIKFNPYLCGSVAGMVPEAFIYIYSGRLIRTLADMKYGNYKMTPVEIAYNAISFVIAIALTVAFTVYAKRALGDIKSPDDGIGKDEEDHGPNGSGVRMNRRQERADARYIELDDM

SEQ ID NO: 700 - protein, 263 aa, Zea mays
NSDIHILQHAAFMAGELGFDMVDKVIKALDDAGYHDQTAQKVMVQSTDSSVLEKFKEQTKYDLVYMVNKKVGDAASSSLVDIKRFASAVSVDTGSVFPETHYFTVYETNLVQTLQTAGLSVYVYTLMNEFLSQPYDFFSDATAQINAYVKGALVDGLITDFPATARRYKVNSCMNMGNSTPNFMAPARPGDLMQSISKSAQPPALAPVPPLTGSDVAEPPLPPARSNSSTAPTQSLASRTRACAAHIPALASLAMLCAWLSLV

SEQ ID NO: 701 - protein, 242 aa, Oryza sativa
APKRGAKAPVPARKKAAAAAVNPLFEKRPKQFGIGGALPPRKDLHRFVRWPKAVRIQRQRRVLKQRLKVPPALNQFTRTLDKNLGCQKERLLKRAQAEAEGKTVEAKKPIVVKYGLDHVTYLIEQSKAQLVVIAHDVDPIELVVWLPALCRKMEIPYCIVKGKARLGSIVHKKTASVLCLTTVKNEDKLEFSKILEAIKSNFNDKFDEVRKKWGGGIMGSKSQAKTKAREKLLAKEAAQRMT

SEQ ID NO: 702 - protein, 606 aa, Sorghum bicolor
MDGEEEREEGEVGEYKLQRVVGKGSFAEVHRAAHRRTGARVAVKAIDRRRVDKRVHDGILQEREILRSIDHPNILRLLDTIDTKKMMSLVREYCDGGDLDGFLHKHARLPEAIPKDLMRQLAEGLKVLRGRNIVHRDLKPQNLLLSTNGDAIVLKIGDFGFARSLVHENLAATMCGSPYYMAPEIWQGKDYDAKSDLWSVGVILFQLVTGKLPFTGSNAFQLHQNILAADDLNFPSEIEADLCADCIDLCRRLLQRDPSGKCDESCQAIELRNNCQTITSPVVLKTKSESIESKNSKVFDSWEWIEREYVLVPVNCTSMEMSSLNINKSTKDDTDIRTASYDRPAAKGSAQNQIRDLTDTATGIQSHGCAPVLISQESATVDCRRGKLPDYITRFHSLNQYVLVLTELAREKLSKGLYLEALSIELVLLAIWKEALDACSLLMDASDGENFSKSSQEHSLPMSGHSPLNVVRGLDFTRTASVFSWVESGFMKAYDRAEKISHVLRKSDDNTEMPDAMDVVFQTALEYGKTGAANEVLGHQSRSTALYSKSIILLTFLVQEAPMLPLNPPLSLSPSDQQRIHRYIANLKSHLCCAQVAGQQQRSVYN

SEQ ID NO: 703 - protein, 423 aa, Sorghum bicolor
MTEEPHTVTHPAFPVSVAVSHSHASCSCSLRLPSLPPFALRGRVSPDRNSQETNPARNPPSHRGISSNAPRVPRPSPPMGSLPVPASAECAPQGRATVSASDLAPLFSAQRRHLDHFFDSLDMSQAAAFAQALIDAPGAVFFTGVGKSGIVACKIAQTLASLGFARAGFLAPVDALHGDIGALFPGDVLVLISKSGASDELLALAPCARAKGAYLISLTSAASGAECPLAAACDLNVHLPLQGEVCPFGLAPVTSTAIQMVFGDTVIAAIMEARRLSRDQYASNHPAGKIGKTLIFKVKDVMKKQNELPLCKEGDMIMEQLTELTSKGCGCLLVVDEEHHLIGTFTDGDLRRTLKASGPAIFSLTVGEMCNRNPRTITAEAMAVEAMEKMESPPSPVQFLPVINDNNIVCGIITLHGLVSAGL

SEQ ID NO: 704 - protein, 1248 aa, Sorghum bicolor
METSEAAAAHPQKDSVKVAVNIRPLITAELQEGCTDCVTVTPGEPQVQIGPHVFTFDHVYGSSGPSSSLIFEQCVHPLIDALFSGYNATVLAYGQTGSGKTYTMGTDYSCEGNSGGIIPQVMDTIFRKVDTSKDGSEFLIRVSFIEIFKEDVFDLLDANQAAARPDAGSMAKASAPGRVPIQIRETATGGITLAGVTEAEVKSKEEMASYLTRGSSSRATASTNMNRQSSRSHAIFTICVEQKRISGTSDKSASSDYDIISSKFHLVDLAGSERAKRTGADGLRLKEGIHINKGLLALGNVISALGDEKKRKEGAFVPYRDSKLTRLLQDSLGGNSKTVMIACISPADINAEETINTLKYANRARNIQNKAVVNRDPATAEMQKLRSQLEQLQTELLFSRSGSAALEELQLLQKKVSLLELKNSELNNELKERELSCEQLAERARAAQLERDQLMLKIESARNGKSWDDIENADNDQDMDLLKGYISKVQQLESELMRQNFSNACRHGLNDQLAMERDILLNELGSGCEVGTPDASSEVDEEEKEREHSSMQDQLDKELQELDKRLQQKEEEMKQFAKSDTSVLKQHYEKKLNELEQEKKALQKEIENLRHALTNISSSTDDNAQKLKENYLQKLNALESQVHELKKKQEAQQQLLRQKQKSDEAAKRLQEDIHRIKSQKVQLQQKIKQESEQFRSWKAAREKEVLQLKKEGRRNEYEMHKLLALNQRQKMVLQRKTEEAAAATKRLKELLEAKKSSRETYGGANGSGMQALIRAIDDELEVTVRAHELRSYYERQMQERAAISKEIAKLKEESKHKMSDCPQAMSPSARSSRISALENMLSSSSSAMVSMASQLSEAEERERVFNGKGRWYHVRSLPEAKNIMNYLFQSASSARCQVLDKEVICNEKEHTISELKEKVVVLNSGMRQLETQLMDLRSQNTQLFTALNNAKKSARSNGTGFAQRKSVRSSQHFGCSKDNFINWVDDMDISDGEHSDELESMSDGSDSDWVQSNRKAKKHQRRVSSNSNHKLDCQNTQDNAEPEKPSDEKCILPKNLPSDGCSCSKSSSCKTNKCECRGSGAQCGAGCGCKDSKCSNRDSSSTKEKANQGAMLLQNAFSEKEAQDAKPRKPLANIGNNVVNQTAETEKKPRKNWRKSTVQLVPGPLLPSEPETTEAAPRDRADIPLKLPRAMSSGTPAESNPPPLTDRNAAKPHQSVSTGNKDSTGTAATRPPSQLRKNAATEKENQLR

SEQ ID NO: 705 - protein, 283 aa, Sorghum bicolor
MPPTTMPSTSLALPTAARAGARRHAFFSNRSPSSVPIARRRRAPRFVMVSASASLEALIFDCDGVILESENLHRQAYNDAFANFGVRCPPASADPLYWDEAFYDELQNRIGGGKPKMRWYFGENGWPSSELFETPPSTDTDKEKLVDIIQDWKTERYKEIIKSGTVKPRPGVLRLMDEVKNAERFNGLDCFLAGDDVKLKKPDPTIYITASEKLGVGSKNCLVVEDSVIGLLAAKGAGMSCIITYTPSTASQDFKDAIATYPDLSNVRLEDLKLLLQKTLVTG

SEQ ID NO: 706 - protein, 960 aa, Sorghum bicolor
MDTLKRKAPDGPEAADQASPLKAPRVVAPTSEPPAPTALATAEPVACVHDVSYPEGYDASASTSRAIAGGADASEPARKFPFQLDPFQSEAIRCVDNGESVMVSAHTSAGKTVVALYAIAMSLRNQQRVIYTSPIKALSNQKYREFKEEFSDVGLMTGDVTIEPNASCLVMTTEIWRSMQYKGSEVMREVAWIIFDEVHYMRDRERGVVWEESIVMAPKNSRFVFLSATVPNAKEFADWVAKVHKQPCHIVYTDYRPTPLQHYVFPSGGDGLYLVVDEKGKFREDSFQKALNALVPASDSAKKKENGKWQKVIMAGKSSEESDIFKMVKMIIQRQYDPVILFSFSKRECEFLAMQMAKMDLNEDDEKANIETIFWSAMDMLSDDDKKLPQAKTFSIGLNMPAKTVVFTNVRKFDGDRFRWLSSGEYIQMSGRAGRRGIDQRGICILMVDEKMEPSTAKMMLKGSADSLNSAFHLSYNMLLNQMRSEDGDPEKLLRHSFYQFQADRSLPDLEKQIKELESERNSMVIEEEESLKDYYDLLQQHRSLKKDVHDIVLSPKHVLPFLQPGRLVRIEYSTDEPANFSIDENVTWGIIINFEKVKSHGEDRRPEDSDYTVDVLTRCSVTKDNNGKKTMKVVPLKARGEPVVVSLPLSQIDGLSSIRMYIPKDLLPVEARENTLRKVEEVLSRFAKDGVPLLDPEEDMKVQSKSFRKATRRIEALESLFEKHDIRNSPHIQQKLKVFHAKQELSAKIKSIKKTMRSSTALAFKDELKARKRVLRRLGYVTSDDVVEVKGKVACEISSADELTLTELMFSGALKDATVEQMVALLSCFVWQEKLQDAPKPREELDLLFYQLQETARRVANLQLECKIQIDVESFVNSFRPDIMEAVYSWARGSKFYQIMEMTQVFEGSLIRAIRRLEEVLQQLILASKSIGETELEAKLEEAVNKIKRDIVFAASLYL

SEQ ID NO: 707 - protein, 342 aa, Helianthus annuus
MCLLLLPFIIFLHLLPATIPSAAPPLHPGYYANSCPNAELIVRNVMKKAMIREPRSGASVMRFQFHDCFVNGCDGSMLLDDTPTMLGEKLSLSNIDSLRSYEVVDEIKEALETACPRTVSCADIIIMASRDAVALSGGPDWEVKLGRKDSLTASQEDADAIMPSPRANATTLIDLFAKFDLSVKDLVALSGSHSIGNGRCFSIVFRLYNQSGTGRPDPSIEPKFRQKLDKLCPLGGDGNVTGDLDFTPRIFDNQYFKDLVNGRGFLNSDETLYTYWKTREYVKRYSEDQDEFFRDFVEGMIKMGDLQSGRPGEIRKNCRVVNGGPPMDLVMDGYKDRRILSY

SEQ ID NO: 708 - protein, 278 aa, Solanum lycopersicum
MIISTSSFFSSMKMRCFTLLLFFSSIVAVALASNVEEALISQVVEIHRLRPQTGSAGYTVPQLDCLSWRLAIETNNLQNWRSVPKECTNYLGHYMMGKQYRHDCEYVAKQAIEYAKSLKLSGDGKDVWVFDIDETTLSNSPYYARSDVAFGAKPYNATKFDAWIAEGKAPAIPSILEVYNTVLSLGIKPIFITGTKQNFKQVRIVNLKEAGYTNWAALILKGANDTGSAVKFKSSKRTALVKAGYRIIGNIGDQWSDLIGENVGARTFKVPDPMYYIG

SEQ ID NO: 709 - protein, 672 aa, Solanum lycopersicum
MKSRLGVPFKGISEDIRGRVSCYKQDWIAGIRSGIGILAPTTYIFFASALPVIAFGEQLSRETDGSLSTVETLASTAICGIIHSILGGQPLMILGVAEPTIIMYSYLYKFAKGREDLGQTLYLAWAGWVCVWTALMLFLLAIFNACSVISKFTRIAGETFGMLIAVLFIQEAIKGLVSEFSIPKAEDPSSEKYQFHWLYMNGLLGIIFTFGLLYTALKSRKARSWWYGTGWMRSFIADYGVPLMVLMWSSLSFIVPSNVPSGVPRTLYSPLPWESASLYHWTVMKDMVKVPPVYIFAAIIPAVMIAGLYFFDHSVASQMAQQKEFNLKNPSAYHYDILLLGFMTLLCGLLGLPPSNGVLPQSPMHTKSLAILKKQLIRKKMVESAKESIRQKASNSEIYGNMQAVFIEIDSSPISAVAKELEHLKEAIMKCESDNANDEKSSGIFDPEKYIDAYLPVRVNEQRVSNLLQSLLVAASAGAMPVIKKIPTSVLWGYFAYMAIDSLPGNQLWERMLLLFISPGRRFKVLEGVHASFVESVPFRCIAIFTIFQFVYLLVVFGVTWIPIAGILFPLPFFLLISIRQHLLPKFLHPRHLQELDAAEYEEIAGAPQRALSFSFRETEITLPRTEGEIEICDAEILDELTTSRGEFKVRTISFSEDKRPQVPLDNSFHNY

SEQ ID NO: 710 - protein, 135 aa, Triticum aestivum
MAGDGEDEVPAMGGDKLILRGLQFHGFHGVKQEEKKLGQKFVVDVDAWMDLAAAGDSDDIAHTVSYTDIYRIAKGVVEGPSRNLLESVAQSIAGTTLLEFPQISGVRVKVGKPHVAVQGVVDYLGVEILRRRREA

SEQ ID NO: 711 - protein, 247 aa, Triticum aestivum
MAAAAASVGHSSKGGGGRIHRLEVENFKSYKGTQTIGPFFDFTAIIGPNGAGKSNLMDAISFVLGVRSAHLRGAQLKDLIYALDDRDKEAKGRRASVRLVYNLPGTGGELHFTRTITGAGGSEYRIDGRLVTWDDYNAKLRSLGILVKARNFLVFQGDVESIASKNPKELTALLEQIAGSDELRREYDELEEQKTSAEEKSALVYQEKRTIVMERKQKKAQKEEAEKHLRLQQDLKLLKTEHLLWQL

SEQ ID NO: 712 - protein, 316 aa, Arabidopsis thaliana
MAVSCNHSAILFSPSSTAGSSSVTSSSSLIGFPRFQTLRFKSRSVYSKSRVSSPVSALPLRSLEALIFDCDGVILESENLHRQAYNDAFSHFDVRCPPSSSESLDWSLEFYDKFQNLVGGGKPKMRWYFKENGWPTSTIFDSPPQNDDDRAKLIDTLQDWKTERYKEIIKSGSVEPRPGVIRLMDEAKAAGKKLAVCSAATKSSVILCLENLIDIERFQGLDCFLAGDDVKEKKPDPSIYITAAEKLGVSVKDCLVVEDSVIGLQAATKAGMSCVITYTSSTSDQNFNDAIAVYPDLSNVKLKDLETLLQTIVTAA

SEQ ID NO: 713 - protein, 254 aa, Hordeum vulgare
MRPVFVGNLDYDTRHSELDHLFYRYGRIQRIDMKSGFAFVYFEDERDGDDAIRALDGYPFGPGRRRLSVEWSRGDRGTRRDDRDGYSKPPVNTKPTKTLFVINFDPINTRVSDLERHFGPFGRISNVRIRKNFAFVQFETQEEASKALDATHLTKLLDRVISVEYAFRDDSEPGDKYDRPSRGGGGYGRQDDSSYRRSVSPVYRRSRPSPDYGRPVSPQYGAYGRSRSPVRDRYRSRSPVQRSRSPAPNRRGYD

SEQ ID NO: 714 - protein, 935 aa, Hordeum vulgare
MLQSKSFVKKTKQGRVVKVVREHYLRDDIPCGAFSCPSCDAAARRLNADAAAILVVDTNVVLHQIDLLENPAIEDVVVLSVVLDEVKNKNLSVYNRLKTLCTNTARRFFVFTNEHHRDTYVKEMVGESPNDRNDRAIRVAARWYQSHLGDSAKVLLVTNDRDNKRKATEEGLNAETVESYVRSLAQPGLLDLVVVPSSGDVAMEDVEDLRPSKRKIVYNEHKPMSEITSGLRCGIYHQGKLRVNRYNPFEAYVGSESIGDEIIIRGRSNMNRSFDGDIVAVELLPQDQWHDSKSFIADDDEDDNEEDVRLVPNSADDAPRNTTSTQSTAGSSAASVPSRPVGRVVGIIKRNWNSYCGSLEPMPMPAGSGGVAHALFVSKDRRIPKIRIQTRQLGNLLNKRIIVAVDSWDVMSRYPSGHYVRTIGDIGDKETETEVVLIENDINTRPFSTQVLACLPPLPWTLSPEDVANPNRQDLRHVRVFSVDPPGCRDIDDALHCTPLPNGNFEVGVHIADVTNFVHPGTPLDEEASQRATSVYLVGQRIDMLPKPLTEDVCSLRADVERLAFSVIWEMTPDADIISSRYTKSVIKSCAAMSYVEAQARMDDSRLVDPLTVDLRNLNSLAKIMRNRRCERGALTLASAEVKFEIDSETHDPLDIGIYQIREANQMIEEFMLAANVSVAEKILQHYPLCSLLRRHPSPTKEMLEPLLRTASSVGLSLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAQMASRASVELHTLIYFRTRPVDTEARIVKIKANGFIVFVPKFGIEGPIYLTAKGDKGADWVVDEVHQKVTKPGTNISYAVLQSVMIHMEVVEPQPHRPKLQLTLI

SEQ ID NO: 715 - protein, 182 aa, Hordeum vulgare
MASSKTLLLALCAAAAAATLSPASAADDMTKFKVYFHDVLAGKSPTAIRIAQAASTNSSSTFFGAVVAIDDPLTTSPAVTGSAKSKDEVGRAQGTYTFADQATFGLLMNMNFVFTAGEYKGSSLTIYGRNEVLSAVREMSILGGTGKFRMARGYVQASTVDSGANSGETVVEYTVYVKAAAA

SEQ ID NO: 716 - protein, 306 aa, Hordeum vulgare
MRGIASAGTLHPRPSAAVRSKSNAADRPTLHRRPTLHLRRSPENSLPSIRRSGRLMPPLTAAALATSSGAESFSELASADDFAAIASPDGHISVIGFGSLLSERSARSTFPELEGFRVAALRGFRRVFAHAAPIFFERGIAIEATKEFSSLSVEHCEGEMIVVTVFEIKEEEVPAFIERELEFRFLAVVPEGLDGVPFPNQAVVCARYSDEEYFRVRCKGSKEIYNQHYGRYNIDKIWRDDILPCRLYLRHCVLAAKNLGEAAYSNFLDHTYLGDRRTTIREYLATTGAGIMEEEPPEMLKSRYGG

SEQ ID NO: 717 - protein, 358 aa, Hordeum vulgare
MKLCFCLAVVTLAALLSSEAVVACIDVGFYDRTCPSAETLVQQTVAAAFGNDSGVAPAIIRLHFHDCFVKGCDGSVLIDSTPGNKAEKDSGPNFPSLRFFDVVDRAKAALEAQCPGVVSCADVLAFAARDSVVLSGGLGYQVPAGRRDGRVSTEADALNNLPGPTSTASDLVAGFAAKNLTVEDIVVLSGAHTIGVSHCSSLTERIYNFPNTTDGIDPKLSKAYAFLLKGICPPNSNQTFPTTTTLMDLITPTRFDNKYYVGLTNNLGLFQSDAALLTNATMKSLVDSFVRSEAAFRTRFARSMLKMGQIEVLSGAQGEIRRNCRVINPTNATSAGAVHHHLLPGSSGSSGSNQVAAS

SEQ ID NO: 718 - protein, 691 aa, Hordeum vulgare
MAAVADAATAMTIDFLRARLLSERSVSRAAKDRADQLANRVAELEEQLRSVTAQRREAERAAAEVLAILDSQGFSDAADSVSDDDACGPPEAPDHGTGGQARGEAEDALSGSELGGPPQPGRLSWKGRAASPGADRRHPHLKARQRHGHGHRRSYFYLLGADSSPKYQPGQSCRKIRRKEPRLQTEGGDAKDNAAEGLEEDQAKSDSTVCTDEKLDLDGEVGHGGRGPCGDGRVEDDGGRYAMEDVKDGEMERVLENHAALIGQYEAQENAQREWEKKFNGSRDSTSDDVDRDSKLNQNEKACEQRGRAAQIMDREVVGEETPSRDKDLSGTNSPSECLLNVSAFGLSTNAPNVSVIGKCKGSDNDFERVTAAVATLDELHSRKDELVHKIYTEIIEGGGSNRGRSASSPQKSHSSSPNAGHNEGQGDGNSDNGSSYHVNACSYEHYGTTPSPGSPLSDTPKSKVSEWSSSCFHNHIDNQIDMQPSSSDDVGGVLEALQRAKMSLREKLSRASPPRQDMLALPAPEDHYTDDDSQANDTEFSLCMSQRLSHEILALPVSGEYLSRISWPGDDAKIPVGPAGLFRLPTDSFPQNEVCSADGYGSRFSLASSRQTVFSGNPASNSMLTSSRPQYGSGFSPNPYYDLHSSMLLSMPTTRDASFIPEILRSSDDSRRGMSSGDAGMLSQYGNAYD

SEQ ID NO: 719 - protein, 417 aa, Gossypium hirsutum
MSFSEFRPLDENSLIEYIKATPSLSSKIGHNYDGLKIKEVGDGNLNFVHIIVGPSGSFVIKQALPYIRCIGESWPMTKERAYFEAVALKQHGGLCPEHVPEVYHFDRTMSLIGMRYLEPPHIILRKGLIAGIEYPLLAEHMSEYMAKTLFCTSLLYQSTTEHKRAVAEFCGNVELCRLTEQVVFSDPYKVSEYNRWTSPYLDRDAETVREDNLLKIEVAELKSKFCERAQALIHGDLHTGSVMVTPDSTQVIDPEFAFYGPMGFDIGAFVGNLILAFFAQDGHAGQGNDRKSYKEWILKTIEDTWNLFHQKFTALWDEHKNGSGEAYLPAIYNNPELQKLIQEKYMKELFHDTLGFGAAKMIRRIVGVAHVEDFESIKEANIRADCERRALELGKTLLKRRREFVSISEVISAMKHV

SEQ ID NO: 720 - protein, 516 aa, Setaria italica
MAWARLASRSRLRPAASSAVGQAPRASPPAPPPPPQAGQAARAAPPLRRLLRLPQLHSAATASSASHARRLGDRWQRLGVARRWLASDASAAAEAAELVEVPLAQTGEGIAECELLRWFVNEGDQVDEFQPLCEVQSDKATIEITSRFKGKVHQIHFGPGDIVKVGETLLKMIVGDSQIVSPDNIFPSADKSLEEEPAVPSSEGNIPSGTLSTPAVRHLAKQYGLNINEIVGTGKDGRVLKEDVLNYAVSKGLYKEQSSSLEENIGLIDLLEEGKSLPDVPFYEDKKILLRGYQRAMVKSMSLAAKVPHFHYLEEINCDSLVKLKKAFQNENKDNTIKHTFLPFLIKSLSMALNKYPMLNSSFIEETNEVILKGSHNIGIAMATAHGLVVPNIKKVQSLSILEITKELARLHEMASHNRLSAADIEDGTITLSNIGAIGGKFGSPLLNLPEVAIIALGRIQKLPRFDDDENVYPSSIINVTVGADHRVVDGATVARFCNEWKGLVEEPELLLLHMR

SEQ ID NO: 721 - protein, 471 aa, Setaria italica
MAPLPRAACLLRSAAGRLRSPPPPPARLLSSAAGTGTGVGAGAGREAAIVAAAVAVAGSGLGLWLKPPSLADSGETEAGGQISVAGAGAGAAEARGEKGRFLFADSFRRRVFFNYEKRIRLLSPPEKIFEYFASVRKPEGEVCMLPADLMRAVVPVFPPSESTVVREGRLRGERSPGELHCAPSKFFMLFDTNGDGLISFAEYIFFVTLLSIPESNFSVAFKMFDVDHSGVIDREEFKKIMSLMRSFNRQGATHKDGLRIGLKVGQPVENGGVVEFFFGNDGNEPLHYDKFSKFLKELHDEIIRLEFSHYDVKSSNTIPAKDFALSMVASADMNHINMLLDRVDDLVNDPDLKDMRISFEEFKAFADLRRRLEPLSMAIFAYGKVNGLLTKQDLKHAAQHVCGVDLTDRVVDIIFHVFDTNQDGNLSSEEFLRALQRRETDIRQPTIPGPLGFLSCWFGGRKSSSLRQMVF

SEQ ID NO: 722 - protein, 874 aa, Gossypium raimondii
MAAGNKFARFLHKHTSKITVILVYAVLEWILIFLLLLNSFFTYLITKFANYFGLKPPCPWCSRVDHVLEPNNNNSSNSYRDLVCDKHGSEISKLSYCSSHGKLAETHLMCEECLASRPTPSDGKSIGMARRIAFISWVSGDPKLDNGEKVVPCSCCNGTKLHPPYFLFKPSWGALDCAEKGSLIIQAIEDDDDNDGSESDQCKDGEDMIEIKLNNQDDDDDDDDQNDQRAKTEHQVLFEKDVHEDDRSDAINIAEKHFSSATSGIVEPCFAGDYMLDFINLHHQKCVSDRLFPVELIDLSTSASHFSEKQDNGSETSDSSNEETPLHAIDEIAETITCPREAENLELDHQLEKNDLNLMAERPISETKLLSTQDSDLPLVQVSDPSLQCLREDGFSTFKDQAKGVDAPESSKTQILGFTLGTHEEKSTMDENGERTNASLSVYTDCNNNEAEEEKFPDTPTSSHQGMHYLHNKLLFFEKRESGIEESLDRSVVTAMESGDPVRTIERLKTSLKAERKALSALYAELEEERSASAIAANQTMAMITRLQEEKAAMQMEALQYQRMMEEQSEYDQEALQLLNELMIKREKEKEELEKELEVYRKKVLYYEAKEKTRIMRISKDGSLGSGKSSAACSYAEDSDELSIDLNREAKDEDSSFSGNQESSSDAVGNLEEMALDCVNHVSALDESLTEFEEERLSILDQLKALEDKLLTMGDDQFMEDLKSIQNSFDGLDEKNDLRSKEGNEFSKETSCGKTMASMAKSLLPFLDAADNGTEEGTMYGKQGESDSEPVVMQTYPGPELELDPKKLAIEEEVDHVYERLQALEEDKEFLKNCMSSIKKGDKGMDLLQEILQHLRDLRAVELRTRTLCGDVQG

SEQ ID NO: 723 - protein, 266 aa, Zea mays
MVALTAGISVATGVVFSPAGRRRGRGHAAFRCSSSSAGERQALFSRIAPVYDHLNDVLSLGQHRTWKRICVSWSRAKMGDRVLDLCCGSGDLAFLLSQKVGLDGEVMAVDFSSQQLQTAAGRQEQRWKLCYKNIKWIEGDALDLPFTDCYFDAVTVGYGLRNVVDKPKAMQEIYRVLKPGSRASILDFNKSSSLFTATLQSWAIDNVVVPLASGYGLTEEYKYLKSSISQYLTGEELEKLAREAGFCAAKHYELGGGLMGNLVATR

SEQ ID NO: 724 - protein, 201 aa, Zea mays
MAALGSSVTSRGLALHTSVCVVFLHRRHGNPVIPAAPSRPQRSLASGLTTSSSGMNNAFPIIKGTTRIPAVGPGPANPPGGNLPIPSSMPPWAKWVAGAVILAIPIYRRFRTLEEKTAEVAIEVVDTVAEAAEKVAGEVAGAFPGNDGLREAASKIKTVADEIEEDAEKAEALIEKVDEIKKEVDSIVDPIIDKVVKDKEI

SEQ ID NO: 725 - protein, 325 aa, Zea mays
MEVVVAAKQKAKKHIHLFYCSECEELALKIAASSDAIELQSINWRSFDDGFPNLFINKAHDIRGQHVAFLASFSSPSVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDAENITIAFPDDGAWKRFHKLLQHFPMIVCNKVREGDKRIVRIKEGLPEGRHVVIVDDLVQSGGTLRECQKVLALHGAAKVSAYVTHAVFPKQSYERFMASSSAGPGDQFAYFWITDSCPHTVKAIGQRPPFEVLSLAGSIADALQI

SEQ ID NO: 726 - protein, 120 aa, Zea mays
MHDFCFTIPYGFAVLAGGVLGYLRRGSTASLAGGAGAGALLLLAGFVSLKAFQKRRNSYVALALETLCALALTSVMGQRFLETSKIMPAGAVAGLSAMMSAFYLFKIATGGNHIPPPKKE

SEQ ID NO: 727 - protein, 657 aa, Zea mays
MEMAETLHVLPDDANGSAAVQTEPYCHEDAIEDMESFLDEVNDRVHVSGIVTGAIIKGILSDVRQEAASQIALKDAEISSLNQKLQQPVNGSLSLSEGRDKRHDEFYSLRQQLDSISKLLLNSEWGLSGSQHNFEDSENASKQQDKENSSRNGVAKTIHPGDSKEEVFGDPKLLDHMDKVALIAHFNKSMNEMKRQHDSVLYQRTEEIFKLKREILKKDGSNPFHLRNNKELEQTRKKIEEVISKLDVLLLENKRTSVRVKSNAIPGQQDKNNVLGSETEQLESGASNNEDYHCSIPTHSSHFASREADHELNIVRPQFDVEDVRIAVTFREEIERIIIKEFISEINIELHGYEIEGDMKQEVCSIVHNEAIAKAMSNIDSLLLKYEEKKGHAEEESLHKQKIEKLKLVVDSFTEVLSEKEKFVSQIGLEAMQTRVESMCCELDLLRDKVAKQDSYLSEKNREFGAIMGRLEQAQQHVQHNDVTLVELNDRLRTISNSLKDLEKQNQALHYVIEEKEKMLTSAVSKDNDMREFMENLVKSIKYFEIVMMNQQAVVANKVEHHESRFCLLKEQCKHLAKEGNLLRKKALRYKEISDTRGSNLHKAELEVDLLGDEVEALTDLLAKIYTALDHYSPVLRHYTGVMETLNMIKKHISMAK

SEQ ID NO: 728 - protein, 309 aa, Zea mays
MDRGQNGRDDVFGRRDPFSGFGFGPHRSLFSGLLGGRDPFDDPFFTHPFGGRMMGDHDMFVPSPFGPMGGPFGDMRNGGFIEQAPPRGNRRRPVITEVEEDGGENAEHGNQQPNQDPYVQEPDDGIDETEGGQVELHRDLSRANSGGQPQARTFTYQSSSVTFGGINGAYYTTSKSRRTGSDGITVEESKEADTTTKEATHRISRGIHDKGHSLTRKLNSDGKVDTTQTLHNLNEDELAGFEQSWKGNAGHYLPDWNHNAGAPNSDNSGDRSSNGRDRRPASGWALPGTEQGRDPRRNGKPKSRVIPIS

SEQ ID NO: 729 - protein, 277 aa, Zea mays
MVSTSSTPHPLDPSVPAVVGGGKEEEEEAVESCAAAAATPLPPVGIDDEEEGPRRVRKPYTITKSRESWTDPEHDKFLEALQLFDRDWKKIEAYVGSKTVIQIRSHAQKYFLKVQKNGTGEHLPPPRPKRKAAHPYPHKSSKKALQVVLPQQVSHIMEQGCGTPMDVATVATDSSVNNAFPVQHFSPRHTQAMPDFARVYNFLGSIFDPETNGHLQKLKEMDPIDAETVMLLMKNLSINLTSPNFEEHRRLLSSDASSMDQKSGSSRVHLPFMITSK

SEQ ID NO: 730 - protein, 171 aa, Zea mays
MLSSTSLAALLHGRPHYPFPPSKAHLFLALPNNPTRFLASASVRVAYPPRWPLRAADGERDNRVQELRVPDSWLTPAGATQESEWLRETLRKWLDDEYCPEPANVDISSTAARSYRESLIARQSDLGEILLRMVGDLDKLSYRESFHGPFSAANAAVRLIAQRMEESLPDE

SEQ ID NO: 731 - protein, 343 aa, Zea mays
MASTAFAAAKYFPAHLDSSPRIAPRRAAPTASLSFSPLSASPSSLLRLRTPCPSGPGGRLPPPPPPPPRSYGGGGGSGGDAANSGGGRRGGGILGLFLAGWAARVAADPQFPFKVLMEELVGVTACVLGDMASRPNFGLNELDFVFSTLVVGSILNFVLMYLLAPTAAASSAASALPSHMFEPGAFSLGSRVATLVSKGATFAVVGFAAGLAGTALSNGLMAMRKRMDPAFETPNKPPPTLLNAATWALHMAGSSNLRYQTLNGVEYMLGKVAPAPVFKASVVVLRCLNNVLGGVSFVLLARLTGAQKSDKPATVAEEKDRLIAVGNAAADAIGEARDGEEGK

SEQ ID NO: 732 - protein, 685 aa, Zea mays
MDLDMDGYVDPYEEAAAEGDSDDPDEDDSDAESDYEEKSFGLLKSGKHRVRNPDGTFRCPFCLGKKKQGYKIKDLLQHADGIGVSSKHRRHGRERANHRAFARFVRTDPSFAEDLVGITGIQGAITTTPANENYSANGNGKAKANVDTAGSSSVAAKVGPPQEVERFAWPWACVLAAGAGFNAEDFVGRVALFSSVEVVPLFVDEMEVTETFAIVRFTNDWSGFNDALTIENYFSVNKLGKKEFQMRDSGLGSVEGDGEGDVKVYGWVARAEDYDATTVVGRFLRKHTVLQTIDEVSKTELEKSGEMVAILASQIEEKNRYLQDLETKKNATELSISRLEEDNRKLHEAYNEEMRNLHRRARENALRIFQENENLRIDLENKRRELNLRAKELEKMSAENANDRKTLDDQKQKTKYDNSELELASIEQQRADADVLKLLADQEREKEDVLARMLQLEKELHEKQQLELEVERLNGTLQVMKHLEGDDDGGDIHEKMEKLSERFEREKKRLEDLSGDLVTKERESNDELQQARKELIKGLEEELNGRTAVGIKRMGELDEKPFLNACKRKYGNSEYQVKAAELVTNWQEELKNPSWYPFKMIHVDGEDKEILVDDDTKLKFLWIEFGDDVCNAVKTALMEINEYNPSGRYVVPELWNFRKGRKATMKEVLKYLFSQMDTTTKRRRG

SEQ ID NO: 733 - protein, 333 aa, Zea mays
MISTAHSRQQHHAFEKSPGNSHMKSIDRKLQQAMSQAASKYMQRIYPLGMQRSSSSLTLSSLSLSQNSNDSSISSSNASWEPKVPLLYAGTFSPWGDVMVSREMRREDDDKVSDHDVEGGEEDLDCSEPGSLRRCSWITKNSDEAYVQFHDECWGVPVYSDNRLFELLSLSGMLIDHNWTEILKRRDMYREAFADFDPSAVARMEEEDVAEISGDRELRIAECRVRCIVENARCIQRVAREFGSFSGYMWGHVNHRPVVGKYRHHKYIPFRTPKSEAVSKDLVRRGFRLVGPVIVYSFMQAAGMAIDHLVDCFRFHDCVRLAERSWGITNVAA

SEQ ID NO: 734 - protein, 58 aa, Zea mays
MDKANKLSTGAGEKATKSRSHGSTALFVAVDYAFLLVFAGFLAYLVGSRILPSAAGSA

SEQ ID NO: 735 - protein, 407 aa, Zea mays
MAAPAQAQVMPLLRWSRSASFLCASSRRLFSALHRPAAAARCEAGSKAMLKGMDYSELENWVQAQGFRPGQAMMLWKCLYGNNVWAHCYDELAGLNKDFRKMITEHADLKALTMKDIHIASDGTRKILFSLEDGSVIETVIIPCARGRTTICVSSQVGCAMNCQFCFTGRMGLRKHLSTAEIVEQAVFARRLFSDELGSINNVVFMGMGEPFHNIDNVIKASAIMVDEQGLHFSPRKVTVSTSGLVPQLKRFLQESNCSLAVSLNATTDEVRNWIMPINRKYNLNLLLGTLREELNLRQKQIVLFEYVMLSGVNDSMDDAKRLIELVQGIPCKINLISFNPHGGSQFKPTPDDKIIEFRNVLIQGGLTVFVRLSRGDDQMAACGQLGEPGGYKLPLLRVPEKFQVAL

SEQ ID NO: 736 - protein, 247 aa, Zea mays
MPLLAVCPRRVPPLSLARRHRRSLYRARSLALKCEVSSPPLLLTRRMSAAGSLLVAVVPVPAPSPQLPVASASELETETAEGESGASEGLALERYTDQEQGFTLLKPASWPKVEKAGATALFQQEGKGSNNIGVVVNPVRLNSLAEFGTPQFVADRLLQAEKKKESTKSAEVISVGERSGHGGLTVYEIEYTLDSTRGGMKRIFSGAFVASRKLYLLNIAYSDTQEKPLDRETRTVLEKVLHSFDSV

SEQ ID NO: 737 - protein, 264 aa, Zea mays
MEVTSSPSPSAPPPASSKPALQLNPAAVLLRRLPTPTPTAATPVTATAPPARPATASNPLAALLVPFWRGLRRAPKQPVHPASAAAARRAAEQQEAEAEARQLVGCAVPLFRPYVAQLPWHGGARAWLSKLFPRYGHYCGPNWSSGKEAGSVLWDRRPVDHLDFCCYCHDMAYDTHDQAQLLRADLAFLRCLEGSRHTPARDGIAAAAIYRAMCIFGLKTILIPYRTNLVRLQTGPNYADFFADFVKRVASSSGRPTGGEKQRL

SEQ ID NO: 738 - protein, 190 aa, Oryza sativa
MGPPPAAAAAVDGVGVGVGAHSVFVYGSLMQDEVVRTIIKRVPPSSPALLPNYHRFNIKGRIYPAILPVQSKKVAGKVITGVTDAELQILDEFEDVEYVRTRVEISLTDTSETMLADTYVWADAEDPNLYGEWDFEEWKRLHMKDFLAMTHGFMDGLEQPESKSRVETYQSFMQEIQQPGTTTTTTQVEI

SEQ ID NO: 739 - protein, 688 aa, Oryza sativa
MGGVCSAGIPGDRSPAELSFRAMGLVVEQELKAFPAVAGKVQGKHKTAPVEVAPEPDPPRRLSPEKAPRLSTGGGGGKARRSVSKEPQLVRSSSEKLKAGKSRTSTSGKASDKGSVFGRASTSGIGKAVEVLDTLSSSMTNLSPVGGFVAGAKMKGSPQKILAFEVANTIVKGMSLMQSLSKESVRYLKGTVLRSEGVKRLVSSDMSELMRIAAADKRQELALFSREVIRFGNRCKDTQWHNLDRYFSKLESEITPQPNLKEIAEAEMQQLLTLVRHTADLYHELHALDRFEQDYRRKLEEEKKSVAFERGDTVQIIRQELKSQRRHVKSLKKKSLWNKMLEDVMDKLVDIVHFLHVEIQESFGTYDGALQLNQPSESRQTLGSAGLSLHYANIISQIDNIVSRSTVPPQSTRDALYQGLPPTIKSALRKKLHNCPQPQEVPITEIRSSMERTLQWIIPIANNTARAHHGFGWVGEWANTGNDAMRRAAGQPDVIKIETFYHADKAKTEACILDLVLWLHHLISYSRPSNGGRSRSPSRSPVRSPPLTPPHQVPTTTSSSSPPPPAVARPSGGTGGGLTREDRAMLQDVYAGRRRRAPGHSRSQELSSARGGGGAGGDSSSAVAAAAQLSKNDRLSKSSNDAPARSGGGGGGGKLFPLSRRPSSAVVSPAVDFDIDGIKALADAQKRQ

SEQ ID NO: 740 - protein, 472 aa, Oryza sativa
MADEEHAPTSRKRVAGTQINKDNPEPDDDSTEQEMGTFKRASEEVMATRRIVKVRRQQPSSAPSNPFSAIRFTPSDTSAQATIPVSEPQPSDVITADAKDSSSEKADEGSNGSGKDALPVTDKSAGSSEVAETEKDGSDLKGSDEKAKSSDSIEPPSQPVETTDEAKDLGGGSVVAGEAKEDNSKASDIEDKTAKEGDAEEEDGANEAGAEDKISKGDDEKKDGDESETKDGSSEEQKDADNKGQSSSPTPLFSFKNLSSGQNAFTGLAGTGFSGSSFSFGSGSKESSSAPLFGLKTDGSSFPSFSIGASNNGSSSPALATSAEAPKKFAMPEGPVETGEENEKAIFTADSALYEYLDGGWKERGKGELKLNIPVSGGERSRLVMRTKGNYRLVLNASLYEDMSLKDMDKKGVTFACMNSIGDSQSGLATFALKFRDTSIREEFKAAVEMHKAKKASGTLKTPENSPKASDD

SEQ ID NO: 741 - protein, 397 aa, Oryza sativa
MRMAAPQQVHVRAAPLARALRTRVAAAAASASSPERALLGLSEPDLRQLAVDLGQQSYRGKQLHDLLYKSRAKQIQEFSHVPKVFREALVGAGWKVGRSPVHHAVTASDGTTKILLKLEDNRLIETVGIPVDDDKGPSRLTACVSSQVGCPLRCSFCATGKGGFARNLHAHEIVEQVLAIEETFQHRVTNVVFMGMGEPMLNLKSVLEAHRCLNKELKIGQRMITISTVGVPNTIKKLASHKLQSTLAVSLHAPNQKLRETIVPSAKSYPLEALMDDCKNYFLETGRRVSFEYTLLAGINDAKEHAEELAELLHTCGGGYHVNLIPYNPIQGSEYKRPYRKVVQAFVDALEARKITVSVRQTRGLDANAACGQLRNEFQKNPLLESSPSSEPNLLPA

SEQ ID NO: 742 - protein, 242 aa, Oryza sativa
MAAAGSIGVYKAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGNLSQRKSSFVIIGRIIFSILGAMMAAVVIYTVITDGLPFRKDLLTPWMAATLLDFYINVFAISVWVAHKESNWISTAIWICLLICFGSITTCGYIVIQLFQVSYQDPIYHVLLNTRNKYDIVPSQ

SEQ ID NO: 743 - protein, 261 aa, Oryza sativa
MAPKRGAKAPVPARKKAAAAAAAVNPLFEKRPKQFGIGGALPPRKDLHRFVRWPKAVRIQRQRRVLKQRLKVPPALNQFTRTLDKNLATNLFKMLLKYRPEDKAAKKERLLKRAQAEAEGKTVEAKKPIVVKYGLDHVTYLIEQSKAQLVVIAHDVDPIELVVWLPALCRKMEIPYCIVKGKARLGSIVHKKTASVLCLTTVKNEDKLEFSKILEAIKSNFNDKFDEVRKKWGGGIMGSKSQAKTKAREKLLAKEAAQRMT

SEQ ID NO: 744 - protein, 544 aa, Sorghum bicolor
MAAKKQLPQAVAAASGHTKMGEEKLIIRSEKVRFIDVLSMLFLRRPITSYAFVEAGDRTAADFGSTPGDWLVALTQLIQKALDAAYYPALVIGAVVEFLLNFVALNNGILGIFLNIFRCKLVIPHRDAPNFRSMIGLIDGRTELKPLPAGGGPEDRRLQVVGVSAAGSDDYYVNVESGGGGTGTAAVPLVQQQYVNGRLIRLRTFSVFEVSMMAAKIAYENAAYIENVVNNVWKFHFVGFYNCWNKFVGDHTTQAFVFTDKANDASVIVVSFRGTEPFNMRDWSTDVNLSWLGMGVLGHVHVGFLKALGLQEEDGKDAAKAFPKAAPNAVAGKPLAYYTLREELRAQLKKHPNANVVITGHSLGGALAAIFPALLAFHGERDILDRLLSVVTYGQPRVGDKVFAAYVRGNVPVEPLRVVYRYDVVPRVPFDAPPVAEFAHGGTCVYFDGWYKGREIANGGDAPNPNYFNPRYLLSMYGNAWGDLFKGAFLWTKEGKDYREGAVSLLYRATGLLVPGIASHSPRDYVNAVRLGSVVVAGKEEEVV

SEQ ID NO: 745 - protein, 202 aa, Sorghum bicolor
MPSPTPPPMSTPHKSCSSPSPPPPKLQRAPDIRHRPICGGACRLPITRRAHAASLLLLGLAPAPAPVRAEEDGSGGEEGVLGAIKSIFDPNEKTKAGKTLPKAYLKAAREVVRTLRESLEEDDGGDMARFRRNADAAKESIREFLGGWRGQQTVAAEESYVALEKAIRSLAEFYSKAGPFAPLPQDVKNKILDDLSAADACL

SEQ ID NO: 746 - protein, 400 aa, Sorghum bicolor
MAANGKSSLANGASSTQGKPINCKAAVAWAPGEPLVMEEVEVAPPGRLEVRVRVLFTSICHTDLSFLKGENELQRKFPRILGHEAAGVVESVGEGVQDLAPGDHVVPIFNGECGACAYCESDKTNLCGTYRVNPFKSTMSSDGGTRFSVVDRNSGLRQPVYHFLNTSTFAEYTVLDAACAVKINPKAPLHKMCLLSCGISTGVGAAWNTANISAGNTIAIFGLGAVGLAVAEGAKLRGAARIIGVDVNPEKFAKGKDMGVTDFVNSKACDKPVHEVIREMTDGAGVDYSFECTGINDVLREAFLSTHDGWGLTVVLGIHATPKMMPLHPMELFDGRRITGCVFGDVKGKSQLPAIVDKYVNGDLNINFDGFITHNMPFSDISKAIQLLEEGKSLRCVLHL

SEQ ID NO: 747 - protein, 416 aa, Sorghum bicolor
MAYTSSLHLPKHLLLPSPRRTRHRRPSSFVPVSAAANKINGGVNGHHAPEKPALPNGKAPQHINGHVNGHGKKGVNGHVNGRHAGNNRIHLSVSTGGGGGQDGSGLRVAFQGAPGAYSEFAAKTALPGCETVPCRAFADALAAVERGAADRAVLPVESTMEGTALRNYDLLLRHGLVVVQEINLFVHYCLLAMPGVRAAEVRRVISHPMALAHCGRALARLGVDPEPVEDTAGAVEMLRSGRMLDTAAIASPRAADLYGLDVLAHGLQDESWNVTRFLLLSRPSAVAALPVDAAAGGATKTSMVVAHRGGSMMVVLKVLSAFSSRGINLTKLEVINNDGAAAADAGSGARPPVVILDTSARGKPTLRAFPHVLYVDCEGAAHDPRVREAIQEIETFAVFVRVLGCYAADSTVYDLQ

SEQ ID NO: 748 - protein, 871 aa, Sorghum bicolor
MAASAGKLAAALHRRTRRVTSALAYAALEWVLIALLLINGVLAYAIARFADYFGLSPPCLLCSRVDRLFLQAEGGDAEAGAARWLRDALCGDHAAEISALGYCLRHHRLAEAGEMCDGCRSEWKEKTSDAAGACTCCKAIVRTSLREQEDTITRDQHVLEKITEEVEDDDQGYVLLAQDDHEEDEEEPDEVESQEQEQQSEVEGQQQEDEVMASVQDESLEFMDQVEDITAIGDDRLVSVVALDEMTIADDSGLHRDVEEEDGVNRVVEDEQDSRDVDIGVVLEEKRMLDSSVATPADVIEDSVMPISPVPCPEILTNPSHPDHNSISQDDGDVPEDTAEIGDSTAEEEHIFVPQEANFEDDNRTAEVDTNCEVSIGSDICEREQDDHVVPFQDLAAFEEPVSPLSAADDLPLPLEILDPTEQEEAGEVEQEEVTTSTGLDLQPNEQSEIEEDKAPETPTNSAATQRSDRMFLLERKRSLSLSLDGSVASEMEGGEPSTVDQLKSALQAERKALGALYAELEEERNAAAIATNQTMAMINRLQEEKAAMQMEALQYQRMMEEQSEYDQEALQLLNELVTKREREKQELERELELYRQKVQHYEDRERRRTASFKANGVSVSPSGSGTSVSSSGEESDGHSDDYCELGESPDVGNVQSSSDAALGSMRDQEGTKHLAALDDSLTYFEMERLSILEELKTLEERLFTLEDDDTNTGKQAIGHSSIDFDLSAGGLQSPDYILSGDKARIGGRASISRGKSLLPLFDAVGDETCDQMPSAGVGEADQDDDSATKPVSVLVKEQERLAIIEEVDHVYERLQALEADKEFLRHCIKSLKKGDKGMDLLQEILQHLRDLRNVELHVKNAGDAIAANSA

SEQ ID NO: 749 - protein, 622 aa, Sorghum bicolor
MDGEEEREEGEVGEYKLQRVVGKGSFAEVHRAAHRRTGARVAVKAIDRRRVDKRVHDGILQEREILRSIDHPNILRLLDTIDTKKMMYLVLEYCDGGDLDAFLHKHGRLPEAIAKDLMRQLAEGLKVLRGRNIVHRDLKPQNLLLSTNGDAIVLKIGDFGFARSLVHENLAATMCGSPYYMAPEIWQGKDYDAKSDLWSVGVILFQLVTGKLPFTGSNAFQLHQNILAADDLNFPSEIEADLCADCIDLCRRLLQRDPKERISFEEFFNHKFLATRKCDESCQAIELRNNCQTITSPVVLKTKSESIESKNSKVFDSWEWIEREYVLVPVNCTSMEMSSLNINKSTKDDTDIRTASYDRPAAKGSAQNQIRDLTDTATGIQSHGCAPVLISQESATVDCRRGKLPDYITRFHSLNQYVLVLTELAREKLSKGLYLEALSIELVLLAIWKEALDACSLLMDASDGENFSKSSQEHSLPMSGHSPLNVVRGLDFTRTASVFSWVESGFMKAYDRAEKISHVLRKSDDNTEMPDAMDVVFQTALEYGKTGAANEVLGHQSRSTALYSKSIILLTFLVQEAPMLPLNPPLSLSPSDQQRIHRYIANLKSHLCCAQVAGQQQRSVYN

SEQ ID NO: 750 - protein, 366 aa, Sorghum bicolor
MEPALRELWAESRDLLGLPSSSLDAAAAAAVPRVDLPPTPLAFLRDHVSPGRPLLVSAAATRHWPAVSLWPTASYLTDALRSTAVSLHLTPDGRADALASHPRRPGGPGPSRCFASAHVRRVDFPTAVRLIRASDPAAGLVAYAQQQDDCLRGEYAAVAGDVDAHVPWASEALGCLPEAVNLWIGNAHSVTSFHKDHYDNIYVVVSGEKHFLLLPPTEHHRLYVREYPAAHYVAAEQDSEGEHQLRLKLEMEEPERIVPWSSVDPCPASPEEMAVQASSFPLYFDGPAPMRCTVRAGEMLYLPSMWFHHVSQSPGPNGLTIAVNYWYDMQFDIKYAYFNFLRSLDIDGCSSGKAGALEGDLEEKKD

SEQ ID NO: 751 - protein, 506 aa, Sorghum bicolor
MGKGAVVGTAVVVGAAAAAAVGVAVVSLSRRRRRRREAEDERKRKAAAVIEEVEQRFSTPTALLRGIADAMVEEMERGLRAEPHAPLKMLISYVDNLPTGDEQGLFYALDLGGTNFRVIRVQLGGRDKRVVKQQYEEVSIPPHLMVGTSTELFDFIAAELEKFVRTEGEDFHLPNGKHRELGFTFSFPVHQTSISSGTLIKWTKGFSINGTVGEDVVAELSRAMERQGLDMKVAALVNDTVGTLAGGRYADNDVVTAVILGTGTNAAYVEHANAIPKWTGLLPRSGNMVINMEWGNFRSDKLPMSEYDKSLDFESLNPGEQIYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLSDFSQQRTVVAIDGGLYEHYKKFSACLEATLTDLLGEEVASSVVVKLANDGSGIGAALLAASHSQYAEVA

SEQ ID NO: 752 - protein, 757 aa, Sorghum bicolor
MATPVPAEADAGEARELLYEAYNELQALASELGGAAVAPAVVVVGHQTDGKSALVEALMGFQFNHVGGGTKTRRPVALHLRFNPRCDEPQCRLLSATGDADEHDEAGVAARPMPLADIQAYIEAENLRLENDPCQFSEKEIIIKVEYKHSPNLTIIDTPGLILPAPGRKNRVLQSQASAVERLVRAKIQHKETIILCLEDCSDWSNATTRRVVMQVDPDLARTVLVSTKLDTKIPQFARPSDVEVFLHPPTCVLDVSLLGDSPFFTSVPSGRVGSCHEAVFRSNEEFKKAILSREMEDIASIEDKLGRSLTTKERDRIGVGNLRLYLEELLQKRYVESVPLIIPLLEKQHRNTTSKLREVSHELSDLNEAKLKEKAQLFHDSFLTKLSLLLKGMVVAPPDKFGETLVNERINGGTFTGSENFQLPNKMMPNGGMRLYGGAQYHRAMAEFRLVVGSIRCPPITREEIVNACGVEDIHDGTNYSRTACVIAVAKARDTFEPFLHQLGFRLLYILKRLIPICVYLLEKDGEGFSSHEVLVRRVQEAFKRFAESTEQSCRQRCMEDLESTTRYVTWSLHNKNRAGLRHFLDSFVAPEQLSVNTLNEQFSGLNDNKQDRAKGDSKSNHSDTNSSSAVPETRLVDLLDSTLWNRRLVPSSERLVYALVHQIFLGIKEHFLVTTELKFNCFLLMPIVDKLPALLRQDLESAFEEELDSIFDVTQLRQSLGQKKRELEIELKRIKRLKDKFGEINKKLNSLQVRQ

SEQ ID NO: 753 - protein, 188 aa, Sorghum bicolor
MASTSSSYPLLLLLLLLAAPAAAAAEASVGVGIVGGGNATTTTSSSPTAYEMLERYDFPRGILPAGVSGYELRGDGSFEVYFPRRCEFLLAGTWLVRYEPRVRGSVAAGSLTALDGISVKVLFLWLGVGEVDRAGDTLSFYIGPVATSFPLDDFAESPRCRGYDYDGDGDGAAAGDDLFPAAAVAASS

SEQ ID NO: 754 - protein, 225 aa, Glycine max
MINHALCFLVFLSALHATHAVEYTVTNNALSTPGGVAFRDKIGAEYAKRTLDSATQFIWRIFQQNNPSDRKNVQKVSLFVDDMDGVAYTSNNQIHLSARYVGNNKGDVKTEITGVLYHEMVHVWQWSGNGRAPGGLIEGIADYVRLKANYAPSHWVKAGQGQKWDQGYDVTARFLDYCDSLKSGFVAQLNKLMRTGYSDQYFVQLLGKPVDQLWRDYKAKYGNIA

SEQ ID NO: 755 - protein, 130 aa, Helianthus annuus
MASTVTIFIILFLTIATVFTSNTEASSVDFVKKTVSSHPIVIFSKSYCPYCKRAKGVFKELNVKPYVLELDEREDGSKIQDALSEMVGRRTVPQVFINGKHLGGSDDTVEAYQSGELAKLLGIESHKTDL

SEQ ID NO: 756 - protein, 434 aa, Helianthus annuus
MGEWVIGAIINLFGSIAINFGTNLLKLGHDERDRHAMLGEGIDGKTILRPIISFQSWRIGILFFAFGNALNFISFGYAAQSLLAALGSVQFVSNIAFAYFVLSKTVTVKVLVATIFIVLGNTFLVAFGNHQSPVYTQEQLAEKYSNITFLFYCLFLVVVVVMHHYVYRRGELLLAIPEKELTPYWKLLLPFSFAVVSGAVGSCSVLFAKSLSNLLRLSMSSSYRLDSWFTYSILVLFLCTAGFWMARLNEGLSQFDAILIVPMLQIAWTFFSICTGFVYFQEYQVFDALRTVMFILGMISVFIGISLLAPDDSKGEVKDSPSPSSKVNTDVERLIEDSSIKDMKSLARAMATKASAAVIRAKSACTLLLGMGDDTMHASSVFAMPMVSSKMTGFRAVNGDRSKLLSLRSPSGWNRIPVVEETVNMMDSMSSEED

SEQ ID NO: 757 - protein, 427 aa, Helianthus annuus
MEEITNGGNKNEPQLLKLKCSVQNYDWGRIGYDSRVATLFEKNCGVQIDEKKHYAEFWMGTHVSGPSVVDAGDGDNVSLKVWIVQNPKVLGDVVVDKWGVDLPFLLKVLSVGKSLSIQAHPDQELAGFLHKTQPNVYKDANHKPEMALALTEFEALCGFISSEELDVVLETVPEINEVVGNASANQILTVDKHIGELKEERALQSIFTKLMSVDQEVISEALSKLVNRLTHEKEKRRLTSKEELVLKLEKEYPNDVGVLAALLFNHVKLEPGDGLYIAANEPHAYLNGECIECMAASDNVVRAGLTPKYIDVKTLCSMLTYKQGLPEILKGVPMNQYVRRYTPPFEEFEVDQCVLDQGASVVFPALPGPSVFVVISGEGTMATSSREDRVSEGDALFAPAGTEVHVSTDTELQLYRAGVNHKVLLNP

SEQ ID NO: 758 - protein, 503 aa, Helianthus annuus
MPFLDSLTAISLLLFVTVLTVHASVHNYAGVKFARKGNAYVVHGGSEGIYYSHPNLNGSDASSNGDAYIKFEEIIFRRPQEASNFSTGMIYAILFEVDDRETIGGSAYGGQRAICCTADLAKLGACKEGEVIHRLSTSNPGWPEIFGVSFDVNDETSTMQPRSVQITRTGMYNLYFMHCEPRLADMVVEGKTIWKNPNGYLPGRMAPLLNFYGFMSLAFLVLGIFWFSQYARFWKEVLHLQNCITLVITLGMLEMALWYFDYAEFNESGVRPTGITIWAVTFGTIKRTISRLIILTVSMGYGVVRPTLGGLTSKVVMLGGTFFLASEVLELVEHVGAVSDFSGKAILFLSLPVAVLDAFFVLWIFTSLSSTLNKLQAKRMMAKLDIYRKFTNALAVAVIVSVGWICYELYFKSTDIYNEQWQNAWIIPAFWHVLSFSLLCVICALWAPSQNSMRYAYSDDGSEEFDKDDTLTLIKPSPVPISAKDVGDVRSEDDVDLEEDKTE

SEQ ID NO: 759 - protein, 366 aa, Helianthus annuus
MHPLYNKVKNTLHKTLPSKPFLGIMCLLLLPFIIFLHLLPATIPSAAPPLHPGYYANSCPNAELIVRNVMKKAMIREPRSGASVMRFQFHDCFVNGCDGSMLLDDTPTMLGEKLSLSNIDSLRSYEVVDEIKEALETACPRTVSCADIIIMASRDAVALSGGPDWEVKLGRKDSLTASQEDADAIMPSPRANATTLIDLFAKFDLSVKDLVALSGSHSIGNGRCFSIVFRLYNQSGTGRPDPSIEPKFRQKLDKLCPLGGDGNVTGDLDFTPRIFDNQYFKDLVNGRGFLNSDETLYTYWKTREYVKRYSEDQDEFFRDFVEGMIKMGDLQSGRPGEIRKNCRVVNGGPPMDLVVDGYKDRRILSY

SEQ ID NO: 760 - protein, 297 aa, Helianthus annuus
MGLPFRSLTMLLLLLLIWWSTSEAQTLRALDAILQDYAYRAFHRPRTGRPYDGVPPANLSGIQISALRLRSGSLFTRGVRQYKQFSIPVGVIGTPYVERLVLVYQNLGNWSTTYYPLPPGYMYLAPVLGLLAYDASNLSATNLEELDIYASEDPISIEFTQVQPVRDARCVWFDLDGRINFTKVVSGNKCLTYEQGHFSIVVESTAPSPAPVPQPHQGGGGKGWIIGGSVLGGVALLVLLALLILWVWRFNKRKKVHKMEKAADAGEALHMTAVGNTKAPAATTTRTQPSLETEYVP

SEQ ID NO: 761 - protein, 359 aa, Solanum lycopersicum
MEATRSCSQAHLPLQSISFPPQFYKKFQFTKSKPSNSHPRLVIAKVLGTGDNGDFEHFTATPNKIFMEEAIGAEYGEGFETFRPNGLLKVDVDFLNDRLQEGFLRRIRYAMKPDEAYGLIFSWDNVVADSRALMLDAWNQLASEEGLELPEDDSVQRLLLYATADHILHKALAGEKNEADQDRLKTRLSHLYQDKLLKISEPIEGLKEWLDAVSTARIPCAVVSSFDRRNMVEALERMGLMKYFQAIVTEEDGMESIAHRFLSAAVKLDRKPSKCVVFEDDPRGITAAHNCTMMAVALIGAHPAYDLGQADLAVGSFSELSVINLRRLYAHKGSNFMDLEKQIAEKAPRRRKLTIDTIF

SEQ ID NO: 762 - protein, 265 aa, Solanum lycopersicum
MRCFTLLLFFSSIVAVALASNVEEAVISQVVEIHRLRPQTGSAGYTVPQLDCLSWRLAIETNNLQNWRSVPKECTNYLGHYMMGKQYRHDCEYVAKQAIEYAKSLKLSGDGKDVWVFDIDETTLSNSPYYARSDVAFGAKPYNATKFDAWIAEGKAPAIPSILKVYNTVLSLGIKPIFITGTKQNFKQVRIVNLKEAGYANWAALILKGANDTGSAVKFKSSKRTALVKAGYRIIGNIGDQWSDLIGENVGARTFKVPDPMYYIG

SEQ ID NO: 763 - protein, 346 aa, Solanum lycopersicum
MGGGEEDQQKLKNTAAAAYDYENDPRWADYWSNILIPPHMASRSDVVDHFKRKFYQRYIDPGLVVEPMATSSSSQPAKPSVAQPSSSSSTPSNNQPRQRNSGQASRTSGTPTTPTSNPTSLRWDRNTIQFSVNAWVFVVAVLSIFPLTPANLSNRAYRLSFLGTACSSLYSLYSVYGKPRAWNLQAVQVWFQSVIVTKDFISFIYCLTFVTSHLYLKFSLIPVLCRSLEHVGKFLRRNFGRSSLYRKYLEEACVWVESNVTTLNILSSQAEIGLGFLLVVSLLSWQRNIIQTFMYWQILKLMYHAPATAGYHQNVWAKIGGLVNPVVQRAPFLNTPISTIQRWWFR

SEQ ID NO: 764 - protein, 529 aa, Solanum lycopersicum
MANNAAACAERATSDMLIGPDWAINIELCDIINMNPGQAKDALKIIKKRLGSKNPKIQLLTLFVLETLSKNCGENVFQQIVEREILRDMVKIVKKKPDLNVREKILILIDSWQEALGGPGGRFPQYYAAYNELKAAGVEFPPREENSVPLFTPPQTHPIVHTPSAYEEAAVEASLESDPSGLSVAEIQSAEGLSDVLTEMLGALDPKNPQSVKEEVIVDLVEQCRSYQKRVMILVNNTVDEDLLCKGLALNDNLQRVLRRHDDIAKGTSTITVPPRETPVAPLMNVNHEDDESEDDFSHLSRRTSRDPSQGQGRKTIDVKSEPMRITPTLPPPPSSRRPVFTDGKMVDYLSGDRFESERSMGTEGSSPIAASTNSNNASFIPWSSPKPSSSAPPPDDLLNPTADENFLNPTASMFTGKNNQNESNSKAKSADNLPPAPWDAPPPTAIPPPPARYDQRQQYFEKHVSGGSPPARTGSSSYDSIVGQTKNLSINSSSPSKPEKPEDALFKDLVDFAKAKSSSSSNQSNRSF

SEQ ID NO: 765 - protein, 225 aa, Triticum aestivum
MKLQVATVASFLLVALAATAQAVTFDASNKASGTSGGRRFEQAVGLPYSKKVLSDASAFIWKTFNQRGVGDRKPVDAVTLVVEDISGVAFTSANGIHLSAQYVGGISGDVKKEVTGVLYHEATHVWQWNGQGRANGGLIEGIADYVRLKAGFAPGHWVKPGQGDRWDQGYDVTARFLDYCDSLKPGFVAQLNAKMKSGYTDDFFAQILGKNVQQLWKDYKAKFRG

SEQ ID NO: 766 - protein, 429 aa, Triticum aestivum
MKLPLSAGSPDAAPELAKPSLPATWLILHALFCATSMAVGFRFSRLVVFLLFLPTPPMNPSAHLVSLVTPPVMLASSNTTATITTTTTTTTTVTTTTTLAESEAGANAHHQVHHGPVFVGRHAIRVRKWPHPNPGELLKAHSILAAVQEAQRRSRNRMADPLRPVIAVTPTTTSALQAPSLTSLAHTLRLVDAPLRWIVVEPGHRTDAVAAVLARSGLDFLHLVASDGPSTARLRMHALREVRKEKMDGVVVFADENGILRTELFDEAQKVKSVGAVPVGILGEDEGTKESFLQAPACDEAGKLVGYHVSEETLLPAARSDMLLSTRLEWAGFVVNARVLWESASERPEWVRDLDAVDGGAHLDSPLALVTDAGQVEPLARCARAALAWSLRSDALHEVKFPHEWKFDAPLVSAASRQQSSVVNTEDGH

SEQ ID NO: 767 - protein, 715 aa, Triticum aestivum
MAALAAAAAFAGLLLALAPVVGADTDAAGVSALGNLYTSWNSPAQLVGWSAAGGGDPCGAAWMGVSCSGSAITSINLSGMGLNGTLGYLLPSLVALTTMDLSNNSLHDVIPYQLPPNLIHLNLARNNFSGNIPYSISNILSLGYLNVSHNSLFQEIGELFGGLNSLSVLDLSFNNLSGNLPVSFVSLSNLSSLYMQNNQLSGTVNVLSNLSLTTLNIANNNFSGLIPGELSSIPDLSAGGNSFINMPASPPPIIMPPSESPLAQPDRPRVPTTFPNGPEDEIPIDEGDKKQGRQTGLLVGLAVGSVAAASCILFALVFCLHSVHKRKDGGTSELKDFVGALAVNIDRDSNNNIHLDSPVAASVLQRPIGTPERAYGVNSSPAKKIKVPGAATSYTVASLQVATNSFCQDTLLGEGSLGRVYRADFPNGKVLAVKKIDSAALSLYEEDHFLEVVSNISRLRHPNIVSLTGYCADHGQRLLVYEHIGNGTLHEMLHFSDEANKSLSWNARVRIALGTARALEYLHEVCLPPVVHRNLKSSNILLDEECSPHLSDSGLAAFSPNPEREVSTEVLGSLGYSAPEFAMSGTHTVKSDVYSFGVVMLELLTGRKPLDRSWERSEQSLVGWAIPQLHDIDALAKMVDPAMDGMYPAKSLSRFADIIALSVQPEPEFRPPISEVVQQLVRLMQRASMLRRQSGDDLGSSYRAPEREGGAWDAV

SEQ ID NO: 768 - protein, 134 aa, Triticum aestivum
MAGDGDEERPAMGGDKLILRGLQFHGFHGVKQEEKKLGQKFVVDVDAWMDLAAAGDSDDISHTVSYTDIYRIAKGVVEGPSRNLLESVAQSIAGTTLLEFPQISGVRVKVGKPHVAVQGVVDYLGVEILRSRQA

SEQ ID NO: 769 - protein, 302 aa, Triticum aestivum
MSRGAAATGSLRTALSYCVQQVRSYDYHNYLCLLHLPPAMRKAAFTFRAFNVETAKAMDVVSDPRKGLMRLLWWKDVVDKVCAGKKVEHPVALALSSVLSEHKVSKHWLKRSLEARINDGNRDEDAIPENVPELERYAEDTQSTILYMTLQAGGIQSTVADHAASHIGKASGLLLLLKALPHHVSKQGKIPYIPASVAEECGLLAREGGRTEVRMGDALPDAVFKVASVAEAHLQKARELATSVPAEAVPVLLPAVPAQVLLDSLRRREFNVFDSRLSSGVHGISPLWYQLKLNWHAWRNKY

SEQ ID NO: 770 - protein, 1228 aa, Triticum aestivum
MAAAAASVGHSSKGGGGRIHRLEVENFKSYKGTQTIGPFFDFTAIIGPNGAGKSNLMDAISFVLGVRSAHLRGAQLKDLIYALDDRDKEAKGRRASVRLVYNLPGTGGELHFTRTITGAGGSEYRIDGRLVTWDDYNAKLRSLGILVKARNFLVFQGDVESIASKNPKELTALLEQIAGSDELRREYDELEEQKTSAEEKSALVYQEKRTIVMERKQKKAQKEEAEKHLRLQQDLKLLKTEHLLWQLYSIEKDMEKIEAELEDDRRSLQQAREDNQSSDNGLAAKRKEQSAFLKKITLCEKSMSKKKVDIDKKQPELLRLKEQISRLKSKIKSCNKEIDKKKDDNNKHLEEMKRLQSALADVTSAIEELNEQGQDKGVKLQLADDQVQEYHRIKEDAGMRTAKLRDEKEVLDKELNADIEAKKNLEENMQQLRSRVDEISSQESELQTKFNKILHSIPKHEDELTRLREDHNKIAKERQSSGAKYLTLKQKVDEIDTQLRELKAVKHESERDARFSETVKSLKRLFPGVHGRMTELCRPSQKKYNLAVTVAMGKFMDAVVVEDESTGKECIKYLKEQRLPPQTFIPLQSIRVKPITERLRTLGGSAQLIFDVIQFDRALEKAVLYAVGNTLVCDKLDEAKTLSWSGERYKVVTVDGILLTKSGTMTGGVSGGMEARSNKWDDSRIESLKKKKSKLEAEMSELGSPRELQRKELAVSEKITGLEKKLHYSNVEQNNLKEKLHKLASEKRNIEKEIDHLEPGKEELESRLAKNEREVRKREKKINEIVDRIYKDFSTSVGVKNIREYEEKQLKDAQALQERKLSLSNQLSKLKYQLEYEQKRDMHAPIAKLNNTHETLEKELKGLQERETRAKADAEHISNQMEELKAEAEDWKLKSDECETAIEELKKQNDSVAAALAKLDRQVKLKEGQIVQLRSRQREIHEKCDLEQLKLPTVNDPMDTGSSSQELVLDYNQLSEIYLKGVRLSDRDKLEAEFKQKIGALMAEIERTAPNLKALDQYEALQTKEKEVSEKFEAARKEEREVADKYNSVKQRRYELFMEAFDHISKGIDKIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCERAGEEQDGDGGCGFQSIVISLKDSFYDKAEALVGVYRDSERSCSRTLTFDLTKYKEA

SEQ ID NO: 771 - DNA, 2151 bp, Arabidopsis lyrata
catgtggctcttttgcatgttctgtcataaacccgtccatttcattcttcctcatcttctatcctctgttttttctcttcttcttctctgttttagtggctgaggtcgtttgtattggtgaaacagaatttaaaacaagtagggcaatctttaactctggccgacacatcaacggattcggcggtggtcggatcaagaagtgcttcctttttttccggcgtcatttcttcttttaaattcatcgatttggtgctctcccaacttccaatagattacggctaatttaaaaaatttcttcgggatttttgagtctgttcacaaaatgaagatatttccatgctttgctggattgatccgtagaaagaaaaataaggggaattcaaaacctctgcctccgaaaacgcagagaatccttcagatcagacttgaagagccagtgaagcctctggagaatgatgagcctaacatcgcaggctacgacaagggcagtcctattaagcacgagccatatgacggcgaagatgaacgtgacgacaaggattcaacgaaccgtgagtttcctgaattccaagttcatgaacgagccgttgaatctctgaaaagcaaggaggaagtcacagatacttctgaaaacggcgatgatgacgacgacgaaggaggtcatgtcagcgatcccggattaggcagagccacgtcttgggtgacttctcctaagcttaaacgatcttgctccactctcagcaagttcaatggccggtttcatggttctgatctccatgacctgagagagaccgttccagttagtaatgaatcagtgaagtcccataaaagtgcagatagagtgatgctcaagaaacactcgtcgatgcagatacttccttcgggtagccggcggctctggtggaaattgttcctctggagccataggaaccttcacaaacaccgtgtttcgctaaagtcacagcctttaaacaagcaccatcagtctggatacacctctgactttgctgagcacaaccaatctagccatgaagaagaatctacaaacaattgcgccgatttcaccaaccaatcatccaacttgtggcctcgtcataaccagtgggtagcgttctctgccgaatcatcttcaatgaagcgagtggacgagtgggtaagaggactcgatgttgaaaccgccgcagtacccataaacgaggatagagacgtcttggccagcttcccaacctctcccaatacagagagatcaccctttggaaatgtggttcaatccggaaatgtcacagaggctatagtgcacgcaaatagccttattcagtctatgagcaaatcctcaagcgtggctcacatatcgagtatcggcttgaaagctatcccgtgcatctcacattttaccagcctcaagtcgattgatctttcaaacaacttcatagttcaaattactcctgcatcgcttccaaagggcctgcacgcgttgaatctttcaaagaacaagatcagtgttatcgaaggactgagagatttgacacgcctaagagtactcgatctcagttacaaccgaatttctcgcattggacaaggtttatcaaactgtacactgatcaaagaactatacctagctgggaacaagatcagcaatgtagaaggcttacacagattgctgaaacttatcgttcttgatcttagcttcaacaagatcgccaccaccaaagcaataggccagcttgttgccaactacaactctcttgtcgctttgaacatcctcggaaacccgattcagagtaacgtaggcgaggaccagctacgaaagaccgtctccagccttctccctaagctagtttatcttaacaagcagctcatcaagccacaacgagccagggaagttctcaaagatagtgtagcgagagctgcgtttggtggtggagattctttgcaccacaggcgcaaaagaacatccaccaataaagttgtgggagcagcctcccctagcgttcaccaccgaggccacattgcaaaaggacgtggttccaaaaaccgaagccaacatcagctaagaaaaacttcagctgcagagtcaccattacattgacattttttttctttacttgtatgaatcttatcttatgaattggccaatgcaaattgcaaaga

SEQ ID NO: 772 - DNA, 963 bp, Arabidopsis lyrata
actacctaacccaaactcaattcgacgttaagaaaacgtgtcgcgtcttctggtctcagctaccaaattcgagaaagagtgatcggaaaacaatcatcggcgatgggttggtataccagtttcatagcagcgttggcgttcttagccgtcggagttatattctctccggagacattcggatcgctgtcgaatggagagaattcggagaagctttcgatattcctgaagctagctcatctactcagtttcgccacagcttggggagctgctctctgggctaccttcatcggaggaatcatcatgttcaagaatttaccgaggcatcagtttggtaatcttcagagcaagatgtttccagcttacttcactttggttggttcttgctgcgcaatttcactctctgcttttggttatttgcatccatggaagtcatcttctactgtcgacaagtatcagctaggctttctcctatccgcttttgctttcaatctcaccaatttgtttgtcttcactcccatgaccatcaatatgatgaaggaaaggcacaaagtagagagagaaaacaacattggagatgaagttggttggtccaagaacagagaaaaggcaaagaccatccctaagctagctgccatgaacaagaagtttggaatgattcacgggttgtcatcgcttgctaacattttctcatttggcagccttgctatgcattcttggtatctagcagggaagttgaatctttagtttcctcaatactcatcttttcacaaaggtctgatcttttatgccccccttactgaataaatctcttgcatttcgtcgccaatccctttgtaagattctgtcagttggacaagactccaaagagtgaaatcatgaaagaatttgttatccctttttctcttatactaagatagttgctgtcttttctgaaaattattgatgtgtgtgatagattctatt

SEQ ID NO: 773 - DNA, 2435 bp, Brassica rapa
gttcggtgtatgcgttaacagttaggggtactgtcgtaaatgcgatagctacctacccagcttcgacgtgaacaaaacgtgtcgcgtctagtatcttgtaacttgtaagcagagactttactcagctacatcaatttcatctgatcggaaaccatcatctcggcgatgggttggctgacgagatttctaacagcggtagcgtttttagccgccggagttatattctcaccggagacattcggatctctgtcgaagggcgagaatccagcgaaggttttgatattcgtgaagctagctcatctcctcagcttcgctacagcttggggagctgctctctgggctaccttcatcggcggaatcatcatgttcaagaacttaccgaggcatcagttcggtaacctccagagcaagatgtttcccgcttatttcactctcgttggttcttgctgcgccatttcactctctgcgtttggttacttgcatccatggaagtcatcttctaccgtggagaagtatcagcttgggttccttgtctccgcttttgctttcaatctcaccaatttgctcgtcttcactcccatgaccatcgatatgatgaagcaaaggcataaagtagagagagagaacaacattggagatgaagttggttggtccaagaacagggagaaggcaaagactatccctaagctagctgccatgaacaagaagtttggtatgattcacggcttgtcatctctagctaacatcttttctttcggaagccttgccatgcattcttggtaccttgctgggaagttggatctctaagtttctttgtcacaaaggtctgaactttttttatgtcacccttcatgaataaaatctcttgctttgtaaaatcgtgaaacagtttgctatggtaatataaaactagatgttccctttttcactggaataattgatgtgtgaatgcgattacagaataacatggctaagttttacttaaagaaactaaaaaaatgttcgtgtgaatggtggagtaatacaccatagacactcgtagttaacaatctaattgggagaaagaagatgatcactagttgactactccctgacgcgacgaatctagctatgagtttcaaggaatctctcccagtacatataatgtttacgattaagaacttggcccgccattgatctcgttcagtctttatctgcttcagctccttgcggatcacgtgcctcaatgctttcaggtaagagctcatgtcatggtttcttttgatttttccttcagacccgtaagagcgacggtcgctgagaatctctagagggtgcggtgagttaaagaacactgtctttgctgcccttagtcctttatctgtttcatcggtgttcttagatgttaggacatagagaccacttcctggtggaaggagagggtgtgggggagagaatctctcggatggttgtaggattagaagctttcccattggagaatacaatagattctgcagaaaaagacataagagtaagcgaagaaacgatggtctggatcaaaacagcttgacgttacctggttattcagacaaggatggttgcggaagtttttattcaacgccttgagaagctttgcggctcgattagggtaactgcaagagaacgctcgaggaacaatatctctatgcatcgagatcccaagaagatgactcttaggcaacccgagtttctcaagaagcctgtcgcctccgcacatgatgcaaggtgaaccaaatgtgatcaccggaagcagagaagaagccgggacttgacctctgatcagaagcattaggttcaccaacagcgacaagcttcctcctagagagtgtccgctgaaccgaagaaaagcacggttcttgccacgagaattgaggtgagcgtgaacttcaggtaacatctgttcgtagattcctttcgcagcttcgtatatgcctctgtggacaggtacatcaaagtcctcgaatgggactggctcaaagagaaggttagcttgccatgaggccaacgagtcggatccctgtaaaagaagatgataagcttatcttttggccaataatctcaagacaccattaaaagagcaaactacctgaataaagaagaacctggtgctagttttatcatcgtcgcatacgaaccactcacaaggcggtgaatggttggacttgagatcatcggccaccgcctgcttgacttcctcttccgctgccacgacggctgtaacggaatcagcggtggccattagagaagcttcgttctctcgacgtccaaaaggaagcacagatttcgaatgggagaagagacgagatgctgcagaagcagctattctgtaagcagcagctggattgataagcttctcctcctcctcctcctcattgctattctcatcctgttggtcaagactcgatctcttctcaatt

SEQ ID NO: 774 - DNA, 836 bp, Brassica napus
gatctcgtaacttgtaagaagggaactttactcagctacatcaatttcaactgatcggaaaccatcatcatcggcgatgggttggctgacgagatttctaacagcggtagcgtttttagccgccggagttatattctcaccggagacattcggatctctgtcgaagggcgagaatccagcgaaggttttgatattcgtgaagctagctcatctcctcagcttcgctacagcttggggagctgctctctgggctaccttcatcggcggaatcataatgttcaagaacttaccgaggcatcagttcggtaaccttcagagcaagatgtttccagcttatttcactctcgttggttcttgctgcgccatttcactctctgcgtttggttacttgcatccatggaagtcatcttccaccgtggagaagtatcagcttgggttccttgtctctgcttttgctttcaatctcaccaatttgctcgtctttactcccatgaccatcgatatgatgaagcaaaggcacaaagtagagagagagaacaacattggagatgaagttggttggtccaagaacagggagaaggctaagactatccctaagctagctgccatgaacaagaagtttggtatgattcacggcttgtcatctctagctaacatcttttctttcggaagccttgccatgcattcttggtaccttgctgggaagttggatctctaagtttctttgtcacaaaggtctgaactttttttttattgtcacccttcatgaataaaatctcttgctttgtaaaatcgtgaaacagtttgctatggtaatataaaactagatgttccct

SEQ ID NO: 775 - DNA, 802 bp, Brassica napus
ctcagctacatcaatttcatctttggagaagagtgatcggaaactatcatctccgcgatgggttggctgacgagatttctaacagcggtagcgtttttagccgccggagttatattctcaccggagacattcggatcgctgtcgaagggcgagaatccagcgaaggttttgatattcgtgaagctagctcatctactcagcttcgccacagcttggggagctgctctctgggctaccttcatcggcggaatcatcatgttcaagaacttaccgaggcatcagttcggtaaccttcagagcaagatgtttccagcttatttcactctcgttggttcttgctgcgccatttcactctctgcgtttggttacttgcatccatggaagtcatcttccaccgtggagaagtatcagcttgggttccttgtctctgcttttgctttcaatctcaccaatttgctcgtctttactcccatgaccatcgatatgatgaaacaaaggcacaaagtagagagagagaacaacattggagatgaagttggttggtccaagaacagggagaaggctaagactatccctaagctagctgccatgaacaagaagtttggtatgattcacggcttgtcatctctagctaacatcttttcttttggaagccttgccatgcattcttggtaccttgctgggaagttggatctctaagtttctttttacaaaggtctgagcttttatgcctcccttcatgaataaaatctcttgcattgtaaaatcgtgaaacagtttgctatgataatataaaactaga

SEQ ID NO: 776 - DNA, 981 bp, Eutrema parvulum
cttacctactcaaattcgacgtgaacaaaacgtgtcgcttcttgcgtctctgaagactctctcgctcaccgaccgactattttgttttcgagaagagtgatcggaaaataccatcggcgatgggttggctgacgagatttttagcagcggtagcgtttttagccgccggcgttatattctcaccggagacattcggatcgctgtcgaatggcgagaattcggcgatgcttttgatcttcctgaagctagctcatctactcagcttcgctacagcttggggcgctgctctctgggctaccttcatcggcggaatcatcatgttcaagaacttaccgaggcatcagttcggtaaccttcagagcaagatgtttccagcgtatttcactctggttggttcttgctgcgcaatctcactgtctgcttttgggtatttgcatccatggaagtcatcttctgctgtggaaaagtatcagctagggtttctcctatcggcttttgctttcaatctcaccaatttgttcatcttcactcccatgaccatcgatatgatgaagcaaaggcacaaagtagagagagaaaacaacattggagatgaagttgggtggtccaagaacaaggaaaaggcaaagactatccccaagctggctgccatgaacaagaagtttggtatgattcacggtttatcatcgctagctaacatcttttcatttggaagccttgctatgcattcgtggtatctagcagggaagatggatctctaagtttctctcttttactcatccggagatgcttgtcacaaaggtctgagcttttatgcccctttaatgaataatctcttgcctttctttgccaaccccttttgtaagattatatcagtaggagcatattatagtgaaatcatgaaagaacttgctacaataatatcgctctttccctttattgttccttcttctttgaaataattgatatgtgaattctatt

SEQ ID NO: 777 - DNA, 1256 bp, Brassica juncea
gaagagtgatcagaaactatcatctcggcgatgggttggctgacgagatttctaaccgcggtagcgtttttagccgccggagttatattctcaccggagacgttcggatcgctgtcgaagggcgagaatccagcgaaggttttgatattggtgaagctagctcatctgctcagcttcgctacagcttggggagctgctctctgggctaccttcatcggcggaatcatcatgttcaagaacttaccgaggcatcagttcggtaaccttcagagcaagatgtttccagcttatttcactctcgttggttcttgctgcgccatttcactctctgcgtttggttacttgcatccatggaagtcatcttctgctgtggagaagtatcagcttgggttccttgtctcggcttttgctttcaatctcaccaatttgttcgtcttcactcccatgaccatcgatatgatgaagcagaggcacaaagtagaaagagagaacaacattggagacgaagttggttggtccaagaacagggagaaggcaaagactatcccaaagctagctgccatgaacaagaagtttggtatgattcacggcttgtcatcgctagctaacatcttttctttcggaagccttgccatgcattcttggtaccttgctgggaagttggatctctaagtttctttgtcacaaaggtctgaacttttatgcccccttcatcaataaaaatctctttctttgtaagattattataccagaaggagaagaactgttccttttttcaacactagatgttcctttttctctgaagtaattgatgtgtgaatactattacagaacagtgtgcctaagtttttacttaaagaaactaaaaaaatgtgcgtgtgaatggtggaatataacaccatagacactcgtagttaacaatctaattgggacaaggaagatgatcactagttgactactccttgacgcaacaaatctagctatgagtttcaaggaatctctcccagtacatataatgtttacgattaagaacttgaccttccattgatccctttcagcctttatctgcttcagttccttgcggatcacatgcctcagtgctttcaggtaagagctcatgtcatggtttcttttgatttttccttcagacccgtaagagcgacggtcgctgagaatctctagagggtgcggtgagttaaagaacacgctctttgctgccctcagtcctttttctgtttcatcggtgttcttagatg

SEQ ID NO: 778 - DNA, 810 bp, Brassica napus
agctacaacaatttcatctttggagaagagtgatcggaaaccatcatcatcggcgatgggttggctgacgaggtttctagcagcggtagcgtttttagccgccggagttatattctcaccggagacattcggatctctgtcgaagggcgagaatccagcgaaggttttgatattcgtgaagctagctcatctactcagcttcgctacagcttggggagctgcactctgggctaccttcatcggcggaatcatcatgttcaagaacttaccgaggcatcagttcggtaacctccagagcaagatgtttccagcttatttcactctcgttggttcttgctgcgccatttcactctctgcgtttgggtacttgcatccatggaagtcatcttctattgtggagaagtatcagcttgggttcctcgtctccgcttttgctttcaatctcaccaatctgctcgtcttcactcccatgaccatcgatatgatgaaacaacggcacaaagtagagagagagaacaacattggagatgaagttggttggtccaagaacagggagaaggctaagactatccctaagctagctgccatgaacaagaagtttggtatgattcacggcttgtcatctctagctaacatcttttcttttggaagccttgccatgcattcttggtaccttgctgggaagttggatctctaagtttctttttacaaaggtctgagcttttatgcctcccttcatgaataaaatctcttgcattgtaaaatcgtgaaacagtttgctatgataatataaaactagatgttcttttt

SEQ ID NO: 779 - DNA, 940 bp, Eutrema halophilum
ctacctactcaaagtcgacgtgaacaaaacgtgtgcgcgtcttgtgtctgtctttgaagactctcagcgataattttcgagaagagtaatcggaaaaaccatcggcgatgggttggctgacgagatttctagcagcggtggcgtttttagccgccggaattatattctcaccggagacattcggatcgctgtcgaaaggcgagaattcggcgaagcttttgatcttcctgaagctatctcatctactcagcttcgctacagcttggggcgcggctctctgggctaccttcatcggcggaatcatcatgttcaagaatttaccgaggcatcagtttggtaatcttcagagcaagatgtttccagcgtatttcactctggttggttcttgctgcgcaatttcactgtctgcttttgggtatttacatccatggaagtcatcttctgctgtggagaagtatcagctagggtttcttctatcggcttttgctttcaatctcaccaatttgcttgtgttcactcccatgaccatcgatatgatgaagcaaaggcacaaagtagagagagaaaacaacattggagatgaggttgggtggtctaagaacagagaaaaggcaaagactatccccaagttagctgcaatgaacaagaagtttggaatgattcacggcttatcatcgctagctaacatcttttcatttggaagcctcgctatgcattcctggtatcttgcagggaagatggatctctaagtttctctcttttactcatctctctctccccgtagattcttgtcacaaagcttttatgcccctttaatgaataaatctctcgcattttatttgccaactatatcagtacgagaagactccctacgtatttcactgaaatcttgaaatcttgaaagaatcttgaataaatctctcgctttttttggtgccct

SEQ ID NO: 780 - DNA, 683 bp, Brassica juncea
gggacatcaattctaattttggaggaagagtgatcggaatcatcatctcggcgatgggttggctgacgagatttctagcagcggttgcgtttttagccgccggagttatattctcaccggagacgttcggatcgctgtcgaagggggagaattcagcgaaggttttgatattggtgaagctagctcatctgctcagcttcgctacagcttggggagctgctctctgggctaccttcatcggcggaatcatcatgttcaagaacttgccgaggcatcagttcggtaaccttcaaagcaagatgtttccagcttatttcactcttgttggttcttgctgcgccatttcactctctgcgtttgggtacttgcatccatggaagtcatcttctactgtggagaagtatcagcttgggttccttgtctccgcttttgctttcaatctcaccaatttgctcgtcttcactcccatgaccatcgatatgatgaagcagaggcacaaagtagagagagagaacaacattggagatgaagttggttggtccaagaacagggagaaggcaaagactatcccaaagctagctgccatgaacaagaagtttggtatgattcacggcttgtcatctctagctaacatcttttctttcggaagccttgccatgcattcttggtaccttgctgggaag

SEQ ID NO: 781 - DNA, 813 bp, Brassica oleracea
  misc_feature (66)..(66): n is a, c, g, or t
  misc_feature (192)..(192): n is a, c, g, or t
  misc_feature (222)..(222): n is a, c, g, or t
  misc_feature (291)..(291): n is a, c, g, or t
  misc_feature (294)..(294): n is a, c, g, or t
  misc_feature (363)..(363): n is a, c, g, or t
  misc_feature (392)..(393): n is a, c, g, or t
  misc_feature (395)..(395): n is a, c, g, or t
gctacaacaatttcatctttggagaagagtgatcggaaaccatcatcatcggcgatgggttggctnacgaggtttctagcagcggtagcgtttttagccgccggagttatattctcaccggagacattcggatctctgtcgaagggcgagaatccagcgaaggttttgatattcgtgaagctagctcatctnctcagcttcgctacagcttggggagctgcnctctgggctaccttcatcggcggaatcatcatgttcaagaacttaccgaggcatcagttcggtaacctncanagcaagatgtttccagcttatttcactctcgttggttcttgctgcgccatttcactctctgcgtttggntacttgcatccatggaagtcatcttctanngnggagaagtatcagcttgggttcctcgtctccgcttttgctttcaatctcaccaatctgctcgtcttcactcccatgaccatcgatatgatgaaacaaaggcacaaagtagagagagagaacaacattggagatgaagttggttggtccaagaacagggagaaggctaagactatccctaagctagctgccatgaacaagaagtttggtatgattcacggcttgtcatctctagctaacatcttttcttttggaagccttgccatgcattcttggtaccttgctgggaagttggatctctaagtttctttttacaaaggtctgagcttttatgcctcccttcatgaataaaatctcttgcattgtaaaatcgtgaaacagtttgctatgataatataaaactagatgttcttttttttc

SEQ ID NO: 782 - DNA, 702 bp, Brassica juncea
gaagaagagactttgctcagctacaacaatttcatctttggagaagagtgatcagaaactatcatctcggcgatgggttggctgacgagatttctaaccgcggtagcgtttttagccgccggagttatattctcaccggagacattcggatctctgtcgaagggcgagaatccagcgaaggttttgatattcgtgaagctagctcatctactcagcttcgctacagcttggggagctgctctctgggctaccttcatcggcggaatcatcatgttcaagaacttaccgaggcatcagttcggtaaccttcagagcaagatgtttccagcttatttcactctcgttggttcttgctgcgccatttcactctctgcgtttggttacttgcatccatggaagtcatcttctaccgtggagaagtatcagcttgggttccttgtctctgcttttgcttttaatctcaccaatttgctcatcttcactcccatgaccatcgatatgatgaagcaaaggcataaagtagagagagagaacaacattggagatgaagttggttggtccaagaacagggagaaggctaagactatccctaagctagctgccatgaacaagaagtttggtatgattcacggcttgtcatcgctagctaacatcttttcttttggaagccttgccatgcattcttggtaccttgctgggaag

SEQ ID NO: 783 - DNA, 946 bp, Raphanus sativus
  misc_feature (39)..(40): n is a, c, g, or t
  misc_feature (122)..(122): n is a, c, g, or t
gggcgtcttgtatctcgtaagcagagagactttactcannagtcttacacaacaattttattttcggggaaagagtgatcatcggaagcatcatctcggcgatgggttggctgacgagattnctaacagcggtagcgtttttagccgccggagtaatattctcaccggagacattcggatcgctgtcgaagggggagaattcggcgaaggttttgatattggtgaagctagctcatctactcagcttcgctacagcttggggagctgctctctgggctaccttcatcggcggaatcatcatgttcaagaacttaccgaggcatcagttcggtaaccttcagagcaagatgtttccagcttatttcactcttgttggttcttgctgcgccatttcactctctgcctttgggtatctgcatccatggaagtcatcttcttctgtggagaagtatcagctagggttccttgtctcggcttttgctttcaatctcactaatttgctcgtcttcactcccatgaccatcgatatgatgaagcaaaggcacaaagtagagagagagaacaacattggagatgaagttggttggtccaagaacagggagaaggcaaagactatccctcagctagctgccatgaacaagaagtttggtatgattcacgggttatcatctctcgctaacatcttctcttttggaagccttgccatgcattcttggtaccttgctgggaagatggatctctaaatttcttgtcacaaaaggtctgagcttttatgcctcccttcatgaataaaatctcttgctttgtaagattattataccagaaggtgaaacagtttgttataatgatatcgtttttttttcttttaaacactagatgttttcttttttttctgaaataattgatgtgtgaatactattacagaagagtaatgcctaagttttac

SEQ ID NO: 784 - DNA, 933 bp, Raphanus sativus
  misc_feature (913)..(913): n is a, c, g, or t
agagactttactcagagaagcttacacaacaattttattttgggagaaagagtgatcatcggaagcatcatctcggcgatgggttggctgacgagatttttaacagcggtagcgtttttagccgccggagttatattctcaccggagacattcggatcgttatcaaagggcgagaattcggcgaaggttttgatattggtgaagctagctcatctactcagcttcgctacagcttggggagctgctctctgggctaccttcatcggcggaatcatcatgttcaagaacttaccgaggcatcaatttggtaaccttcagagcaagatgtttccagcttatttcactcttgttggttcttgctgcgctatttcactctctgcctttgggtatctccatccatggaagtcttcttctgctgtggagaagtatcagctagggttccttgtctcggcttttgctttcaatctcactaatttgctcgtcttcactcccatgaccatcgatatgatgaagcaaaggcacaaagttgagagagagaacaacattggagatgaagttggttggtccaagaatagagagaaggcaaagactatccctcagctagctgccatgaacaaaaagtttggtatgattcacggcttgtcatctctcgctaacatcttttcttttggaagccttgccatgcattcttggtaccttgctgggaagatggatctctaagtttcttgtcacaaaggtctgagcttttatgccctccttcatcaataaaatctcttgctttgtaaagattattataccacaaggcgaaacagtttgttataatgatatcatttttttttcttttaaacactagatgttttctttttctctgaaatagttgatgtgtgaatgctattacagaagagtaatgccnaagttttacttaaagaaact

SEQ ID NO: 785 - DNA, 918 bp, Raphanus sativus
agagactttactcagaatctacacaacaattttattttggagaaagagtgatcatcggaagcatcatctcggcgatgggttggctgacgagattcttaacagcggtagcgtttttagccgccggagtaatattctcaccggagacattcggatcactgtcgaagggcgagaattcagcgatggttttgatattggtgaagctagctcatctactcagcttcgctacagcttggggagctgctctctgggctaccttcatcggcggaatcatcatgttcaagaacttacgaggcatcagttcggtaaccttcagagcaagatgtttccagcttatttcactcttgttggttcttgctgtgctatttcactctctgcctttgggtatctgcatccatggaagtcttcttctgctgttgagaagtatcagctagggttccttgtctcggcttttgctttcaatctcaccaatttgctcgtcttcactcccatgaccatcgatatgatgaagcaaaggcacaaagtagagagagagaacaacattggagatgaagttggttggtccaagaacagggagaaggcaaagactatccctcagctagctgccatgaacaagaagtttggtatgattcacgggttatcatcgctggctaacatcttctcttttggaagccttgccatgcattcttggtaccttgctgggaagatggatctctaagtttcttgtcacaaaggtctgaccttctatgcctcccttcatgaataaaatctcttgctttgtaagattataataccagaaggtgaaacagtttgttataatgataccattttttttcttttaaacactagatgttttctttttctctgaaataattgatgtgtgaatactattacagaagagtaatgcctaagttttactta

SEQ ID NO: 786 - DNA, 860 bp, Raphanus sativus
  misc_feature (62)..(62): n is a, c, g, or t
  misc_feature (355)..(355): n is a, c, g, or t
  misc_feature (382)..(382): n is a, c, g, or t
  misc_feature (389)..(389): n is a, c, g, or t
  misc_feature (412)..(412): n is a, c, g, or t
  misc_feature (424)..(424): n is a, c, g, or t
  misc_feature (463)..(463): n is a, c, g, or t
  misc_feature (474)..(474): n is a, c, g, or t
  misc_feature (496)..(496): n is a, c, g, or t
  misc_feature (499)..(499): n is a, c, g, or t
  misc_feature (511)..(511): n is a, c, g, or t
  misc_feature (517)..(517): n is a, c, g, or t
  misc_feature (548)..(548): n is a, c, g, or t
  misc_feature (553)..(553): n is a, c, g, or t
  misc_feature (616)..(616): n is a, c, g, or t
  misc_feature (619)..(619): n is a, c, g, or t
  misc_feature (622)..(622): n is a, c, g, or t
  misc_feature (625)..(626): n is a, c, g, or t
acaacaattttattttggagaaagagtgatcatcggaagcatcatctcggcgatgggttggntgacgagattcttaacagcggtagcgtttttagccgccggagtaatattctcaccggagacattcggatcactgtcgaagggcgagaattcagcgatggttttgatattggtgaagctagctcatctactcagcttcgctacagcttggggagctgctctctgggctaccttcatcggcggaatcatcatgttcaagaacttacctaggcatcagttcggtaaccttcagagcaagatgtttccagcttatttcactcttgttggttcttgctgcgctatttcactctctgcntttgggtatctgcatccatggaagtcntcttctnctgtggagaagtatcagctaggnttccttgtctcngcttttgctttcaacctcactaatttgctcgtcttcacncccatgaccancgatatgatgaagcaaaggcanaangtagagagaganaacaanattggagatgaagttggttggtccaagaacnggganaaggcaaagactatccctcagctagctgccatgaacaagaagtttggtatgattcacggcttntcntcnctnnctaacatcttttcttttggaagccttgccatgcattcttggtaccttgctgggaagatggatctctaagtgtctcacaaaggtccgagcttttatgcctccctttgtcaatataatctcttgctttgtaaaatctcaaaacagtttgttattgtgatatcgtttttttctttcttttaaacagctagatgttcctttttttctctgaaataattgatgtgtgaatgctattaca

SEQ ID NO: 787 - DNA, 983 bp, Citrus clementina
acttcaatagaagcaggcggtgacttgtgcgtgcggtgataaataaatagataaagagaacctaccggtttcttcgtcaagtgtcaagcttcaaccactgttaatctgagggcgtgaggtcagagtaagagagaaatggcttggctaacaagattcctggcagccgtggctttcttagccatcggagtgatattctcacctgagacatttggatcaaaatcggacggccttaattcatccaagctatcgcccttcctgaagctggctcatctcctctgcttctccactgcttggggcgcagctctttgggtcaccttcatcggcggcatcatcatgttcaagaacctaccaaggcatcagtttggtaatctacaaagcaagatgtttccagcatatttttcgctagtaggagtgtgctgttcaatagctgttgcatcatttgcatatctgcatccgtggaagtcatcatccactgctgaaaagtaccagctcggcttcctactctctgcttttgctttcaatctcaccaatttgtttgtcttcacacccatgaccattgagatgatgaagcaaaggcacaaagtggagagagaagagaacattggagatgaagttgggtggacaaagaacagggaagttgcaaagtctaacccaaagcttgcagcgatgaataagaagtttggaatgattcatggattatcatcccttgctaatatcatgtcatttggcagccttgccatgcactcttggtatttggctggtaagatcaatctttaactttatcagaatttcatctccatatcccttcatttggatatttgggacgctggttcacttaatcatacatgatgcattgactttgtacactgtattggggaatgtgcaacttatgtataattcactatatcttatgtataattcactatatgtcattatatggaatttactctctttaattgaatgaaataaagtttgagaggatc

SEQ ID NO: 788 - DNA, 983 bp, Citrus sinensis
acttcaatagaagcaggcggtgacttgtgcgtgcggtgataaataaatagataaagagaacctaccggtttcttcatcaagtgtcaagcttcaaccactgttaatctgagggcgtgaggtcagagtaagagagaaatggcttggctaacaagattcctggcagccgtggctttcttagccatcggagtgatattctcacctgagacatttggatcaaaatcggacggccttaattcatccaagctatcgcccttcctgaagctggctcatctcctctgcttctccactgcttggggcgcagctctttgggtcaccttcatcggcggcatcatcatgttcaagaacctaccaaggcatcagtttggtaatctacaaagcaagatgtttccagcatatttttcgctagtaggagtgtgctgttcaatagctgttgcatcatttgcatatctgcatccgtggaagtcatcatccactgctgaaaagtaccagctcggcttcctactctctgcttttgctttcaatctcaccaatttgtttgtcttcacacccatgaccattgagatgatgaagcaaaggcacaaagtggagagagaagagaacattggagatgaagttgggtggacaaagaacagggaagttgcaaagtctaacccaaagcttgcagcgatgaataagaagtttggaatgattcatggattatcatcccttgctaatatcatgtcatttggcagccttgccatgcactcttggtatttggctggtaagatcaatctttaactttatcagaatttcatctccatatcccttcatttggatatttgggacgctggttcacttaatcatacatgatgcattgactttgtacactgtattggggaatgtgcaacttatgtataattcactatatcttatgtataattcactatatgtcattatatggaatttactctctttaattgaatgaaataaagtttgagaggatc

SEQ ID NO: 789 - DNA, 944 bp, Cleome spinosa
tagcgaaatcgagagagttcgagacagagagtgcgcgagtgatcggaatcttcgggcaatggcgtggctgacaaggttcttagcagcagtggcgttcttggctatgggggtgatattctcgccggagaccttcggatcgaagtcggacggcgagaatccggcgaaggtgacggcgtcggcgttactcaagctggctcatctcctcagcttctccaccgcttggggtgctgctctctgggctactttcttcggcggcatcatcatgttcaagaatttgccgaggcatcagttcgggaacctgcaaagcaagatgtttccggcgtatttcactttggtgggcacgtgttgtgcgatttcgctagccgcttttggatatctgcatccatggaagtcatcttcggcagtggagaagtatcagctagggtttctactctccgcatttgctttcaatctggccaacttgtttgtatttacacccatgactatcgagacgatgaagcaaaggcacaaagtggagaaagagaataacattgggaatgaaatcgggtggtccaagaaccaggaggtggcgaagagtaacccgaagctagctgccatgaacaagaaattcggaatgattcacgggctatcatcattagctaatatcatgtcctttggttgcctcgccatgcactcttggtatctggctgggaagatccatctctagtacctgtggagagaaacaaggtctgcgaatacacacgcacacgcgtatagactccctcaagacatttcaactcaaaatcccatgtaagatatgtctttctcgtatcagtgggagaatccagggatatattctcagtggtatcgtaacagagattgtactaataatggtcatggaacgatcagggaaaaccatgttccgaagcctgaggcttctactactctgtttcttccttcctata

SEQ ID NO: 790 - DNA, 767 bp, Cleome spinosa
agagggaaatggcgtggctgacaaggctcctagcagcagtggcgttcctggccgtgggggtgatattctcaccggaaattttcggatcgaaatcggacggagagaatccggcaaaggtgacggcgttgctgaagctggcccatctcctcagcttctccactgcttggggcgctgctctgtgggttaccttcatcggcggcatcatcatgttcaaaaatttgccgaggcatcagtttggtaaccttcaaagcaagatgtttccggcgtattttactttggtgggtatatgttgcgcgatttcactggctgcttttggctatttgcacccatggaagtcttcttcagcagtggagaagtatcagctagggtttctactgtccgcttttgctttcaatctctccaatttgttagtatttacgccaatgactatcgagatgatgaagcaaaggcacaaagtggagaaagagaatagcatcggaacagaaatcgggtggtccaagaaccaagaggtcgcaaagagtaacccaaagctagctgccatgaacaagaaattcggaatgattcacgggctatcatcactagccaatatcatgtcctttggtagccttgccgtgcactcttggtatctagctgggaagatcaatctctagttttgcttattctctccttgctatgttgtatctttggagagaaacagggttgggcatatatactcccttgcgaataaatttcttatcatttcagcggaaaaccatatgtaagatttg

SEQ ID NO: 791 - DNA, 1706 bp, Theobroma cacao
gaagggatatggaaatgccttgtcatttccttaccagatttccttaacgagtaattacgccggtcatattaaggcggtggagagaatagaataaaagaggggagaatacgaaaattaagtaaaatagccaacccctctaaagaaatggtggactgcgtttaattaacggttagaccgtaaatctgataaagtaagcaaccggggcaatttggtaactttattaaagtaaaaacctctaaaatccacagaaattccaccaaccaccaactgccagccagcactgaggacgaagtgttagaaacatttcccccatcagaattaaaatcccccagaagtagttaccaattttcttcaccgcactttctagtaatatcggagagatggcttggataacacgatttctaacggcggtggctttcttggctgtcggagtgatattctcaccggagaccttcggatcaaaattggacggtccaaattcacccaagctctccactttcattaagctagctcatctcctcagcttcgcaaccgcctggggcgccgccctttgggtcactttcatcggcggtatcatcatgttcaagaatctgccaaggcatcaatttggtaatctacaaagcaagatgttcccggcttatttctcgatggtcggtgtttgttgtgccatagcggtggcggcgtttggttatttgcatccgtggaagtcggcgaccactgcggagaagtaccagcttgggtttttagtctctggttttgctttcaatctctccaatttgctcgtttttactcccatgaccattgagatgatgaagcaaaggcacaaggtggagaaagaacagaacattggtgatgaaattgggtggtcaaagaatcaagaagctgcaaagtctaatccaaagcttgcagccatgaacaaaaaatttggaatgattcacgggttatcttcccttgctaatattatgtcctttggcagccttgccatgcactcatggtacttagctggtaagctcaatctgtagtttggagatgatgtttccttctacatggaaagttagagtttcccctctggctatagactaaagtaatcacctttactttgtgtttctcttggataacctgttgcaattactcttgccaggattatgtaaaattgaacaatatgtcaagaaaaaggatttagtcttgttagtttatttgaaaataaatttacaaagttacatggcttttccgtcaagtgggtggaagtttgaaaatatttgaaagtattatttcatgttggcagcgtttatagtagctgaaacagttagtataggtttcattgtatttcgttttgctcatctcagtcgcatcccctttctggcatggtttcctgccttaaaataacatcctcagaacaatggaatttcttggattatccaaccttcccttgttgtttctggcttctgcagaaggttcatatgaaggacaactactttgcatttagaggtttatgttcatgcatgcaggatgatgctacaagttaatggcaatccaacctgagtgtgagcttggaagtctttaaaggggtctaagggaggttgcattagttccaaagaaatcaaggagctcccttgattcgagtgatctgggcaaattgagtgcactctaagagagtgatattttacttgtttgcgacacgttttgtgcatgattcaatcattggt

SEQ ID NO: 792 - DNA, 1197 bp, Arachis hypogaea
aaataagccaaaaatttagtagccttgttgtcacgaagtcatagttgtcttaatgaatgaatttaaggtcacagcggcgcacctactctctcttccagaagcatccacgccacgaaggttcttaaccacaagcaaagtgttgagaaacactgagtaagaatcgttccacaatgggttgggtcactcgcttcttaaccgcggtggttttcttggccgtcggagtcattttctcacctgaaaccttccgatccaactccgactcagccgcaagtagaatctccacttacctcaaactctctcaccttctctgcttctccaccgccttcggtgctgctttatgggtcaccttcatcggcggcatcatcatgttcaagaacctgccaaggcatcagtttgggaacctgcagagcaagatgttcccggcgtacttctcgatggtgggcgtgtgttgcgccatatcagtggcatcttttgggtatcttcacccttggaagtcttcctccactactgaaaagtaccagcttgggttcttgctgtcgtcctttgccttcaaccttacaaacttgtttgtctttacacctatgaccattgagatgatgaagcaaagacataaagtggagagagaaaacaatattggggaggaagttgggtggtcaaagaatgtggaagttgcaaagaagaacccaaagcttgcagccatgaacaagaagtttggtatgattcacgggttatcttcgcttgcgaatatcatgtcattcggaagcctggcgatgcactcttggtacctggccggtaaacttaatctctgattagttgcttcttccactcttatgaaagttggttgagttccttgtgaagagttggttaagtctgcgatatctgtattcaacttatcttccaattttacattgcttgtttctaaatgcgaaatcaaaaggaatgtagaatgcagtttgtttagtatatgctgtcaaaggtactgcagggtattggttcgaccagtcttgtgacttaccatggcaacactttgtaattgtcctacttcatattaataaataagcagcatctatagtagcaagaacaagaaataatacctgtcggccgctcggccagtcgaactctagactcgagcagcttagcattgcgcgcattctgtcatgtcatagcctaatgagtcgtatatgacagttcactctg

SEQ ID NO: 793 - DNA, 922 bp, Euonymus alatus
gagaatcacaagtctacattttagtggttcggtgagttcgactgtaacaaaatcggaagtatcttcaagcggaatctgtgtgagggagtcagagaaattgagatgggttggctaactcgatttctggcagcggtggcgttcttggccgtcggcgttttattttcaccggagatctttggatcgaaatcggatggtcagaaatcatcacatctgtcaacctacctgaaactggctcatctcctctgcttctccacggcttttggtgccgctctctgggttactttcatcggcggtatcatcatgttcaggaatctaccaaggcatcagtttggaaatctccaaagcaagatgtttcctgcgtatttctcattggtgggggcttgtgcagcaatatcagtggcctcatttggttatttacacccatggaagtccgcatcaacggtggagaaataccagctcggattccttctgtcttcatttgcttttaatctcaccaatttgttcgtctttacacccatgaccattgagatgatgaagcaaaggcacaaggtagagagagaacaaaatattggagatgaagttgggtggtcgaagaacagggaagctgcgaaggctaatccaaagcttgctgccatgaacaagaaatttggtatgatacatggattatcatcccttgctaacattatgtcctttggaagccttgccatgcactcctggtacttggctggtaagatgaatctgtaattttaacctttgacgggaagtttgtgtcattaccagatttaaagtcaattaagaaaggacatacttgtttctcatcgattagttgttatgttggccaatttatgtatgattgaacattgtgttaagataaagtagtttgttttctcgtccagtatgaaataaaaatctgagataacat

SEQ ID NO: 794 - DNA, 867 bp, Tripterygium wilfordii
agggagtctgagaaattgagatgggttggctaactcgatttctggcagcggtggcgttcttggtcgtcggcgttatattttcgccggagacctttggatcgaaatcggatggtcagaaatcatcgaatctatcaacatacctgaaactggctcatctgctcagcttctccacggcttttggtgccgctctctgggtcaccttcatcggtggtatcatcatgttcaggaatctaccgaggcatcagtttggtaatctccaaagcaagatgtttcctgcatatttcttattggtgggggcttgtgcagcaatatcagtggcctcatttggttatttgcacccatggaagtctgcatcaacggcagagaaataccagcttggattcctgctgtcttcatttgcttttaatctcaccaatttattcgtctttacacccatgaccattgagatgatgaagcaaaggcacaaggtagagagagaacagaatattggagatgaagttgggtggtcaaagaacagggaagctgcaaaggttaatccaaaacttgctgccatgaacaagaaatttggtatgatacatgggttatcatcccttgctaacattatgtcctttggaagccttgccatgcactcgtggtacttagctggtaagatgagtctgtaatttaaacctttgatgggaagtttgcgtcattaccacatttaagatcgatactaagaaaggtcatgcttgtttctcatcgataagttgttatcttggccaatttatgtacgactgaacaatatgtcaagataaagaagttagttttctcgtccggtatgaaataaaagtctgagataagcatacaccttctccttcataaaaaaaa

SEQ ID NO: 795 - DNA, 845 bp, Pteridium aquilinum
cgcactttctagtaatatcggagagatggcttggataacacgatttctaacggcggtggctttcttggctgtcggagtgatattctcaccggagaccttcggatcaaaattggacggtccaaattcacccaagctctccactttcattaagctagctcatctcctcagcttcgcaaccgcctggggcgccgccctttgggtcactttcatcggcggtatcatcatgttcaagaatctgccaaggcatcaatttggtaatctacaaagcaagatgttcccggcttatttctcgatggtcggtgtttgttgtgccatagcggtggcggcgtttggttatttgcatccgtggaagtcggcgaccactgcggagaagtaccagcttgggtttttagtctctggttttgctttcaatctctccaatttgctcgtttttactcccatgaccattgagatgatgaagcaaaggcacaaggtggagaaagaacagaacattggtgatgaaattgggtggtcaaagaaatcaagaagctgcaaagtctaatccaaagcttgcagccatgaacaaaaaatttggaatgattcacgggttaccttcccttgctaatattatgtcctttggcagccttgccatgcactcatggtacttagctggtaagctcaatctgtagtttggagatgatgtttccttctacatggaaagttagagtttcccctctggctatagactaaagtaatcacctttactttgtgtttctcttggataacctgttgcaattactcttgccaggattatgtaaaattgaacaatatgtcaagaaaaaggatttagtcttgttagtttattg

SEQ ID NO: 796 - DNA, 953 bp, Quercus alba
gccagtctttagaaataaaacccacaaatttcttcaacgacctaccattttgcgcacgcagacagagactcacagagagcgagagagatgggttggctaacgcgattcctaggggccgtggcattcttagcggtcggggtgatattctcaccggagacctttggatcgaaatcggacggtgagaattcaactagtaagctagctatctatctcaagctagctcatcttctctgctacgccaccgccttcggcaccgctctctgggtcaccttcatcggcggcatcatcatgttcaagaatcttccgaggcatcagtttggaaatttgcaaagcaagatgtttcctgcgtatttctccatggttgggatctgttgtgcagtatcagttgggtcttttgcgtatctgcatccctggaagtcatcgtctaccactgagaagtaccaactcgggttcttgctgtctgcgtttgcattcaatctcgccaatctgcttgtttttacaccgatgacaattgagatgatgaaacaaaggcataaggtggagagagaatcaaacattggggaagaagttgggtggtcaaagaacgtggaagttgcaaaggtgaatccaaagcttaaagccatgaacaagaaatttgggatgattcatgggttatcatcccttgctaatatcatgtcctttggcagcctagccatgcactcatggtacttagcaggtaaacttaatctgtagtttcaatctggtttcccattaatagcgaaggtagtgctttggctctattgattacatcaatagagagaggacctacgtgctttctctttgttataaatactttgaaatcctccttgccaagttatgtatgattgaacaataagtttagagaagaatccttgtcgatgaattataagtccacattatgagctataataatatggttaccatgttgataacaa

SEQ ID NO: 797 - DNA, 992 bp, Gossypium hirsutum
actttaaaatattaaaagacgaaacaaaaaaccccaagaaaatagttagaacttgtaactacccattttttctgttcaccaagttctagataatcggagatatggcttggataacacgattcttaacggcggtagctttcttggctgtcggcgtaatattctcgccggagactttcggatcaaaatcggatggtacaaaatctccaaatctctcctcattcattaagctggctcatctcctgagcttctcaaccgcctggggcgctgccctttgggtcactttcatcggcggtatcatcatgttcaagaatctgcctaggcatcaatttggtaatctacaaagcaagatgttcccggcttatttctcgatggtgggggtttgttgtgccatatcggtggcggcatttggttatttgcatccatggaagtcagcgacgatgccggagaagtaccagcttgggtttttagtctctgcatttgccttcaatctatccaatttgttcgtttttactcccatgaccatcgagatgatgaagcaaaggcacaaagtggagagagaagcaaacattggtgatgaaattggctggtcgaagaatcaggaagctgcaaagactaatccaaagcttgcagccatgaacaagaaatttggaatgattcatgggttatcttcacttgctaatattatgtcctttggcagcctggccatgcattcgtggttcttagctggtaagctcaatctgtagtttgcagttaatttagacatagaaagtccaagttctaaatttgccttccggctatgtagattgaagtgatcacctgtattttatgtttccccttggatgaactgttccaactattcctgccataattatgtagaactcaaccatatggtaataaacagaatctagtcttattagtgcacttaacaaagatcgcattgtttgaagttaaaaactttttttcaattatattgcgtttaattccgtgtttgc

SEQ ID NO: 798 - DNA, 2903 bp, Gossypium raimondii
aaatttaaaataaatttgatttaattatttaaaaatataaataaaatctgaaaattataatttagatccaaatagaattgaacaatataaaatatattaatatatctctaaattctatttaaaccctgaacaaactccacccacgaacagttctatctccacttactgcacttcaaaatattaaaagcggaacaaaaaaaaaaaaaacctaagaaaatagagttagaacttgtaactacccattttttctgttcaccaagttctagataatcggagatatggcttggataacacgattcttaacggcggtagctttcttggctgtcggcgtaatattctcgccggagactttcggatcaaaatcggatggtacaaaatctccaaatctctcctcattcattaagctggctcatctcctgagcttctcaaccgcctggggcgctgccctttgggtcactttcatcggcggtatcatcatgttcaagaatctgcctaggcatcaatttggtaatctacaaagcaagatgttcccggcttatttctcgatggtgggggtttgttgtgccatatcggtggcggcatttggttatttgcatccatggaagtcagcgacgatgccggagaagtaccagcttgggtttttagtctctgcatttgccttcaatctatccaatttgttcgtttttactcccatgaccatcgagatgatgaagcaaaggcacaaagtggagagagaagcaaacattggtgatgaaattggatggtcgaagaatcaggaagctgcaaagactaatccaaagcttgcagccatgaacaagaaatttggaatgattcatgggttatcttcacttgctaatattatgtcctttggcagcctggccatgcattcgtggttcttagctggtaagctcaatctgtagtttgcagttaatttagacatagaaagtccaagttctaaatttgccttccggctatgtagattgaagtgatcacctgtattttatgtttccccttggatgaactgttccaactattcctgccataattatgtaaaactcaaccatatggtaataaacagaatctagtcttattagtgcacttaacaaagatcgcattgtttgaagttaaaaactttttttcaattatattgcgtttaattccgtgtttgcagtttgcatgtagtagtattgattgcgttgtatttaagatgtttctttggttttgtttatcttcggtggtatctgttatctacctagtaagcagcacactacttcattgaacaagaactggtaggcttcttcagaacaatggaaataaactttgatcactctgatttaattttattggattcccctgcgtccttctgcagattgtgttctttgtgggcaaaataaacttggtgtggttctgtttattttaatcatgcaatgatggtaaaaatgggaccaaaacagcttgttcaactactataatctagccagatttttcaagaacagttgcttctagaatgttggggtttggcaaactacctaaaagaaatattattaatattggtaacatgtatgtattaaagtgatttgaggagaagcaagaaattttaaactccattcgtggctgaatcattgaatttattgttgtaattaaaagcatatttgttttttaggaattagataagatgagaaagatttgaggagagtaaaatggaaagagaggagactgttgattctgtttctaaaacagtggcaacctacaaaagcccaattagattatgaccatgggatccctaaactcattgtctgagggccttgtgttaaacaacattagaacaaaagagctttcatgactctatttagggactgcaggatcccgggcattggcatgggttggcccaaaatctgttacaacgcttgctacagctaaatccattacgaagaagaaaagtacaaagaaatgcaagtcgccgctgcctcagaattcgagctgaaaagttccaagcaaatccgatgtccgctaccgcagatagagtagtatagtacatcagccaataataatgtgagaccaaatttttaggccacttttgcccaccatttgggctgtccagttatagctacgaccctcctaaccccacggactcagcctattccgcaaggcaaggcaaggtaacaaggtcggtcccctcccctgtgatatttgaagctttaattttaataacaaattaactaaattggattagttccttagttccaaggaaatagaaattacttggaactttggttggtttggtccttaaagccccccttgccgattttcagtcacatttataaatttggcagctcttacaagaatggtccacaacgtcccactttcgtccctcctacaagatgatagacgaaagaaaaacagaaatacgaatgaattgaactggttaagcaattcaagtagcggataacgatggacttgaagtccacacgtaaacgctgttgcaacgcgccgtgcgagggagacttaggccttcattcatccataataacaggctgactttttgccgtgttggatggataggctttaaattaaggagaacagtcatattggaccggagggccagtggggactcttattttgtttgtagatgaaccttatttttccatgcagcgccacgcagacgaaaacttttattcgtggcttggctaagcctgtcgactatttagaatccctacatgggactcacccatgtgcttaatgtggcttatttacgaaatgtaaagaatcttggttggaatgactgattctatcttagccacacccaaaaacagctcacctcctaattgtccgaaacaacaaaaacatctcctcccacgtttagaagaatattcatgtccctcctaagttaattgcaccagaca

SEQ ID NO: 799 - DNA, 832 bp, Tripterygium wilfordii
ggtcagagaaattgagatgggttggttaactcgatttctggcagcagtggcgttcttggccgtcggcgttatattttcaccggagacctttggatcgaaaccggatggtcaaaagtcatcgcatctatcaacctacctgaaattggctcatctcctcagcttctccacggcttttggttccgctctctgggtcaccttcatcggcggtatcatcatgttcaagaatctaccaaggcatcagtttggtaatctgcaaagcaagatgtttcctgcatatttctcgttggtgggggcttgtgcagcaatatcagtggcctcatttggttatttgcacccatgggagtccgcatcaacggtggagaaataccagctcggattcttgctgtcttcatttgcttttagtctcaccaatttattcgtatttacacccatgaccattgagatgatgaagcaaaggcacaaggtagagagagaacagaatattggagaagaagttgggtggtcaaagaacagggaagctgcaaaggttaatccaaagcttgctaccatgaacaagaaatttggtatgatacatggattgtcatcccttgctaacattatgtcctttggaagccttgccatgcactcatggtacttagctggtaagatgaatctgtaatgtaaaactttgatggcaagtttgtgtcattaccacatttagaataaattaagaaaggacattcttgtttctcatcgataagttgttatcttggccaatatatgtatgattgaacaatatgtcaaaataaagaaattgaggagataggcatgcaccttctcctttataactttg

SEQ ID NO: 800 - DNA, 824 bp, Cirsium arvense
gcctccttctgttagatttctgcaaatttttcattaagatcatgggttggatgacacgatttctcaccgccgttgccttcttggcaatcggagtcatattttcaccggaaaccttcggctcaaaatcagcaaagatcacaactttggtcaaacttgcacacctactatgtttctccactgcttggggcgcagcactttgggtcaccttcatcggcggtatcatcatgttcaagaatctaccaaggcatcagtttgggaatctgcaaagcaagatgtttccggcctactttatgatggttgggatatgctgtgcagtgtcggtggggtgttttgggtatacacatccatggaagtcttcatcaactgctgagaagtatcagcttggatttttgctctctgctttcgccttcaatctcaccaatctttttgtttttactcccatgaccattgagatgatgaagcaaaggcacaaggtggagagggagtcgaacattggagaagaagttgggtggacaaagaaccaagaggttgcaaaggtgaatccgaagctagcagcaatgaacaagaagtttgggatgattcatgggttatcatctctagctaacattatgtcttttggtagtcttgcaatgcattcatggtatttagcaggcaaaattgatctctagactcatttcatcccatggctattatgttgacaatgacaataatgtaccgttttcctatcattggctcctcctttgctgctgtggggagtgatgtcaattatatataataggtaatgtgttggatgttataaaaggaggtttaatggtgtttttaaa

SEQ ID NO: 801 - DNA, 888 bp, Cynara scolymus
  misc_feature (17)..(17): n is a, c, g, or t
  misc_feature (783)..(783): n is a, c, g, or t
  misc_feature (841)..(841): n is a, c, g, or t
  misc_feature (845)..(846): n is a, c, g, or t
  misc_feature (854)..(854): n is a, c, g, or t
  misc_feature (875)..(875): n is a, c, g, or t
  misc_feature (885)..(885): n is a, c, g, or t
taggttacgatcaattnatcttcttcgtctcctcctgttccctttagatttcgaaatcttccaaattcaatccgtttcacagactaagatcatggcttggatgacacgatttctcaccgccgttgccttcttggcaatcggagtcattttttcgccggaaaccttcggatcaaaatcagcaaagatcacaactttcgtcaaacttgcacacctcctatgtttctccactgcttggggtgcagcgctttgggtcaccttcatcggcggcatcatcatgttcaagaatctgccgaggcatcagtttgggaatctgcaaagcaagatgtttccggcctactttatgatggttgggatatgctgtgcggtgtcggtagggtgttttgggtatacacatccatggaagtcttcatcaactgctgaaaagtatcagcttggatttttgctctctgctttcgccttcaatctcaccaatcttttcgtctttactcccatgaccattgagatgatgaagcaaaggcacaaggtggagagggagtcgaacattggagaagaagttgggtggacaaagaaccaagaggttgccaaggtgaacccaaagctagcagcaatgaacaagaagtttgggatgattcatgggttatcatctctagctaacattatgtcttttggtagtcttgcaatgcattcatggtatttagcagggaaaattgatctctagacccatctcatcccatggttcttatgttgacaatgacaaataatctactaccattttcctagcantgggctccttcctgctgctgtgggaagtgatgccaattgtataacaggcaatgtgttngacnncctatatngatgttataaaaggaaggttnatggtgtttnaaa

SEQ ID NO: 802 - DNA, 1047 bp, Eucalyptus grandis
gccacactcaccggtcgctcttcctccatcttctcggttctcctcctccctaattcgcacagaaagagagagagatggggtggctgacgcgattcctggcggcggtggccttcctggccgtcggggtcatcttctcgccggagactttcgggtcgacctccgacggctccaagtcccccacggcggcgacgctcttgaagctggcccacctgctcggcttcgccaccgcctggggcgccgccctctgggtcaccttcatcggcggcatcatcatgttcaaaaatcttccgagacaccagtttggtaatttgcaaagcaagatgtttcctgcatatttcacgatggttggagtgtgctgtgccatgtcagtggcttcatttggatacctacatccatggaagtcatcatcctcaacagagaagtaccagctagggtttcttctctctgcctttgctttcaacctcacgaatttgtttgtcttcacccccatgaccattgagatgatgaaacaaagacacaaagtggagaaagaggagaacattgggaatgaggttggatggtccaagaacgtagaagttgctaaggtcaatccaaaattggctgccatgaacaagaagtttgggatgattcacggcttgtcatctcttgctaatataatggcctttggtagccttgccattcactcgtggtacttggctagtaagataaatttgtgaagcaaagtatatccatctcagcaaaatggcggttctggtcatattattgttaaagctagttattgtccttgctttctctaggaaggatgtcctgatagtttcctgaatgtactatcgagttctgcacagagggacataatgtcacgtgaataaaggtcacatactgcctcagctgtggctgagttttccctttgcaatagaaagttgacttctggctctgttgttattcatatagccttgggcaaaatttactgcagcaacggtttttcatgtacctttctgtagtaaatcgtcattggaaagatgaacttaaaaagttctgtttcttggt

SEQ ID NO: 803 - DNA, 1110 bp, Vitis vinifera
tatatatcaacgtgacccactagtcaaggaagaagaacgagtcggccaggtgttgctctcttaatcgtacctgctccttcaacgttgccatatcgggactagattcagtgagtcactccgtcgtcagaaatgggttggctgactcggtttctcggcgccgtcactttcttggccgtcggagttattttctcgccggagacattcggatccaaatcagacggtagccattcgtcaaagctaaccgctgccctcaaactcgctcacctgctctgcttcgccaccgcttggggcgccgctctctgggtcaccttcatcggcggcatcataatgttcaagaatcttccgaggcatacgttcggtaatttgcaaagcaagatgtttcctgcttatttctcgatggttggtgtgtgttgtgcggtttcaacggcgtcgtttggttatctacatccatggaagtcttcttctaccgccgagaagtaccagctaggatttcttctctccgcctttgctttcaatctcacaaatttgctcgtctttacaccaatgacaattgagatgatgaagcagaggcacaaggtggagagagagcaaaacattggtgaggaaattgggtggtcaaagaacaaggaggttgccaaggtgaatccaaagcttgcagccatgaacaaaaaattcggtatgattcatggactatcatcccttgccaatatcatgtcctttggcagccttgcaatgcattcatggtacctagctggtaaaatggacctgtaacttgatctccattcccctgtattggggaaggacatgtctggcatagatttatgttgaggacttatccccttcctttcttggatgaacagtgctgactactttgtggccaagttatgtaatacttgtgatggattgagaaaaaatacttgtttgtggacacatttggaacaaaatttcataaagttacatgggatgccttatagatatttctgtttatgggaacgaaatcattctgttctgtttgtgtagcctttgaagccagcccattttgttggtaatcaggtcattggtattcattttatcatttataatgttcttttgaagatttatgatattgaa

SEQ ID NO: 804 - DNA, 898 bp, Humulus lupulus
attacggtccgaaattacttcttcttctaccgaaaaatacttaatcttgttcagcaaaatctaaaaatcagagagagagagagattgagagatgggttggttgtctcgattcctcactgcggtgactttcttagctatcggagtgatattctcaccggagagctttggatccaagtcagacggtagcaattcccccaaaatctacacctacctcaaattggctcatcttctctgcttctccaccgcttggggcgccgctctatgggtcaccttcattggtggtatcatcatgttcaagaaccttccgaggcatcaatttggtaatttgcagagcaaaatgttccctgcatacttctcaatggtgggtacttgttgcgcagtatcagtagcatcgtttgggtatctgcatccatggaagacgtcagctactactgagaaataccaactcgggtttttgctttctgcattcgccttcaatctaacaaatttatttgtctttacacccatgaccattgagatgatgaagcaaagacataaggttgagagagaggagaacattgggggtgaagttgggtggtcaaagaatgtggaagttgccaaggtgaatccaaagcttgcagccatgaataagaagtttgggatgattcatggcttgtcttctcttgctaatatcatgtcctttggtagcctcgccatgcactcatggtatttggcaggtaaaattaatctgtagtgaaatgctttcgttcctttacagtggaagaaattgttctctcgatgcataaactatgtcgaacatggaactcatggaaaatcagtatagatttttcctggaaagcttgtattctgattgaacagtttaatcaaaatcacgaggtccgtcatagtggaatgaata

SEQ ID NO: 805 - DNA, 865 bp, Platanus occidentalis
ggttggattacccgatttcttgctgccgtagcatttctgtccttcggagtgctcttctctccggaaaccttcggatcaaaatcagaaggcggctacccctcgaagctctccatctctctcaagctcgcccatctcttgagcttctcaaccgcttggggcgccgctctctgggtcaccttcatcggcggaattatcatgttcaagaatcttccgaggcatcagttcggaaatcttcagagcaaaatgtttccggcctatttctcgatggtgggtctttgctgtgcgatatcggtggcatcgtttggatacctccatccgtggcgatcttcgtcctctgcggagatgtatcagcttgggtttttgctttctgccttcgctttcaacctcacaaatttattcgtcttcacgcccatgacaatcgagatgatgaagcagaggcacaagattgagagagaggagaacattggagaggaagttgggtggacgaagaacagagaagtggccaaggtcaatccaaagctagctgcaatgaacaagaaatttggaatgattcatgggttgtcatcacttgccaatattatgtcatttggaagccttgccatgcattcatggtacttggcaggtaaacttaacctgtaaaattacttcgatcttcctgcatcaagaagatgaattctagctgttgttgtacacacattcaaccaattgaggagggagagtgcctttgttgtttgataaacaactctgattctcatgggtatgtactctttgtccaagatctttaagagtgaacatcattttaaggataataaactagttagttccactttcaattactgagctaaattttataaaatttacatgg

SEQ ID NO: 806 - DNA, 1118 bp, Cannabis sativa
aaatataaattactctaatactaattgaaaacagtgtctaacttttcttaacaatttggttctactacttctactctttccattctccgtactcctttcattttttttctccccaattttctttcctaacaaataatcttgctctgcaaaaccgacgagacgacactccagtgtgagatgggttggttatctcgattccttactgcggtcaccttcttagcggttggagttatattttcaccggagagctttggatctaagtccgacagtcaccattcaccaaaaattttcacctatattaaattggctcatcttctctgcttctccaccgcttggggtgcagctctatgggtcaccttcatcggcggtatcatcatgttcaagaaccttccgaggcatcaatttggtaatttgcagagcaaaatgttccctgcttacttctcaatggtgggtgtttgttgcgcagtatcagtagcttcgtttgggtatctgcatccatggaagacatcagctactactgagaaataccaactcgggtttttgctatctgcattcgccttcaatctgaccaatttatttgtctttacacccatgaccattgagatgatgaagcaaagacacaaagtggaaagagaagagaacattgggggtgaagttgggtggtcaaagaatgtggaagttgccaaggtgaatccaaagcttgcagctatgaacaagaaatttgggatgattcacggcttgtcttctcttgctaatatcatgtcctttggcagccttgccatgcactcatggtacttagcaggtaagcttaatctgtagtgaaatgcttgtgtttatctctacggtggaagaagttgtactcttgatgaacatgaaattctcacggataatcagtatatatatttcctggaaagcttgtattctgattgaacaatttaaacaaaatcacgaggtccatgatagtggaatgtatatgctgttgttgtaataaggatggacttgatgtgatgattatgcagtgtagtttgcttgctttatatcaagtctacatattgaaaaaaaaaaaaaaagaataagggttgaactactctatgctgatttttttttgtttttgtttt

SEQ ID NO: 807 - DNA, 854 bp, Carpinus betulus
ggttggctaacgcgattcctagcggcggtggcgttcttggcgatcggagtgatattctcgccggagaccttcggatcgcaatcggacggtcagaattcgacgaagtttgcaatctatctcaagctggctcatcttctgtgcttctccacggcctttggatccgctctctgggtcaccttcatcggcggcatcataatgttcaagaatcttccacggcatcagtttggaaatctgcaaagcaagatgtttcctgcgtatttctccatggttggggtctgttgtgcaatatcagccgggtcgtttgggtatctgcatccatggaagtcgtcatctactgctgagaagtaccagcttggtttcttggtgtcttcgtttgcattcaacctcgccaatttgtttgtatttacacccatgaccattgagatgatgaagcaaagacataaagtggagagggaatcaaacattggggatgaagttgggtggacaaagaatgttgaagttgcaaaagtgaacccaaagcttgcagccatgaacaagaaatttgggatgattcatgggctatcatcccttgctaatatcatgtcatttggcagcctagccgtgcactcatggtacttggcaggtaaaataaatctgtagtttcaaattggcttccctttattagggaaggcagtatctggataacaatcgagcgaggccctctgttgctttctctttgtttaagtactttggattcttcccggccaagttgtgtaggactgaacaaatacttagcaacaaagagaaaatgtacgattaaatatgtcaaatgtaggaatcctttcctgtctatgaaatgtaataacatgggtact

SEQ ID NO: 808 - DNA, 1048 bp, Carica papaya
gttccttctcgtcaacgggaaagacgaaaatcctccccgtgatttgccttcgtcaatactccgccagaaaattccagagaaagagagaaggactaggaagggaatcgtacagttattaggcacatggcttggctgacacgattcttggcagcggtggctttcttagccatcggcgtgatattctcgccggagactttcggatcaacgtcagagggccagaattcatcgaaactatcagtctacctgaagctagttcatctcctcagcttctccacggcgtggggcgccgctctctgggtcaccttcattggcggaatcatcatgttcaagaatctaccaaggcatcagtttggaaacctacaaagcaagatgtttcctgcatatttttctttggtgggtgtgtgttgcgcgctgagtgtggcagcctttggttattcgcatccatggaaatcatctgccactgcagagaagtatcaattagggtttctactctctggttttgcttttaatctcaccaatttgtttgtctttacgcccatgaccattgagatgatgaagaagaggcacaaagtggagagagagcagaacattggggatgaaatcgggtggacaaagaacaaagaagttgcaaaggttaatccacagcttgcagccatgaacaagaaatttggaatgattcacgggttatcatcgcttgctaatatcatggcctttggcagtcttgctatgcattcgtggtacttggctgggaagatcaatctgtaatttgatcttcatctccatgggaagaggaagttattttataaatggagagagattgaaaatagctgcagaaagactttgttatcttcctcttagatgaactgtttcaagtatttcaccctgaaagccatgtaagatcaaacgttatgtctgtgcatcctgttaattgaaaataagtgttggtcaaattttctattgaattatcatctgcatagtatttgagacgagcattctgattcatgtttagttttgaaatagtgtcatgtttggagattctagatatgag

SEQ ID NO: 809 - DNA, 1070 bp, Cajanus cajan
gagaagaaatgtgataagaaagtcagtgaaagcggttaaagatttcaatgagcgccgtgggttggtagatagaaataaaagacataagtaacaggggatcgtgtttgcttcaattcttcaacaacctcattcattcgctcactctcactgcgaatcatgggttggattacacggttcataactgcggtggctttcttagccgtgggagtgatattctcaccggagacactagggtcaaaatcaaacaccctttccacctacctcaaactcgctcacctcctcagcttctccaccgccttcggtgccgctctatgggtcaccttcatcggcggtatcatcatgttcaagaatctgccacggcatcagtttgggaacctgcaaagcaagatgtttccggcgtatttctccatggtgggtgtgtgttgcgccgtgtcgttggcttcttttgggtaccttcacccatggaaaacttcctccactactgagagataccagcttgggtttttgctctctgcatttgcgttcaatcttaccaacttgtttgtctttacgcccatgaccatcgagatgatgaagcaaaggcataaagtggagagagaaaataatattggggaggaagttgggtggtcaaaaaatgttcaagttgcaaagtcaaacccaaagcttgcagccatgaataagaagtttggcatgattcatggattatcctcccttgctaatataatgtcgtttgggagtctagcaatacactcttggtacttggcaggtaaaattgatctctgattcagtttctgcttcccgttctgttaaagacaattgagctccttgtgaagagctatataagtgaagatcccagtgttttctttatcttccagatacttgtttattgtgtcaagtaagtgtagaatgtctgtgtaatttatgaaatgtattatcaaattactacagcatattggttggccaatagaatctcatggggttgccatggaaagtggaaacacaatgtaatcaccttacttcacattaataaaaaaaaagtagtctctgccgtaaaaaaaaaatctttacca

SEQ ID NO: 810 - DNA, 882 bp, Carthamus tinctorius
gcggggggccactgtgttaggaaggtttacgataaattcaatcttcatcgccttcttctcttcccttctgaaaaatttcccaaattcaatcaatcttcatttccagagactaagatcatggcttggatgacacgatttctcaccgccgttgccttcttggcaatcggagtcatattctcgccggaaaccttcggatcaaaatcagcaaagatcacaagtttcgtcaaacttgcacaccttctatgcttctccacagcttggggcgcagcgctttgggtcaccttcatcggcggtatcatcatgttcaagaatctgccaaggcatcagtttgggaatctgcaaagcaagatgtttccggcctactttatgatggttgggatatgttgtgcggtttcggtagggtgttttggatattcacatccatggaagtcttcatcaactgctgagaagtatcagcttggatttttgctatctgctttcgtcttcaatctcactaatctttttgtctttactcccatgactattgagatgatgaagcaaaggcacaaggtggagagggagtcgaacattggggaagaagttgggtggacaaagaaccaagaggttgcaaaggtgaacccaaagctagcagcaatgaacaagaagtttgggatgattcatgggttatcttctctagctaacatattgtcttttggtagtcttgcaatgcattcatggtatttagctggcaaaatcgatctctagacccatcacatcccatcccatcccatggttgaataatgtaccattttcctagcaatggctccttcctgcacattagtagttataaaaaccgatgtttaagagtgttctaaagcctgcacattaatgtgttaaactcgt

SEQ ID NO: 811 - DNA, 3274 bp, Brassica napus
aggttctctgatctgatctaaagggtcaaaagatggtagaatcagaagagaatggagtgttatttcccatcttcattctgacaataatcgcaattcctttggtgccttacacattcgtgaagctaagccgcgctttttccaagaaacaaaggagcatacattgtcagtgtcttgactgtgatcgctcagggaagtacaagagatccctttctcatagagtcgctacctttacttcatgtagcaacttgacagttgtgctactctggtttgtaatgatcttcttgatttattacactaagaacatcagccgtgagagtcaactctttgaaccattcagtatacttggattggagcctggtgcttcagactcacaaatcaagaaagcatatagaaaactctctatccagtaccatcccgacaaaaatccagacccagaggccaacaagtactttgtggagtcaatagctaaagcttaccaagctttgactgatccgttgtctcgtgaaaactttgagaagtatggtcatcctgatggcagacagggttataaactaggaattgctctccctcagtttatcctagactttaacggagaatctggtgggctactgttgctgtttacagttggtttatgtattctcttgccgcttgtggtcgcctccatctacctctggagatcatcaaagtatactggaaactacgtcaagctccaaactcgtcaagcgtattatgagttaatgaaaccctctttgactacaagcaaagtcatggacgttttcatcaaagcagctgagtacacagagattccagttcgtaaaaccgatgatgaatctctgaagaaactctttgcgtctgtcaaaagcgagctgagtctggaccctaagaagatgaagcaagatgaagctaagttttggaaacaggatcctgcagttatcaaggctgagcttttgatacacaaacagttaactcgtgaatcagcagttttgtctccagctctgcaaactgatttcaggcgtgtgctagagtttgcacctcgtctccttgaagatttaatgaagatggcagttataccccacaatgaacaagggcatggatggttaagtcctgcactaggagtcatagagctatctcaatgcattgttcaggctgttcctcttagtttgaggaagttatcctcagaaggcactgctcctttcttgcaactccctcatctcaatgaatccatcgctcaaaagatagcgttgcaggttggatcattcaaagagtttcaagacctgagcttagaagaacgttctaaacttcttaaggaggttgctggtttgtctgaaaccgatgttgcagacgtggagaaggtcttggaaatgataccttctctgaaaatagaagtcacttgcaaaacagaaggcgaagaaggtattcaagaaggcgacgtgacgacggttcaagcttggatcactctgaaacgtcccaatggactcgtgggagctgtttctcactcgcctcacttccccttccacaaggaggagaacttttgggttattcttgcggattcaaacaacgtctggttctttcagaaggttagtttcatggatgaagctgaagctataagcactgcgtctattgctattagtgagacaatggagagtttaggagcaagcgctgaggcaaagaacagtgcagttgaagaagctgttgagaaagttaaaactggatcaagattggtgatggggaggctcttggcacctgcagaaggtacttataacttgacttgcttctgcctgagcgatgcttggattggttgtgaccagaagacatcactgaaagtggaggttctgaaaagaacccgtgatgtggagggtgaggctgcagaagaaggtatggaggaggagggtgaagaagatgagcttgaagaggaagattatgagagtgaatacagtgaagatgaggaagacaagaagagaggatcaaagaagaaagtaaacaagaaggaatcgagttctgaagagtcaggatcagatgaagattgaataaacaaagaggagttatctcatgatctttaatacaatagtttttgcttcaaagctttacacagtgatgatactctaaaagattcttcgctgagtttctttatcgttttgacattagttggtatcttgttttgacttttcctaagctctttacctcaaaaggtcaagcgttttgggtcatgttttcagtcagtaacctaagcgcttcattgaagaactttggctctcaatctgttttccatgcatgatccaacattacatacaatctcaaaggctcaagaagagtcctaatgatcgagacagggttctctagatgtttcaatctgtctttgattcattcccacaagttcttcttcttcctcttcactggaatcctcaccatcttggtttgcttcctcacctgacaacaattcagatttactctcaatcttgtcttcatcgctgcttaagcctccttcaccttcgcttagctcattaagctgtttggccttgaccttaacacgtcttcctttgatatatctgaactcccactgtggtggaggatacttcttcatcagcttctcgtacttatcatccatcccaagtttcaaaaacactttcccaaccatattcacaatcgcaatattcggtttcactccaagctcttccatgtcagcaaacacctcgaagagcttgtaatgcatgtctctcttgtaatagatagagatcattttgttgaagaactttcttggagttccttctaaatgttccatgaacagtttgttccagagctcctcagcttcgtcaaggcggttatcttctgctagagcgtttagtaacgagaagtaagtccccattgttcttccttggcctttgctcagcatccattttgtcacctgaataatcttcttccactctctttcatcttcaagaacagctaaagccttcttgacaataacaagagggaactctaactcccacgcaatgaaggaatcaagcgctccgtagacttcttctttaacattcgacaattcttttatacaagcaatcatcttggcagccttggagatacttccaattctcttccttgttttccagactcgaggagatcgaggtcttggacctctagccgcacaaaccacaacattgttaggcctcttggagaagagtttagttgattcctttgtttgaggaagatacggcagtgaatatctcaagctaagcatcctcctttggattcgtcacagttaggcaaagagtgaagatga

SEQ ID NO: 812 - DNA, 1112 bp, Raphanus sativus
gagagatagagaagcgcaaatatcagagagacagcgaagaagaaaagaatcatcttttaactctttgcctaactgtgacgaatccaaagtgtaaggatgcttagcttgaggtattcattaccgtatcttcctcaaacaaaggaatcaactaaactcttctccaggaggcctagcaatgttgtggtttgtgcggctagaggtccaagacctcgatctcctcgagtatggaaaacaaggaagagaattggaagtatctccaagtctgccaagatgattgcttgtataaaagaattgtcgaacgttaaagaagaagtatacggagcgcttgactccttcattgcctgggagttagagttccctcttgtcatagtcaagaaggctttagctattcttgaagacgaaagagagtggaagaagattattcaggtgacaaaatggatgctgagcaaaggccaaggaagaacaatgggaacttacttctcattactaaacgctctagctgaagataaccggcttgacgaagctgaggaactatggaacaaattgttcatggagcatttagaaggaactccaagaaagttcttcaacaaaatgatctctatctattacaagagagacatgcaccacaaactctttgaggtgtttgctgacatggaagagcttggagtgaaacctaacattgcgattgtggatatggttgggaaagtgtttttgaaacttgggatgaatgataagtacgagaagctgatgaagaagtatcctccaccacagtgggagttcagatatatcaagggaagacgtgttaaggtcaaggctaagcagctgaatgagctaagcgaaggggaaggaggtttaagcagcgacgaagacaagattgagagtaaaactgaggaagcaaaccaagatggtgatgatttcagtgaagaggaagaagaaggtttgggggcgaatcaaagacagattggaacatctagagaaccatgtcttgatcatttggactctttttgacttataagtgttcacttaatgagcctttgagattttgtatatactattggatcatgcatggaaacattttgagtcatgtttctgtcagaaactcaagctcagtc

SEQ ID NO: 813 - DNA, 2413 bp, Eutrema halophilum
tgtctatgaattgtgtgctgaaaaggaaaaagctttgagattttgggctctatgaattgaatcctcaggatgcttagcttgagatattcactgccttatcttcctcaaacaaaggaatcaactaagctcttctccaagaggcctaacaatgttgtggtttgtgcggcaagaggtccaagacctcgacatcctcgagtatggaaaacaaagaagagaattggaagtatctccaaggctgccaaaatgctttcttgtataaaagaattgtcgaatgttaaagaagaagtttatggagcacttgattctttcattgcctgggaattagagttccctcttgttatagtcaagaaggcattagctattcttgaagatgaaagagaatggaagaagattattcaggtgacaaaatggatgctgagcaaaggccaaggaagaacaatgggaacttacttctcattacttaatgctctagcagaagataaccggcttgacgaagctgaggaattgtggaacaaattgttcatggaacatttagaaggaactccaagaaagttcttcaacaaaatgatctctatatattacaagagagatatgcaccacaaactcttcgaggtgtttgctgacatggaggagcttggagtgaaaccgaacattgcgattgtgtctatggttggaaaagtgtttatgaaacttgagatgaaggataagtacgagaagcttatgaagaaatatcctccaccacagtgggagttcagatacatcaaaggaagacgcattaaggtcaaggcaaagcagttaagcgagctaagcgaaggtgaaggcggggtaagcagcgatgaagataagactgatagtgagattgagagtaaatctgaaatgttttctgatgaggaagcaaaccaggatgctgaggatctcagtgaaaatgaagaagacgagaatgaactttttagtgggaatcaaggacagattggaacttctagagaattctcttttgatcatttggactctacttgacttagaatgtatgcttcatgagcttttgagatcgtatcttcagttggatcatgtaagggaaagagatcgacggccaaagttctccaaagaagctttctgggactgagctttggagttctgacgaaaacatgaccagaaaattgtgaattttgtaaggttgaagaacttagaaaagtcaaaacaagacataaattgaagagtctacttctgtcaaaaccagaagaaaagattgcaaaactcagcaaagaatgaaaaatgtaaagtcttttgagtatcactgtgtaagcttttaagacaaaaagtattgtaattcagatcaaagttaactcctttttgatattcaatcttcatctgatcccgagtcttcagaactagatcccttcttgtttactttcttcttcgatcctctcttcttcttatcttcctcgtcctcactgtattcactttcgtaatcctcctcttcaacctcatcttcctcttcctcctccataccttcttctgcaaactcaccctccaaatcacgggtccttttcaagacctcaactttcagtgatgtcttttggtcacaaccaatccaagcatcgctaaggcagaagcaagtcaagttataagtaccttcttcaggtgctaagagttttcccattaccaatcttgacccacttttaaccttctcaacagcttctctaactgcattgttttgagcctccacgcttgctcctaaactttccattgtctcactaatagcattcgatgcagctgttacagctccagcttcatccatgaaactaaccttctgaaagaaccagacgttgtttgaatccgcaagaagaatccaaaagttttcctctttgtggaaagggaagtaaggcgagtgaggaacagcgcctatgagtccattaggacgtttcagagtgatccaagcttcagccgtcacaatgtcgccttcttgaattccttcttcgccttctgttttgcaaatgacttctattttcagagacggtatcatttccaacaccttttcgacgtctacaacatcggtttctgacaaacccgtcacttctctgagcagtttagaacgctcttccgagctcagttcttgaaactcttggaatgatttaacttgcaatgctatctttttagcgatagagtcattgacatgagggagttgcaagaaaggagcaatgccttctgaagatgacttcctcgcactaagaggaacagcctgcaatcaaaacagcaactttacttaacctgaaaatttgcaaatgttttgagcaaaagcaaagttggaaaaatcttaatacttgaacaatgcattgagatagctccataactctgagtgcaggacttaaccatccacgtccttgttcattgtgaggtataaccgccatctgca

SEQ ID NO: 814 - DNA, 2380 bp, Eutrema parvulum
gagagagagagagagagagaagcgcaaatatcagaggcagcgaagaagacgaagaagaagcatcaacttagctttttgcctaactgtgaatccacatgtaagatgctttgcttacggtattcactaccttatcttcctcaaacaaaagaatcaactaaactcttctccaagaggcctaacaatgttgtggtttgtgcagcgagaggtccgaggcctcgatatcctcgagtatggaaaacaaggaagagaattggaagtatctccaaggctgccaaaatgattgcttgtataaaagaactgtcaaatgttaaagaagaagtttatggagcgcttgattctttcattgcttgggaattggagttccctcttgttatagttaagaaggcactagctattcttgaagatgaaagagagtggaagaagattattcaggtgacaaaatggatgctgagcaaaggccaaggaagaacaatggggacttacttctcattactgaatgctctagcagaagataaccggcttgacgaagctgaggaattgtggaaaaaattgttcatgcaacatttagaaggaactccaagaaagttcttcaacaaaatgatctctatatattacaagagagatatgcaccataaactattcgaggtgtttgctgacatggaggagcttggagtgaaaccaaatattgcgattgtgtccatggttggaaaggtgtttatgaaacttgggatgacggataagtacgagaagctgacgaagaaatatcctccaccacagtgggagttcagatacatcaaaggaagacgcgttaaggtcaaggcaaagcagctaaatgagctaagcgaaggtgaaggaggcttaagcagcgacgaagataatgttgataacgatattgagagtaaatctgaaatgttgtcaaataaggaagcatacaaagatgttgaggatgtcagtgaagaggaagaagaagaagaacttttgggtacgaaccaaggacaaattggaacttcaagagaaccctgtcatgatcatttggactcttcttgattttaagtgtttgctcatgagcttttgagattgtgtctatcgttggatcttgcaaggaaaagagatcgacaggcaaagttctttcgaagaagctttcttggactaagcttggaaacgtcaaaagaagacgcattgaagagtcaaccaatgtcaaaacaattaaaaaaagaaggtaaaacaaactgggcaaagaattaaaaaggtagtctttttgagtatgttcactgtgtaagctttgaaggcaaaaactattgtatttcagatcaaagtcaactcctttttgtttttcaatcttcatctgatcccgactcttcagaactcgatcccttcttgtttactttcttcttcgatcctctcttcttatcttcctcgtcctcactgtattcactttcgtaatcctcctcttcaatctcatcttcttcttcctcctccatatcttcatctgcaatctcaccctccaaatcacgggttcttttcaagacctccaatttcagtgacgtcctttggtcacaaccgatccaagcatcgcttaggcagaaacaagtcaagttgtaagtaccttctgcaggtgctaagagtcttcccattatcaatcttgacccacttttaaccttctcaacagcttcgctaactgcattgtttattgcctcgacacttgctcctaaactttccattgtctcagtaatagcattggatgcagcggttatagctccaacttcgtccatgaaactaaccttctgaaagaaccagacattgcttgaatccgctagaagaacccaaaagttttcctctttgtggaaagggaagtaaggcgagtgaggaatagcgcctatgagtccatttggacgtttcagagtgatccaagcttgaattgtcgtaatatcgccttcttgaataccttcttcgcctattgttttgcaagtgacgttgattttcagagaaggtatcatttctaacaccttctcgatgtctacaatatcggtttccgacaaaccagcaacctccctgagcagtttagaacgttcttccaaactcaattcttgaaactctcggaatgaactaacctgcatctttttagcgatagagtcattgagatgagggagttgcaagaaaggagcagtgccttctgaagatgacttccttgcactaagaggaacagcctgcaatcaaacaacaacaattattaaagctgaaaactcttacatgttttgggcaaaagtaaacttggaaaatctaaatacctgaacaatgcattgagatagctctatcactccgagtgcaggacttaaatatccacgcccttgttcattgtggggtataaccgccatctgca

SEQ ID NO: 815 - DNA, 2433 bp, Brassica rapa
taatgggccttttccattagtccaaaaacgcagcgtttcgtatgtttctggatgaggatttccgacagacatcagagagggaacttggaaggacagaggagatagagtgagaagcgcaaatatcagagagacagcgaagaaaaagaagaagaatcatcttcactctttgcctaactgtgacgaatccaaaggaggatgcttagcttgagatattcactaccgtatcttcctcaaacaaaggaatcaactaaactcttctccaagaggcctaacaatgttgtggtttgtgcggctagaggtccaagacctcgatctcctcgagtatggaaaacaaggaagagaattggaagcatctccaaggctgccaagatgattgcttgtataaaagaactgtcgaatgttaaagaagaagtctacggagcgcttgattcgttcattgcctgggagttagagttccctcttgttatagtcaagaaggctttagctgttcttgaagatgaaagagagtggaagaagattattcaggtgacaaaatggatgctgagcaaaggccaaggaagaacaatggggacttacttctcgttactaaacgctctagcagaagataaccggctggacgaagctgaggagctctggaacaaactgttcatggaacatttagaaggaactccaagaaagttcttcaacaaaatgatctctatctattacaagagagacatgcaccacaagctcttcgaggtgtttgctgacatggaggagcttggagtgaaaccgaatactgcgattgtgaatatggttgggaaagtgtttttgaaacttgggatggatgataagtatgagaagctgatgaagaagtatcctccaccgcagtgggagttcagatatatcaaaggaagacgcgttaaggtcaaggcaaagcagcttaatgagctaagcgaaggtgaaggaggcttaagcagcgacgaagacaagattgagagtaaatctgatatgttgtcagatgaggaagcaaaccaagatggtgaggattccagtgaagaggaagaaaaacttgtgggaatgaatcaaagacagattgaaacatctagagaaccctgtcttgatcattaggactcttcttgagcctttgagattgtatgtactgttggatcatgcacggaaaagagattgagagccaaagttatcaatgaagcttggggtactgactgaaagcatgacccaaaaggtttgaacttttgaggtaaagagcttagaaaaattcaaaacaagacaccaactaatgtgaaaacgataaagaaactcagcaaagaatctttgtgaatatcatcactgtgtaagctttgaagcaaaaactaatgtatttgaggtcaaacttaaactcctctgtttattcaatcttcatctgatccagactcttcagaactcgactccttcttgtttactttcttctttgatcctctcttcttgtcttcctcatcttcactgtattcactctcataatcttcctcttcaaggtcatcttcttcatcctcatccataccttcttctgcagcctcaccctccacatcacgggttcttttcaaaacctccactttcagtgatgtcttctggtcacaaccaatccaagcatcacttaggcagaagcaagtcaagttataagtaccttctgcaggtgccaagagcctccccatcaccaatcttgacccacttttaaccttctcaacagcttcttcaactgcactgttctttgcctcgacgcttgctcctaaactctccatcgtctcactaacagcaagcgaagcagtgcttatagcttcagcttcatccatgaaactaaccttctgaaagaaccagacgttgtttgaatccgcaagaataacccaaaagttctcctccttgtggaaagggaagtgaggcgagtgaggaacagctcccacgagtccattgggacgtttcagagtgatccaagcttgaactgtcgtcacgtcgccttcttgaataccttcttcccctgctgttttgcaagtgacttctattttcagagaaggtatcatttccaacaccttctccacgtctgcaacatcgctttcagacaaaccagcaacctccttaagaactttagaacgttcttctaagcttagttcttgaaactctttgaatgatccaacctgcaacgctatctttttggcgatagtttcattgaaatgagggagttgcaagaaaggagcagtgtcttctgaagatgacttcctcgcactaagaggaacagcctgcaatcaaacaacaacattaacaacattgcgactctaatgaggtaaagaacttaaagaaagcttattacctgaacaatgcattgagatagctctatgactcctagtgcaggacttaaccatccatgcccttgttcattgtggggtataactgccatctgca

SEQ ID NO: 816 - DNA, 1464 bp, Arabidopsis lyrata
atcagacatcagagggaactcttgggaggacacagagaagcgcaaatatcagagagtgtgaaaacgaagaagaagaagaaaccacaggatgcttagcttgagatattcattaccttatcttcttcttcaaacaaaggaatcatcaacaaagctcttctccaaaaggcctaacaatgttgtggtttgtgcagcgagaggtccaagacctcggtctcctcgagtatggaaaacaaggaagaggattggaactatctccaaggctgctaaaatgattgcttgtataaaaggattgtcgaatgttaaagaagaagtttacggagcgcttgattccttcattgcttgggagttagagtttcctcttgttatagttaagaaggcattagttatacttgaagatgaaaaagagtggaagaagattattcaggtgacaaaatggatgctgagtaaaggccaaggaagaacaatgggaacttacttctcattactaaatgctttagcagaagataatcggcttgacgaagctgaggaattgtggaacaagttgttcatggaacatttagaaggaactccaagaaagttcttcaacaaaatgatctctatatattacaagagagatatgcaccaaaagctcttcgaggtctttgctgatatggaggagcttggagtgaaaccgaatattgcgattgtgtctatggttggaaaagtgtttgtgaaattagagatgaaggataagtacgagaaactgatgaagaaatatcctccacctcagtgggagttcagatacatcaaaggaagacgtgttaaggtcaaggcaaagcagctaaatgagctaagcgaaggtgaaggtggtttaagcagcgacgaagataagattgatactgagattgagagaaccaaagcaagatggtgaggatcttagtgaagaggaagaagatgaaaaagaatttttgggtgggaatcaaggacagataggaacttctaaagaacccagtcttgatcatttggactcttcatgagagtttgagatcgtatcaaccgttgaatcatctataaggaaaagagatagacggccaaagttcttcaaagaagctttctggggctgtgcttcggtttctgaagaaaacatgaccagaaaagttttgaactatttgagcttaagagtcaaaacaagatatagatttgaagagtcaactaaaaagagtattaaattcagcaaaagattaaatactgtaaaatctttgagtacaactgtgtaagctttgaaaacaaaagttattgtataatttcagatcaaagttaactactttatgtttttttactcttcatctgatcctgactcttcagaactcgattccttcttgtttactttcttcttcgaccctctcttcttatcttcctcgtcttcgctgtattcgctttcgtaatcctcctcttcaatctcatcttcgtcgtcctccaatcctt

SEQ ID NO: 817 - DNA, 1059 bp, Brassica napus
gagaggagatagagtgagaagcgcaaatatcagagagacagcgaagaaaaagaagaagaatcatcttcactctttgcctaactgtgacgaatccaaaggaggatgcttagcttgagatattcactaccgtatcttcctcaaacaaaggaatcaactaaactcttctccaagaggcctaacaatgttgtggtttgtgcggctagaggtccaagacctcgatctcctcgagtatggaaaacaaggaagagaattggaagcatctccaaggctgccaagatgattgcttgtataaaagaactgtcgaatgttaaagaagaagtctacggagcgcttgattcgttcattgcctgggagttagagttccctcttgttatagtcaagaaggctttagctgttcttgaagatgaaagagagtggaagaagattattcaggtgacaaaatggatgctgagcaaaggccaaggaagaacaatggggacttacttctcgttactaaacgctctagcagaagataaccggctcgacgaagctgaggagctctggaacaaactcttcatggagcatttagaaggaactccaagaaagttcttcaacaaaatgatctctatctattacaagagagacatgcaccacaagctcttcgaggtgtttgctgacatggaggagcttggagtgaaaccgaacactgcgattgtgaatatggttgggaaagtgtttttgaaacttgggatggaggataagtacgagaagcttgtgaagaagtatcctccaccgcagtgggagtttaggtacatcaaaggaagacgcgttaaggtcaaggcaaagcagcttaatgagctaagcgaaggtgaaggaggctttagcagcgatgaggataataatggtgatgagattgagagtaaatctgaaatgttgttgtcagataaggaaccaaacaaagttgatgaacctgtaaaagaatcattacaacaagacaccaaagagagttttcaagattgaatttttcaaaatatctcatacaacagggggatgaaaatacaatcataataacattttctt

SEQ ID NO: 818 - DNA, 1185 bp, Brassica juncea
caaactcttctccaagaggcctaacaacgttgtggtttgtgctgccagaggtccaaggcctcgataccctcgagtatggaaaacaagaaagaggatcggaactatctccaaggctgccaaaatgattgcttgtataaaagaattgtcgaatgtgaaagaagaagtctacggagcgcttgattccttcattgcctgggagttagagttccctcttgttatagtcaagaaggctttagctattcttgaagacgaaagagagtggaagaagattattcaggtgacaaaatggatgctgagcaaaggccaaggaagaacaatgggaacttacttctcgttactaaacgctctagcagaagataaccgacttgacgaagctgaggagctgtggaacaaattgttcatggaacatttagaaggaactccaagaaagttcttcaacaaaatgatctctatctattacaagagagacatgcaccacaagctcttcgaggtgtttgctgacatggaggagcttggagtgaaaccgaacattgcgattgtgcatatggttgggaaagtgtttttgaaacttgggatgaatgataagtacgagaagctgatgaagaagtatcctccaccgcagtgggagttcagatatatcaaaggaagacgtgttaaggtcaaggcaaagcagctaaatgagctaagcgaaggtgaaggaggtttaagcagcgacgaagataagaccgatattgagattgagagtaaatctgaaatgctgttagatgaggaagcgaaccaagatggtgaggatttcagtgaagaggaagaagaacttgtgggaatgaatcaaagacagattgaacatctagaaaccatgtcttgatcatttggactcttcttgacttaaaattgttcacttcatgagcctttgagattgtatatactgttggatcatgcatggaaaagagttccagagccaaagttattcaatgaagctttcttgggttctgccgaaaacatgacacaaaacgttggaatttttgaggtaaagagcttaggaaaagtcaaaaacaagtcaccaactaatatccaaacgataaagaaaaagaatctctgagtatcatcactctgtaagcttaaaagctagaagcaaaaactaatgtatttgagatcaaagtaaaaactccttttttgtttattcaa

SEQ ID NO: 819 - DNA, 1073 bp, Brassica juncea
acacacagagagagtgagagattcatcaatggcggtttcttgcagccactcatcgattctcttgcccccatccacctcctccgttggcttcaaccgcttccctcgtctccaaacgctgcgtttcaaatccagaaacgtttatcagaaagctaggatctctacagtgtcggcgtcatcttcacggtctctcgaagctctgatcttcgactgcgacggtgtgatactcgaatcggagaacttacaccgtcaagcttacaacgacgccttctcgcatttcgatgttcgttgtcctccttcttcctccgagtctctcaactggagcctcgagttctacgacaagtttcagaacctggtcggaggtggaaagcctaaaatgagatggtactttagagaaaatggatggccaacttcgacccttttcgacacacctccagagagtgacgatgatcgagccaagttgatcgatagtcttcaggattggaagacagagaggtacaaagagatcataaagtcaggaagtgtagaagcaagacctggtgtaataagactaatggatgaagcaagagctgctgggaagaaactagctgtgtgttctgcagctacaaagagttcagttatattatgtctcgagaatctaatccaaatcgagcgattccaaggacttgattgcttccttgcaggagatgatgttaaggagaagaaacctgatccttccatttatataacagctgccgagaagctaggtgtttcagtgaatgactgtttggtcatagaggacagtgtgattggcctgcaggctgctacaaaagcaggcatgtcatgtgtgattacatacacttcttcaacatctgatcaggatttcaaagaggcgattgctgtataccctgatctcactaatgtgagcttgaaagacctggaaactctgcttcaaaccattgtcactgcagcttaatacatgcatttgtatatttttcatttttgtcttctcttctgcaactgtacatttgttattgtttaaaaaaaaaattcatttcatcgatcaaaatgatgattcaaccaaaaaaaaaaaaaaa

SEQ ID NO: 820 - DNA, 1127 bp, Raphanus sativus
  misc_feature (9)..(9): n is a, c, g, or t
ttttttttntatattttatctcactaagtcagagcagctcggatccacacacacacacatagagggttagagattcatcaatggcggtttcttgcagctactcatcgattctcttcccccgatccaccgcgggtacctcctccattggcttcaaccgcttcccttgtctccaaacgctgcgtttcaaatcaagaaacgtttatccaaaatctcgtgcttcttcagtctcggcatcatcagcttcacggtctctcgaagctctgatcttcgactgcgacggtgtgatactcgaatcggagaacttacaccgtcaagcttacaacgacgcattctcgcatttcgatgttcgatgtcctccttcctcatccgagtctctcaactggagcctcgagttctacgacaagtttcagaatcttgtcggaggtgggaaacctaaaatgagatggtactttagagagaatggatggccaacttcgacccttttcgacacacctccagagagtgacgatgatcgagccaagttgatcgatactcttcaggattggaagacagagaggtacaaagagatcattaaatcaggaggtgtagaagcaagacctggtgtaataagactaatggatgaagcaagagctgctgggaagaaactatctgtgtgttctgcagctacaaagagttcagttgtcttatgtcttgagaatctaatccaaatcgagcgattccaaggacttgattgctttcttgcaggagatgatgttaaggagaagaaacctgatccttctatatatataacagctgccgagaagctaggtgtttcagtgaaagactgtttggtcatagaggacagtgtgattggcctgcaggctgctacaaaagcaggcatgtcatgtgtgatcacatacacttcttcaacctctgatcaggacttcaaagaggcgattgctgtataccctgatctcagtaatgtgagcttgaaagagctggaaactctgcttcaaaccattgtcactgcagcttaatacacacatttgcctccttttcatttttgtttcttcgtctgcatttgtacatctgtttttgcttattaattttttttcattaatcatataaatagcagcacaattcaaaca

SEQ ID NO: 821 - DNA, 1041 bp, Brassica juncea
acacacagagagagtgagagattcatcaatggcggtttcttgcagccactcatcgattctcttgcccccatccacctcctccgttggcttcaaccgcttccctcgtctccaaacgctgcgtttcaaatccagaaacgtttatcagaaagctaggatctctacagtgtcggcgtcatcttcacggtctctcgaagctctgatcttcgactgcgacggtgtgatactcgaatcagagaacctacaccgtcaagcttacaacgacgccttcgcgcatttcgatgttcgttgtcctccttcttcctccgagtctctcaactggagcctcgagttctacgacaagtttcagaacctggtcggaggtggaaagcctaaaatgagatggtatttcagagaaaatggatggccaacttcgacccttttcgacacacctccagagagtgacgatgatcgagccaagttgatcgatagtcttcaggattggaagacagagaggtacaaagagatcataaagtcaggaagtgtagaagcaagacctggtgtaataagactaatggatgaagcaagagctgctgggaagaaactagctgtgtgttctgcagctacaaagagttcagttatattatgtctcgagaatctaatccaaatcgagcgattccaaggacttgattgcttccttgcaggagatgatgttaaggagaagaaacctgatccttccatttatataacagctgccgagaagctaggtgtttcagtgaatgactgtttggtcatagaggacagtgtgattggcctgcaggctgctacaaaagcaggcatgtcatgtgtaattacatacacttcttcaacatctgatcaggatttcaaagaggcgatttctgtataccctgatctcactaatgtgagcttgaaagacctggaaactctgcttcaaaccattgtcactgcagcttaatacatgcatttgtatatttttcatttttgtcttctcttctgcaactgtacatttgttattgtttaagaaaaaatcaaacctataatctc

SEQ ID NO: 822 - DNA, 990 bp, Brassica napus
ttcatcaatggcggtttcttgcagccactcatcgattctcttgcccccaaccacctcctccgttggcttcaacagcttcccttgtctccaaacgctgcgtttcaaatccagagacgtttatcagaaagcgaggatctctacagtgtcggcgtcatcttcacggtctctcgaagctctgattttcgactgcgacggtgtgatactcgaatcggagaatctacaccgtcaagcttacaacgacgccttcgcgcatttcgatgttcgttgtcctccttcttcatccgagtctctcaactggagcctcgagttctacgacaagtttcagaacctggttggaggtggaaagcctaaaatgagatggtactttagagaaaatggatggccgacttcgacccttttcgactcgcctcccgagagtgacgatggtcgagccaagttgattgatactctgcaggattggaagacagagaggtacaaagagatcataaagtcaggaagtgtagaagcaagacctggtgtaataagactaatggatgaagcaagagctgctgggaagaaactagctgtttgttctgcagctacaaagagttcagttatattatgtctcgagaatctaatccaaatcgagcgattccaaggacttgattgcttccttgcaggagatgatgttaaggagaagaaacctgatccttccatttatataacagctgccgagaagctaggtgtttcagtgaatgactgtttggtcatagaggacagtgtaattggcctgcaggctgctacaaaagcaggcatgtcatgtgtgatcacatacacttcttcaacatctgatcaggatttcaaagaggcgattgctgtataccctgatctcactaatgtgagcttgaaagacctggaaactctgcttcaaaccattgtcactgcagcttaatacgtgcatttgtatattttcatttttgtcttctcttctgcaactgtacatttgttatt

SEQ ID NO: 823 - DNA, 995 bp, Brassica oleracea
  misc_feature (659)..(659): n is a, c, g, or t
gacacgcgtccgcacacacacacactcagagtgagagattcatcaatggcggtttcttgcagccactcatcgattctcttgcccccaaccacctcctccgttggcttcaaccgcttcccttgtctccaaacgctgcgtttcaaatccagaaacgtttatcagaaagcgaggatctctacagtgtcggcgtcatcttcacggtctctcgaagctctgatcttcgactgcgacggtgtgatactcgaatcggagaatctacaccgtcaagcttacaacgacgccttcgcgcatttcgatgttcgttgtcctccttcttcatccgagtctctcaactggagcctcgagttctacgacaagtttcagaacctggtcggaggtggaaagcctaaaatgagatggtactttagagaaaatggatggccgacttcgacccttttcgactcgcctcccgagagtgacgatggtcgagccaagttgattgatactctgcaggattggaagacagagaggtacaaagagatcataaagtcaggaagtgtagaagcaagacctggtgtaataagactaatggatgaagcaagagctgctgggaagaaactagctgtttgttctgcagctacaaagagttcagttatattatgtctcgagaatctaatccnaatcgagcgattctaaggacttgattgcttccttgcaggagatgatgttaaggagaagaaacctgatccttccatttatataacagctgccgagaagctaggtgtttcagtgaatgactgtttggtcatagaggacagtgtaattggcctgcaggctgctacaaaagcaggcatgtcatgtgtgatcacatacacttcttcaacatctgatcaggatttcaaagaggcgattgctgtataccctgatctcactaatgtgagcttgaaagacctggaaactctgcttcaaaccattgtcactgcagcttaatacatgcattgatatattttcatttt

SEQ ID NO: 824 - DNA, 1247 bp, Brassica rapa
ttaatgggccttagtgacccaaaagccatttggtgtatgatagaaaagttagttaaataccgttactcgcaaggaagaccacacatttttttttaattctatctcacttagtcagagcagctcggatccacacacagcgtgagagattcatcaatggcggtttcttgcagccactcatcgattctcttgcccccatccacctcctccgttggcttcaaccgcttccctcgtctccaaacgctgcgtttcaaatccagaaacgtttatcagaaagctaggatctctacagtgtcggcgtcatcttcacggtctctcgaagctctgatcttcgactgcgacggtgtgatactcgaatcggagaacttacaccgtcaagcttacaacgacgccttcgcgcatttcgatgttcgttgtcctccttcttcctccgagtctctcaactggagcctcgagttctacgacaagtttcagaacctggtcggaggtggaaagcctaaaatgagatggtactttagagaaaatggatggccgacttcgacccttttcgagtcgcctccagagagtgacgatgatcgagccaagttgatcgatagtcttcaggattggaagacagagaggtacaaagagatcataatgtcaggaagtgtagaagcaagacctggtgtaataagactaatggatgaagcaagagctgctgggaagaaactagctgtgtgttctgcagctacaaagagttcagttatattatgtctcgagaatcttatccaaatcgagcgattccaaggacttgattgcttccttgcaggagatgatgttaaggagaagaaacctgatccttccatttatataacagctgccgagaagctaggtgtttcagtgaatgactgtttggtcatagaggacagtgtgattggcctgcaggctgctacaaaagcaggcatgtcatgtgtaattacatacacttcttcaacatctgatcaggatttcaaagaggcgatttctgtataccctgatctcactaatgtgagcttgaaagacctggaaactctgcttcaaaccattgtcactgcagcttaatacatgcatttgtatatttttcatttttgtcttctcttctgcaactgtacatttgttattgtttaaaaaaaaaattcatttcatcgatcaaaatgatgattcaaccatataaataacattacaatacaaacaagacccaccatgtatccagagccagtccagaggacaag

SEQ ID NO: 825 - DNA, 1640 bp, Triticum aestivum
ctcgccatggcagccgccgacgaggcgcagggcttccgcccgctggacgaggcgtcgctggtggcctacatccgggcgaccccggcgctggccgccagcctcggcggccgcgtcgacgacctcgccgtcaaggaggtcggcgacggcaacctcaacttcgtctacatcgtcacctccgacgccggctccgtcgtcgtcaagcaggctctgccgtacatccgctgcgtgggggactcgtggccgatgacaagggagcgggcctactttgaggcctccgcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtcgagtaccccctcctcgccgagcacatgtccgactacatggccaagaccctcttcttcacctccctcctctacaactccaccaccgagcacaagaagcaagttgctcgctactgcgagaacgtggagatgtgcaggctcacggagcaggtcgtcttctcggacccatacatggtctccaaatacaatcgctggaactcgccattcctcgacaaggacgccgaggcggtgcgagaggatgatgggctgaagttggagattgctgaattgaagtcgatgtttatcgagagagcccaggccctgattcatggagatctccatactggttccatcatggtgaccccagattccactcaagtgattgatccggagtttgccttctacgcgccgatgggttacgacattggggccttcttggggaacctgattctggcgtactttgcacaggatgggcatgctgatcaaacgaatgaccgtaaagcttataagcaatggatattgaagaccatcgaagaatcatggaatttgttccagcagaaatttttgggactctggaataaacacaaagatgggaatggggaggcatacctgcctgccatatacaacaacccggagcttttgagcgttgtacagaagaagtacatgacaggtctacttcatgatagtcttggatttggttcagccaaaatgatcaggagaattgttggaattgcccatgtcgaggattttgactcaattgaggatgccagcaagagagcatcatgtgagcgccgtgcgcttgattgtgccaaggcaatcctgaaggggcgacgccaatttgagagcatcgagcaggttattgtgcatgtccaatcagtaaatcatgactgagaaaaccagccgtctgttctgcgtttccagttgaggagacctcggttgattgttattgggattgagtacccacgctcaagtatcgagatgtgctgctctttgtaaaacatccatgggtcagtgtggcttatatgtattgtgtagtgggctgccttcagagatacctatacttgggtcgagaacatcctgtgtgtatttctagtgcaaggcaggctgccttgcagcatagctgcgagttgaataacagaatgtacaatgtatctcaacgttgtacaattatccatagatacaggcgcggtcgccaccaataaaaccctatctggggtaagggtttggccaagcagattgtttgtactgta

SEQ ID NO: 826 - DNA, 1887 bp, Secale cereale
gacttgttgccagatacccgtccaggttcagagcacgcactattaatacagagcggcagcgtctctgttctcgcacgcacacagcgtaaactccggcgattcccgactctctcagtcccgatccactccgccgccgagcccgcccgccatggccgccgccgacgaggcgcagggcttccgcccgctggacgaggcgtcgctggtggcctacatccgggcgaccccggcgctggccgccagcctcggcggccgcgtcgacgacctcgtcgtcaaggaggtcggcgacggcaacctcaacttcgtctacatcgtcacctccgacgccggctccatcgtcgtcaagcaggcgctgccgtacatccgctgcgtgggggactcgtggccgatgacgagggagcgggcctacttcgaggcctcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtcgagtacccgctgctcgccgaccacatggccgactacatggccaagaccctcttcttcacctccctcctctacaactccaccacggaccacaagaagcaagttgctcggtactgcgagaacgtggagatgtgcaggctcacggagcaggtcgtgttctcggacccatacatggtctccaaatacaatcgctggaactcgcctcttctcgacaaagatgccgaagctgttcgacaggatgatgggctcaagttggagattgctgaattgaagtcgatgtttattgagagagcgcaggctctgattcacggagatctccatactggttccatcatggtgaccccagagtccactcaagtgattgatccggagtttgccttctacgcgccgatgggttacgacattggggccttcttggggaacctgattctcgcgtacttcgcacaggatgggcatgctgatcagacaaatgaccgtaaagcttataagcaatggatattgaagaccattgaagaatcgtggaatttgttccagcagaaatttttgggactctggaataaacacaaagatgggaatggggaggcatacctgcctgccatatacaacaacccagagcttttgagcgttgtacagaagaagtacatgacaggtttacttcatgacagtcttggatttggttcggccaaaatgatcaggagaattgttggaattgcccatgtcgaggattttgactcaatcgaggatgccagcaagagagcatcatgtgagcgccgtgcgcttgattgtgccaaggcaatcctgaagggccgacgccaatttgagagcatcgagcaagttattgcgcacgtccagtcagtaactcatgactgagaaaaccagccgtctgttcggcgtttccggttgaggagacctcgcttgattgttgtcaggattgagtacccacgctcaagtatcgagatgtgcggcgtttccggttgaggagacctcgtttgattgttgtcaggattgagtacccacgctcaagtatcgagatgtgctgctctttgcaaaacatccttgtgtctgtgtggcttatgtgtattgcgtagtgggctgcagcgatacctatgcttgggttgagaagatcctgtgtgtatttctagtgtaaggcaggctgccttgcagcatagctgtgagttgaataacagaatgtacaatgtatctcgacgttgtacaattatccgtagatacaggcgtggttgccaccaataaaaccctatctgggtaggttttgcgaagctgattgtttgtactgtaacacctgttggctaaattacacattcatttaagaaata

SEQ ID NO: 827 - DNA, 1769 bp, Triticum aestivum
ggcacacactctccacgacaccgtaaaccccggcccctccggcgattccccactctctcagccccgatccactccgccgccgcgccagctcgccatggctgccgccgacgaggcgcagggcttccgcccgctggacgaggcgtcgctggtggcctacatccgggcgaccccggcgctggccgccagcctcggcggccgcgtcgacgacctcgccgtcaaggaggtcggcgacggcaacctcaacttcgtctacatcgtctcctccgacgccggctccgtcgtcgtcaagcaggcgctgccgtacatccgctgcgtgggggactcgtggccgatgacgagggagcgggcctactttgaggcctccgcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtcgagtaccccctcctcgccgagcacatgtccgactacatggccaagaccctcttcttcacctccctcctctacaactccaccaccgagcacaagaagcaagttgctcgctactgcgagaacgtggagatgtgcaggctcacggagcaggtcgtcttctcggacccatacatggtctccaaatacaatcgctggaactcgccattcctcgacaaggacgccgaggcggtgcgagaggatgatgggctgaagttggagattgctgaattgaagtcgatgtttatcgagagagcccaggccctgattcatggagatctccatactggttccatcatggtgaccccagattccactcaagtgattgatccggaatttgccttctacgcgccgatgggttacgacattggggccttcttggggaacctgattctggcgtactttgcacaggatgggcatgctgatcaaacgaatgaccgtaaagcttataagcaatggatattgaagaccatcgaagaatcatggaatttgttccagcagaaatttttgggactctggaataaacacaaagatgggaatggggaggcatacctgcctgccatatacaacaacccggagcttttgagcgatgtacagaagaagtacatgacaggtctacttcatgatagtcttggatttggttcagccaaaatgatcaggagaattgttggaattgcccatgtcgaggattttgactcaattgaggatgccagcaagagagcatcatgtgagcgccgtgcgcttgattgtgccaaggcaatcctgaaggggcgacgccaatttgagagcatcgagcaggttattgtgcatgtccaatcagtaaatcatgactgagaaaaccagccgtctgttctgcgtttccagttgaggagacctcggttgattgttattgggattgagtacccacgctcaagtatcgagatgtgctgctctttgtaaaacatccatgggtcagtgtggcttatatgtattgtgtagtgggctgccttcagagatacctatacttgggtcgagaacatcctgtgtgtatttctagtgcaaggcaggctgccttgcagcatagctgcgagttgaataacagaatgtacaatgtatctcaacgttgtacaattatccatagatacaggcgcggtcgccaccaataaaaccctatctggggtaagggtttggccaagctgattgtttgtactgtaacacctgttggttgatgttagcctggctaaattacacattt

SEQ ID NO: 828 - DNA, 1729 bp, Triticum aestivum
ccccccgatccagctcgcccgccatggccgccggcgacgaggagcagggcttccgtccgctggacgaggcgtcgctggtggcctacatccgggcgaccccggcgctggccgccagcctcggcggccgcgtcgacggcctcgccgtcaaggaggtcggcgacggcaacctcaacttcgtctacatcgttacctccgacgccggctccgtcgtcgtcaagcaggcgctgccgtacatccgctgcgtgggggactcgtggccgatgacgagggagcgggcctacttcgaggcgtcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtccagtacccgctcctcgccgaccacatggccgactacatggccaagaccctcttcttcacctccctcctctacaactccaccaccgagcacaagaagcaagttgctcgctactgcgagaacgtggagatgtgcaggctcacggagcaggtcgtcttctcggacccatacatggtctccaaatacaatcgctggaactcgcctctcctcgacaaggacgccgaagccgttcgggaggatgatgggctgaagttggagattggtgaactgaagtccatgtttattgagagagcgcaggctctgattcatggtgatctccatactggttccatcatggtgaccccagattccactcaagtgattgatccggagtttgccttctacgcgccgatgggttacgacattggggccttcttggggaacctgattctggcctacttcgcacaggatgggcatgctgatgaagcaaatgaccgtaaggcttataagcaatggatattgaagacgatcgaagaatcatggaatttgttccagcagaaatttctgggactttggaataaacacaaagatgggaatggggaggcatacctgcctgccatatacaacaacccggagcttttgagcgttgtacagaagaagtacatgacaggtttacttcatgacagtcttggatttggttcggccaaaatgatcaggagaattgttggaattgcccatgtggaggattttgactcaatcgaggatgccagcaagagagcatcatgtgagtgccgcgcgcttgattgtggcaaggcaatcctgaagggccgccgccaatttgagagcatcgagcaagtgattgcacttgtccagtcagtaactcaagactgagaaaaccagccgtctgttcggcgtttccgattgaggagacctcgtttgatcgttatcaggattgagtaccgacgctcgagtatcgagatgtgctgccctttgtaaaacatccttgggtcagtgtggcttatgtgtattgtgtagtgggctgccttcagagatacctatacttgggtcgggaacatcatgtgtgtatttctagtgtaaggcaggctgccttgcagcatagctgtgagttgaataacagagtgtacaatgtatctcaacgttgtacaattatccatagatacaggcgtggtcgccaccaataaaaccatatctggtaggttttgccaagcagattgtttgtactgtaacacctgttggttgatgttagcctggctaaattacagattcatttgagtaaatcaaagacatgggataaatatcag

SEQ ID NO: 829 - DNA, 1455 bp, Secale cereale
gcagggcttccgcccgctggatgaggcctcgctggtggcctacatccgggcgaccccggcgctggccgccagcccggcggccgcgtcgacgacctcgccgtcaaggaggtcggcgacggcaacctcaacttcgtctacatcgtcacctccgacgccggctccatcgtcgtcaagcaggcgctgccgtacatccgctgcgtgggggactcgtggccgatgacgagggagcgggcctacttcgaggcctcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtcgagtacccgctgctcgccgaccacatggccgactacatggccaagaccctcttcttcacctccctcctctacaactccaccacggaccacaagaagcaagttgctaggtactgcgagaacgtggagatgtgcaggctcacggagcaggtcgtgttctcggacccatacatggtctccaaatacaatcgctggaactcgcctcttctcgacaaagatgccgaagctgttcgacaggatgatgggctcaagttggagattgctgaattgaagtcgatgtttattgagagagcgcaggctctgattcatggagatctccatactggttccatcatggtgaccccagagtccactcaagtgattgatccggagtttgccttctatgcgccgatgggttacgacattggggccttcttggggaacctgattctcgcgtacttcgcacaggatgggcatgctgatcaaacaaatgaccgtaaagcttataagcaatggatattgaagaccattgaagaatcgtggaatttgttccagcagaaatttttgggactctggaataaacacaaagatgggaatggggaggcatacctgcctgccatatacaacaacccagagcttttgagtgttgtacagaagaagtacatgacaggtttacttcatgacagtcttggatttggttcggccaaaatgatcaggagaattgttggaattgcccatgtggaggattttgactcaatcgaggatgccagcaagagagcatcatgtgagcgccgtgcgcttgattgtgccaaggcaatcctgaagggccgacgccaatttgagagcatcgagcaagttattgcgcacgtccagtcagtaactcatgactgagaaaaccagccgtctgttcggcgtttccggttgaggagacctcgcttgattgttgtcaggattgagtacccacgctgaagtatcgagatgtgctgctctttgaaaaacatccttcggtctgtgtggcttatgtgtattgcgtagtgggctgcagcgatacctatgcttgggttgagaacatcctgtgtgtatttctagtgt

SEQ ID NO: 830 - DNA, 1634 bp, Secale cereale
ccgggcgaccccggcgctcgccgccagcctcggcggccgcgtcgacgacctcgccgtcaaggaggtcggcgacggcaacctcaacttcgtctacatcgtcacctccgacgccggctccgtcgtcgtcaagcaggcgctgccgtacatccgctgcgtgggggactcgtggccgatgacgaaggagcgggcctacttcgaggcctcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtccagtacccactcctcgccgaccacatggccgactacatggccaggaccctcttcttcacctccctcctctacaactccaccaccgaccacaagaagcaagttgctcgctactgcgagaacgtggagatgtgcaggctcacggagcaggtcgtgttctcggacccatacatggtctccaaatacaatcgctggaactcgccgtttcttgacaaggacgccgaagcggttcgggaggatgttgagctcaagttggagattgctgaactgaagtcgatgtttatcgagagagcccaggccctgattcatggggatctccatactggttccatcatggtgaccacagaatccacccaagtgatcgatccagagtttgcattctacgcgccgatgggttatgacattggggccttcttggggaacctgattctggcctactttgcacaggatgggcatgctgatcaaacaaatgaccgtaaagcttataagcaatggatattgaagaccattgaagaatcgtggaatttgttccagcagaaatttctgggactttggaataaacacaaagatgggaatggtgaggcgtacctgcctgccatatacaacaacctggagcttttgagcgttgtacagaagaagtacatgacaggtttacttcatgatagtcttggatttggttcggccaaaatgatcaggagaattgttggaattgcccatgtggaggattttgactcaattgaggatgccagcaagagagcatcatgtgagcgccgtgcgcttgattgtgccaaggcaatcctgaaaggccgacgccaatttcagagcatcgagcaagttattgcacacgtccaatcagtaactcatgactgagaaaaccagccgtctgttcggcgtttccggctgaggagaccttgcttgattgttgtcaggattgagtacccacgctcaagtatcgagatgagctgctctttgcaaaacatccttgggtctgtgtggcttgtgtgtattgcgtagtgggctgcagtgatacctatgcttgggttgagaacatcctgtgtgtatttctagtgtaaggcaggctgccttgcagcatagctgtgagctgaataacagagtgtacaatgtatctcaacgttgtacaattatccatagatacaggcatggtcgccaccaataaaatcctatctgggtaggttttgccaagcagattgtttgtggtattgtaacacctgttggttgatgttcgcctgactaaattacacatttatttgagaaataaaacacaagcacagtc

SEQ ID NO: 831 - DNA, 1788 bp, Secale cereale
acacagcgtaaactccggcgattcccgactcgtctcagtcccgatccactccgccgccgagcccgcccgccatggccgccgccgacgaggcgcagggcttccgcccgctggacgaggcgtcgctggtggcctacatccgggcgaccccggcgctggccgccagcctcggcggccgcgtcgacgacctcgtcgtcaaggaggtcggcgacggcaacctcaacttcgtctacatcgtcacctccgacgccggctccatcgtcgtcaagcaggcgctgccgtacatccgctgcgtgggggactcgtggccgatgacgagggagcgggcctacttcgaggcctcggcgctgcgggagcacggccgcctctgcccggaccacgcccccgaggtctaccacttcgaccgcgccatgtcgctcatcgggatgcgctacatcaagccgccccacatcatcctccgcaagggcctcatcgccggcgtcgagtacccgctgctcgccgaccacatggccgactacatggccaagaccctcttcttcacctccctcctctacaactccaccacggaccacaagaagcaagttgctaggtactgcgagaacgtggagatgtgcaggctcacggagcaggtcgtgttctcggacccatacatggtctcaaaatacaatcgctggaactcgcctcttctcgacaaagatgctgaagctgttcgacaggatgatgggctcaagttggagattgctgaattgaagtcgatgtttatcgagagagcccaggctctgattcatggagatctccatactggttccatcatggtgaccccagagtccactcaagtgattgatccggagtttgccttctacgcgccgatgggttacgacattggggccttcttggggaacctgattctggcatactttgcacaggatgggcatgctgatcaaacaaatgaccgtaaagcttataagcaatggatattgaagaccatcgaagaatcgtggaatttgttccagcagaaatttttggcactctggaataaacacaaagatgggaatggagaggcatacctgcctgccatatacaacaacccagagcttttgagcgttgtacagaagaagtacatgacaggtttacttcatgacagtcttggatttggttcggccaaaatgatcaggagaattgttggaattgcccatgtcgaggattttgactcaatcgaggatgccagcaagagagcatcatgtgagcgccgtgcgcttgattgtgccaaggcaatcctgaaggcggacgccaattgagagcatcgagcaagttattgcgcacgtccagtcagtaactcatgactgagaaaaccagccatctgttcggcgtttccggttgaggagacctcgcttgattgttatcatgattgagtacccacgctcaagtatcgagatgtgctgctctttgcaaaacatccttcggtctgtgtggcttatgtgtattgcgtagtgggctgcagcgatacctatgcttgggttgagaacatcctgtgtgtattctagtcgtaaggccaggctgccttggagcatagctgtgagttgaataacaggatgtacaatgtatctcaacgttgtacaattatccatagatacaggcgcggtcaaccctatctgggtaggttttgccaagctgattgtttgtactgtaacacctgttggctaatgtgacaccccgagaccggtgcgccaggtgtcagtcagctattcgtcgttgtcgctatgtcatctgcttgcgtgttgtatcttgcca

SEQ ID NO: 832 - DNA, 1673 bp, Secale cereale
accgtaaaccccggccgattccccactctctcagtcccgatccactccgccgccgagcccgctcgccatggccgcgccggcgaggcgcagggcttccgcccgctggacgaggcgtcgctggtggcctacatccgggcgaccccggcgctggccgccagcctcggcggccgcgtcgacgacctcgccgtcaaggaggtcggcgacggcaacctcaacttcgtctacatcgtcacctccgacgccggctccatcgtcgtcaagcaggcgctgccgtacatccgctgcgtgggggactcgtggccgatgacgagggagcgggcctacttcgaggcctcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtcgagtacccgctgctcgccgaccacatggccgactacatggccaagaccctcttcttcacctccctcctctacaactccaccacggaccacaagaagcaagttgctaggtactgcgagaacgtggagatgtgcaggctcacggagcaggtcgtgttctcggacccatacatggtctccaatcatcgctggaactcgcctcttctcgacaaagatgccgaagctgttcgacaggatgatgggctcaagttggagattgctgaattgaagtcgatgtttattgagagagcgcaggctctgattcacggagatctccatactggttccatcatggtgaccccagagtccactcaagtgattgatccggagtttgccttctatgcgccgatgggttacgacattggggccttcttggggaacctgattctcgcgtacttcgcacaggatgggcatgctgatcaaacaaatgaccgtaaagcttataagcaatggatattgaagaccattgaagaatcgtggaatttgttccagcagaaatttttgggactctggaataaacacaaagatgggaatggggaggcatacctgcctgccatatacaacaacccagagcttttgagtgttgtacagaagaagtacatgacaggtttacttcatgacagtcttggatttggttcggccaaaatgatcaggagaattgttggaattgcccatgtggaggattttgactcaatcgaggatgccagcaagagatcatcatgtgagcgccgtgcgcttgattgtggcaaggcaatcctgaagggccgacgccaatttgagagcatcgagcaagttattgcgcacgtccagtcagtaactcatgactgagaaaaccagccatctgttcggcgtttccggttgaggagacctcgcttgattgttgtcaggattgagtacccacgctcaagtatcgagatgtgctgctctttgcaaaacatccttcggtctgtgtggcttatgtgtattgcgtagtgggctgcagcgatacctatgcttgggttgagaacatcctgtgtgtatttctagtgtaaggcaggctgccttgcagcatagctgtgagttgaataacagaatgtacaatgtatctcaacgttgtacaattatccatagatacaggcgcggtcgccaccaataaaaccctatctgggtaggttttgccagtc

SEQ ID NO: 833 - DNA, 1724 bp, Avena sativa
cggctaaaacctccggcgattccccactctccgccgatctgttccgcgacccccgacgccgcaccagccagccatggccaccgccaccgccacagccgcggagcttgaggcgcagggcttccgcccgctcgacgaggcgtccctggtggcctacatccgggccacccccgcgctcgcagccagcctcggcggccgcgtcgacgccctcgaggtcaaggaggtcggcgacggcaacctcaacttcgtatacatcgtcctctccgaaggcggctccgtcgtcgtcaagcaggcgctgccgtacgtccgctgcgtgggggactcgtggccgatgacgagggagcgagcctacttcgaggcctccgcgctgcaggagcacggccgcctctgcccggaccacgtgccggaggtctaccatttcgaccgtgccatgtccctcatcgggatgcgctacatcaagccgccgcacatcatcctccgcaagggcctcatcgccggcgtccagtacccgctgctcgcagagcacatggccgagtacatggccaggaccctcttcttcacctccctcctctacaactccaccacggaccacaagaaacgagttgctcagtactgcgggaacgtggagctgtgcaggctcacggagcaggttgtgttctcggacccatacatggtctccaaatttaaccactggacctcgccgtttctcgacaaagatgccgaagcggttcgagaggatgatgggctcaagttggaaattgctgaattgaagtcaatgttcatcgagagagcgcaggctctgattcatggagatctccatactggttccatcatggtgaccacagactccactcaagtgattgatccggagtttgctttctacggaccaatgggttatgacattggggccttcttggggaacctgattctcgcatactttgcacaggatgggcatgctgatcaggcaaatgaccgtaaagattacaaggagtggatattgaagaccatcgaggagtcatggaattcgttccaacagaaatttgttggactgtggaacaaacacaaagatgggaatggggaggcatacctgcctgccatatacaacaacccagagcttttgagcgttgcacagaagaagtacatgacaagtctgtttcatgatagtcttggatttggttcagccaaaatgatcaggagaatagttgggatcgctcatgtcgaggatttcgactcgattgaggatgccagcaagagagcatcgtgtgagcgccgtgcgcttgactgtgcaaaggcaatcctgaagggccgccgccagttcgagagcatcgagcaagtgattgctcgcatccgatcaataactcactgactgagaagaccaggagttatgcttggtgtctcccatcaaccgagaccctttggttggagtttatcatggtagactacacacactctatcaaagcaggaccgtgccttgtaaaaaacatcattgagcggctatctatgttttctgtattgggttggagaggaaccccccttcagcgatactacttcaggggagtcgagtccgacctgtgtgtatttcttgtgtaaggcaggccttccggcatactagctgttagctgaataagtgcagtcccattgcttgcacttgtatcaaaaagcttaccaactactcgtgccgtttggggctttagtcacagatcacaagagagactaaaaaaaaaaaa

SEQ ID NO: 834 - DNA, 1696 bp, Secale cereale
ggggcgtgtcgtctgtgtgcgtaaactccggccgattcccgacctctctcagtcccgactccactccgccgccgagcccgcccgccatggccgccgccgacgaggcgcagggctccgcccgctggacgaggcgtcgctggtggcctacatccgggcgaccccggcgctggccgccagcctcggcggccgcgtcgacgacctcgtcgtcaaggaggtcggcgacggcaacctcaacttcgtctacatcgtcacctccgacgccggctccatcgtcgtcaagcaggcgctgccgtacatccgctgcgtgggggactcgtggccgatgacgagggagcgggcctacttcgaggcctcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtcgagtacccgctgctcgccgaccacatggctgactacatggccaagaccctcttcttcacctccctcctctacaactccaccacggaccacaagaagcaagttgctcggtactgcgagaacgtggagatgtgcaggctcacggagcaggtcgtgttctcggacccatacatggtctcaaaatacaatcgctggaactcgcctcttctcgacaaagatgccgaagctgttcgacaggatgatgggctcaagttggagattgctgaattgaaatcgatgtttattgagagagcccaggctctgattcacggagatctccatactggttccatcatggtgaccccagagtccactcaagtgattgatccggagtttgccttctatgcgccgatgggttacgacattggggccttcttggggaacctgattctcgcgtacttcgcacaggatgggcatgctgatcaaacaaatgaccgtaaagcttataagcaatggatattgaagaccattgaagaatcgtggaatttgttccagcagaaatttttgggactctggaataaacacaaagatgggaatggggaggcatacctgcctgccatatacaacaacccagagcttttgagtgttgtacagaagaagtacatgacaggtttacttcatgacagtcttggatttggttcggccaaaatgatcaggagaattgttggaattgcccatgtcgaggattttgactcaatcgaggatgccagcaagagagcatcatgtgagcgccgtgcgcttgattgtgccaaggcaatcctgaagggccgacgccaatttgagagcatcgagcaagttattgcacacgtccagtcagtaactcatgactgagaaaaccagccatctgttcggcgtttccggttgaggagacctcgtttgattgttaccaagattaagtacccacgctcaagtatcgagatgtgctgctctttgtaaaacatccttgggtctgtgtggcttatgtgtattgcgtagtgggctgcagcgatacctatgcttgggttgagaacatcctgtgtgtatttctagtgtaaggcaggctgccttgcagcatagctgtgagttgaataacagaatgtacaatgtatctcgacgttgtacaattatccgtagatacaggcgtggttgccaccaataaaaaccctatctgggtaggttttgccagtc

SEQ ID NO: 835 - DNA, 2407 bp, Brachypodium distachyon
gccgagaagaacgacacgaagattgatttgttcgactacacgtgccaccgtaccgttggtgttcaagctttttactagtcagagattcctaaccctccattggtgaccgggacaggacggccgaaagccgtaaactagtccaggttcatactacaaggcactgtttaacaggggaaatccccaccgcttctctgctttgctcgcacttgcacacacgccgcggcaggcttaaaccccggcgattccccactcaatttcccgggagcccttccgccggatccgaccgtccgcacacgccagtcaggcagccatggccgccgccgccacggcggaggagggggggttccgcccgctcgacgaggcctccctggtggcctacatccgggccaccccggccctcgccgccagtctcggcggccgcgtcgacgcgctcaccgtcaaggaggtcggcgacggcaacctcaacttcgtctacatcgtcctctccgacgccggatccgtcgtcgtcaagcaggcgctgccgtacatccgctgcgtgggggactcgtggccgatgacgagggagcgggcctacttcgaggcctcgacgctgcaggagcacggccgcctctgcccggaccacgtcccggaggtctaccacttcgacagggccatgtcgctcatcgggatgcgctacatcaagccgccacacatcatcctccgcaaggggctcgtcgccggcgtccagtacccgcttctcgccgagcacatggcggagtacatggccaggactctcttcttcacctccctcctctacaactccaccacggatcacaaggcgaaagttgctcagtactgtgggaacatcgagatgtgcaggctcacggagcaagtcgtgttctccgacccgtacatggtcgccaaatacaatcgctggacctcgccttttctcgatgaagatgccgaagctgttcgaggggatgacgagctgaagttggaaattgctgaattgaagtcaatatttatcgagagagcacaggctctgattcatggagatctccatactagttccatcatgctgaccacagattccactcaagtgattgatccggagtttggtttctatgggccaatgggttacgacgttggggccttcttggggaacctgattctggcatactttgcgcaggatgggcatgctgatcaaacaaatgaccgtaaagcttacaaggaatggatattgaagaccatcgaagagtcatggaatttgttccataagaagtttgtcggactgtggaataaacacaaagatgggaatggggaggcatacctgcctgccatatacaacaacccggagcttttgagccttgcacagaagaagtacatgacagatctatttcatgacagtcttgggtttggttcagccaaaatgatcaggagaatagttgggatcgctcacgtcgaggatttcgagtcaattgaggatgccagcatgagagcaacatgtgagcgccgtgcgcttgattgcgcgaaggcaatcctgaaaggaagacgccaattcgagggcatcgagcaagtgattgcgcatgtccagtcaatcacccatgactgagaagaccagccatctgtttggtgtttccggttgaggacactcttttgtcagttatcacggttagcaacacctttgcccagctatcggcgaactgaagcagcattgggcggctatttatcttttctgtaccgggatggtgaggaaacctccttcagatcgatagccctcgagaccagcctgcgtgtaattctagtgtggaaccttccagcataggtgctagctgaataatggcgatgtatgacatatatcatacgtttatacatccatacatgcagttgtgggctgcaaccaataaaaccctgtttggattaggttttcgccaagcagtttgtctgtataacaccctgttggtttctcgtgtggattgcatttcctttcgggggggagctttgagcatattaagcagatgagattcccgtgtggttctgtaacagtttctcccccaccatgttgacacatggacctgcagtctgcagtggatactcatcactatggcatcttcagaaattacgtaggcgaggatatgctaacaagctgagtgaattcccggcgcgaaaaatcgtttcgatttcagctgttcccggatgcaatctgcgtggaattcatcggaggtttatttcccattaaactctcgaggaggacgtgctgagggcggtggagaccgtgcacgcgatgatcgaccgggaggtctccggcggcaccagcccggcagacgtgttcgtcttcgggctcagccagggaggtgggtcttctactacacgttctttttcatctacttagaattgcagcacaactcgggtaacaggctgaagaaca

SEQ ID NO: 836 - DNA, 1500 bp, Leymus cinereus x Leymus triticoides
  misc_feature (621)..(621): n is a, c, g, or t
  misc_feature (837)..(837): n is a, c, g, or t
  misc_feature (858)..(858): n is a, c, g, or t
  misc_feature (1313)..(1313): n is a, c, g, or t
  misc_feature (1336)..(1336): n is a, c, g, or t
aggtcggcgatggcaacctcaacttcgtctacttcgtcacctccgacgccggctccgtcgtcgtcaagcaggcgctgccgtacatccgctgcgtgggggactcgtggccgatgacgagggagcgggcctacttcgaggcctccgcgctgcgggagcacggccgcctctgcccggaccacgtcccggaggtctaccacttcgaccgggccatgtcgctcatcgggatgcgctacatcaagccgccccacatcatcctccgcaagggcctcatcgccggggtcgagtacccgctcctcgccgagcacatggccgactacatggccaagaccctcttcttcacctccctcctctacaactccacctcggagcataagaagcaagttgctcggtactgtgagaacgtggagatgtgcaggctcacggagcaggtcgtgttctcggacccatacatggtctccaaatacaatcgctggaactcgccttttcttgacaaagacgcagaagcggttcgagaggatgatgggctgaagttggaaattgctgaattgaagtcgatgtttattgagagagcgcaggctctgattcatggagatctccatactggttccatcatggtgaccncagattccacccaagtgattgatccagagtttgccttctacgccccaatgggttacgacattggggccttcttggggaacctgattctggcgtactttgcacaagatgggcatgctgatcaaacaaatgaccgtaaagcttataagcaatggatattgaagactatcgaagaatcgtggaatttgttccagcagaaatttttgggactctggaatnaacacaaagatgggaatgggnaggcatacctgcctgccatatacaacaacccggagcttttgagcgttgtacagaagaagtacatgacaggtttacttcatgatagtcttggatttggttcggccaaaatgatcaggagaattgttggaattgcccatgtggaggattttgactcaatcgaggatgccagcaagagagcatcatgtgagcgccgcgcgcttgattgtgccaaggcaatcctgaagggacggcgccagttcgagagcatcgagcaagttattgcgcacgtccaatcagtaactcatgactgagaaaaccagccgcctgttcggcgtttccggttgaggagacctcgtttgattgttatcaggattgagtacccacgctcaagtatcgagatgtgctgctctttgtaaaacatccttgggtctgtgtggcttgtgtgttgcgtagtgggctggtgaggaaaacccccntcagcgatacctatacttgggtngagaacatcctgtgtgtatttctagtgtaaggcaggctgccttgcagcatagctgtgagttgaattacagaatgtacaatgtatctcaacgttgtacaattatccatagatacaggcgtggtcgccaccaataaaaccctatctgggtacgttttgccaaagca

SEQ ID NO: 837 - DNA, 1404 bp, Triticum aestivum
cttcgtctacatcgtctcctccgacgccggctccgtcgtcgtcaagcaggcgctgccgtacatccgctgcgtgggggactcgtggccgatgacgagggagcgggcctacttcgaggcctcggcgctgcgggagcacggccgcctctgcccggaccacgtcccggaggtctaccacttcgaccgcgccatgtcgctcatcgggatgcgctacatcaagccgccccacatcatcctccgcaagggcctcatcgccggcgtcgagtaccccctcctcgccgagcacatggcagactacatggccaagaccctcttcttcacctccctcctctacaactccaccaccgagcacaagaagcaagttgctcgctactgcgagaacgtggagatgtgcaggctcacggagcaggtcgtgttctcggacccatacatggtctccaaatacaatcgctggaactcgcctctcctcgacaaggacgccgaagccgttcgagaggacgatgggctgaagttggagattgctgaattgaagtcgatgtttattgagagagcgcaggctctgattcatggagatctccataccggttccatcatggtgaccccagattccactcaagtgattgatccggagtttgccttctacgcgccgatgggttacgacattggggccttcttggggaacctgattctcgcatactttgcacaggatgggcatgctgatcaagcaaatgaccgtaaagcttataagcaatggatattgaagaccatcgaagaatcgtggaatttgttccagcagaaatttttgggactctggaataaacacaaagatgggaatggggaggcatacctgcctgccatatacaacaacccggagcttttgagcgttgtacagaagaagtacatgacaggtctacttcatgatagtcttggatttggttcagccaaaatgatcaggagaattgttggaattgcccatgtcgaggattttgactcaatcgaggatgccagcaagagagcatcatgtgagcgccgtgcgcttgattgtggcaaggcaatcctgaagggccgacgccagttcgagagcatcgagcaagtgattgcacttgtccagtcagtaactcatgactgagaaaaccagccgtctgttcagcgtttccggttgaggagaccttgtttgatcgttatcaggattgagtaccgacgctcgagtatcgagatgtgctgctctttgtaaaccatccttggatcagtgtggcttatgtgtactgtgtagtgggctgccttcagagatgcctatacttgggtcgagaacatcctgtgtgtatttctagtgtaaggcaggttgccttgcagcatagctgtgagttgaataacagagtgtacaatgtatctcaacgttgtacaatt

SEQ ID NO: 838 - DNA, 1920 bp, Oryza sativa
ccgccttgtaccaataacaagtccaggttcagagaaccgcccccttccgcgaaagcagcagctgttacaaaacccacacacctccgcgcagcgcagcctcccacacacgcgcactcgattccccactcctctcgcgggtcgcggccacttcgccgccggcgctcgcatcggtcaactcgacgccacggccacacacgcaccggccatggccgcggcggcggagcagcagcagcagcagcagcagcagggcttccgcccgctcgacgaggcgtccctggtggcctacatcaaggccacgcccgccctcgccgcgcgcctcggcggcagcctcgacgccctcaccatcaaggaggtcggcgacggcaacctcaacttcgtctacatcgtcctctccgacgccggctccgtcgtcatcaagcaggcgctgccgtacatccgctgcgtgggggattcgtggccgatgacgagggagcgcgcctacttcgaggcctccgcgctgcagaagcaccgcggcctctgcccggaccatgtccccgaggtctaccacttcgaccgggccatgtcgctgatcgggatgcgctacatcgagccgccgcacatcatcctccgcaagggcctcatcgctggcgtcgagtacccgctgctcgccgagcacatggcggattacatggccaagacgctcttcttcacctcccttctctacaactccaccactgatcacaagaaaggagttgctcagtactgcgataatgtggagatgtgtaggctcacagagcaagtcgtgttctcagacccatacatgctcgccaaatacaatcgttgcacatcacccttcctagataatgatgctgcagcggttcgagaggatgctgagcttaaattggagattgctgaattgaaatcaatgtttattgagagagcacaggctcttcttcatggagatctccacactggttccatcatggtgacaccagattctactcaagtgattgatccagaatttgctttctatggcccaatgggttacgacattggggccttcctggggaacttgattttggcatatttttcacaagatggacacgctgatcaagcaaatgatcgtaaggcttacaagaaatggatcttgaagacaattgaagattcatggaatttgttccacaagaagtttgtcgaattatggaataaacacaaagatgggaatggggaagcatacctgccccctatatacaacagctcagagcttttgtgccttgcacagaagaagtacatgacaagcctatttcatgacagtcttggatttggttcagcaaaaatgatcaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgggcaagtgattgtgcatgtacaatcgtttgatcgggactgataatgccaaccatctacacgacctttctgattgaggagacaaaagttttcatctgtttaccataagcgattatctgtgcctattacaaagcagaattggccagttatttgtgcttttagtactttggatcatgaaaagtgtgtgcactctgcaagatcgatgttttttttcaccacttggctaagccttccaccagcttccgggcttcttagtttatgagctgaataatggaagttcagcacaaacgtttgtccatggatatggacgagtgtgttattacaaataaagttgatagttttcggcaaatagattgttgttgttttatttcaaagagatgtagtcccccttttgttccttttcatcacttaggctgcgttcaagcgcaggagaaagagagaaagatagttttgttttccgcgtgc

SEQ ID NO: 839 - DNA, 2160 bp, Oryza sativa
gaactcctcaagattagctcacacgatgatgacatgactcaactgaagaatcctggccttgtaccaaaaacaagtccaggttcagagaaccgcccccttccgcggaaacggcagctgttacaaatcccacccgagcagcagccacttccaacacacacgctcacccgattccccgcttcgccgccggcgctcgcatcggtcaagtcaactcgacgcccacacacgcaccggccatggccgcggcggcggcggagcagcagcagcagggcttccgcccgctcgacgaggcgtccctggtggcctacatcaaggccacgcccgccctcgccgcgcgcctcggcggccgcctcgacgccctcaccatcaaggaggtcggcgacggcaacctcaacttcgtctacatcgtcctctccgacgccggctccctcgtcatcaagcaggcgctgccgtacatccgcttagtgggggattcatggccgatgtcgagggagcgcgcctatttcgaggcctccgcgctgcagaagcaccgcgccctctgcccggaccatgtccccgaggtctaccacttcgaccgtgccatgtcgctcatcgggatgcgctacatcgagccgccgcacatcatcctccgcaagggcctcgtcgccggcgtcgagtacccgctgctcgccgagcacatggcggattacatggccaagacgctcttcttcacttcacttctctacaactccaccactgatcacaagaaaggagttgctcagtattgcgataatgtggagatgagcaggctcacagaacaagttgtattctcagatccatacagggtcgccaaatacaatcgctgcacatcacccttccttgataatgatgctgcagcggttcgagaggatgctgagcttaagttggagattgctgaattaaaatcaatgtttattgagagagcacaagcttttcttcatggagatctccacactagttccatcatggtgacaccagattctactcaagtgattgatccagaatttgctttctatggcccaatgggttacgatattggggccttcctggggaacttgattttggcatatttttcacaagatggacatgctgatcaagcaaatgatcgtaaggcttacaagaaatggatcttgaagacaattgaagattcatggaattttttccacaagaagtttgtcgaattatggaataaacacaaagatgggaatggggaagcatacctgccccctatatacaacagctcagagcttttgagccttgtacagaagaagtacatgacaagcctatttcatgacagtcttggatttggttcagcaaaaatgatcaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgagcaagtgattgtgcatgtacaatcgtttgatcgggactgataaggctaaccatctacacaacctttctgattgaggagacaaaagttttcatctgtttaccatcagcgattatctgtgcctattataaagcagaattggccggttatatgtgggctgggcaacaacaatgtatatagccaaagtagtccatacagatggacccacatatgtgggatttacctattgtaaccttcatactccctccgtttcacaatgtaagtcattctagcattttccacattcatattgatgtcaatgaatctagacatatatatctatctagattcatggacatcaatatgaatgtgggaaatgctagaatgacttacattgtgaaacgaaggatgtaatatatataggtagttagtagtattagaaggagagagaaagcagagataaataatatattttattctatataggcaactcatatgtttatgggtgacttttgctatttgcttgatatggactagttctacaatgttgttaggtggctgaatgaaatattgtattctttatggactagttctactatacattatgcatgctcaagtgtggacgctctgcaagattgatgtttttttttcaccacttggctaagtttgtaagaatcagtcggttgaatggcaaaagcttccccaaa

SEQ ID NO: 840 - DNA, 1614 bp, Panicum virgatum
ctggcctgtccgtccactcccctcctccgcatctttcggccggcgcccgcatcgccccagtcgccgcggcttcaggcatggccgcggaggcggagcagggcttccgcccgcttgacgaggcgtccctggtcacctacatcaaggccacgcccgcgctcgcctcccgcctcggcggcggcggctccgtcgagatcaaggaggtcggcgacggcaacctcaacttcgtctacatcgtcaagtccagctccggcgccatcgtcgtcaagcaggcgctcccgtacgtgcgctgcgtgggggactcgtggcccatgacgcgggagcgcgcctacttcgaggcctccacgctgcgggagcacggccgcctgtgcccggagcacacccccgaggtctaccacttcgaccgggccatgtcgctgatggggatgcgctacatcgagcccccgcacatcatcctccgcaagggcctcatcgccggcgtcgagtacccgctgctcgccgaccacatgtcaaattacatggccaagacgctcttcttcacttccctcctctataacaacaccacggatcataagaaaggagttgctgagtactgtgcgaatgtggagatgtgtaggctcacggagcaagttgtgttctcagacccataccgggtctccaaatttaatcggtggacctcgccgtatcttgacaaagatgctgaggcggttcgagaggacgatgagctgaagttagaaatagctgagttgaaatcaatgtttatcgagagagctcaggctctgattcatggagatctccacactggttctatcatggtgacccccaattcaactcaagtcattgatccagagtttgggttctatgggccaatgggttttgacattggagccttcctaggaaacctgattttggcatactatgcacagaacggacatgctgatcaaacaaatgatcgcaaagcttacaagaaatggatcttgaagacaattgaagagtcgtggaatttgttccaaaagaagtttgttgaactatggaataaacacaaagaagggaatggggaggcgtacctacctgatgtatacaacaactcaaacctgttgagccttgcgcagaagaagtacatgacaaacttatttcatgatagccttgggtttggttcagccaaaatgatcaggagaatagtcggaattgcccacgttgaggatctggagtcaattaaggatgccagcaagagagcagagtgcgagcgtgctgccctcaattgtgcaaagacgatcctgaagggtaggcgccaatttgagaccatcgagcaagtcattgagcatattcaatcgtttgatcgggactgagaagatatcaatctattcggcgttcaacgagacggattttcgttgttaacctatgcacacctgagtattgatgaattgtttgttctgaagcatatccatttctggccccttttagtttgaactgtgtacactactagagtaaagatcttattaaaggatattagccaggagccgaataatcaaatgtacgacatttctccaagcttatctcagtacatatagacgtgtgtattagcaaataaagttaattctgatgtttttttttgcc

SEQ ID NO: 841 - DNA, 1787 bp, Setaria italica
attcccaccgcgccccgctctcccagtctcccggtcggccccctccctcccttgtccactcctctcctccgcatctctcggccggcgcccgcggcgtcgccccaatcgccgcgcctcaggaatggccgcggaggcggagcagggcttccgcccgctcgccgaggcgtccctggtcgcctacatcaaggccacgcccgcgctcgcctcccgcctcggcggcggcggcagtctcgactctgtcgagatcaaggaggtcggcgatggcaacctcaacttcgtctacatcgtcaagtccagctccggcaccatcgtcatcaagcaggcgcttccgtacgtgcgctgcgtcggggactcgtggccgatgacgcgggagcgcgcctacttcgaggcctccacgctacgggagcacggccgcctgtgcccggagcacacccccgaggtctaccacttcgaccgtgccatgtcgctcatggggatgcgctacatcgagccaccgcacatcatcctccgcaagggcctcatcgccggcgtcgagtacccgctgctcgccgaccacatgtccaattatatggccaagacgctcttcttcacgtccctcctctataacaacacgacggatcataagaaaggagttgctcagtactgtgcgaatgtggagatgtgtaggctcacagagcaagttgtgttctcagacccataccgggtctccaaatttaatcggtggacctcaccgtatcttgacaaagatgccgaagcagtccgagaggatgatgagctgaagttggaagtagctgaattgaaatcaatgtttatcgagagagctcaggctctgattcatggagatctccacactggttctatcatggtgacccccgattcaactcaagtcattgatccagagtttggattctatggaccaatgggtttcgacattggagccttcctaggaaacctgattttggcatactatgcacagaacggacatgctgatcaagcaaatgatcgtaaagcttacaagaaatggatcttgaagacaattgaagagtcatggaatttgttccagaataagtttgttggactatggaatgaacacaaagaaggaaatggggaggcttacctgcccgacatatacaacaactcaaacctgctgagccttgctcagaagaagtacatgacaaacttatttcatgatagccttgggtttggttcagccaaaatgatcaggagaatagtcggtatcgctcatgttgaggatcttgagtcaattaaggatgccagcaagagagcagagtgtgagcgtgctgccctcaattgtgcgaagacgatcctgaagggaagacgccaattcgagaccatcgagcaagtcattgagcatattcaatcgtttgatcggaactgagaggacagcaatctattatgcacacctgagtattgatgacttgtttgttctgaagaactggttgtttgtgctttcagtgttggggttatgatgaaatttttctatttctggtcccccttttagtttgaactgtacactattcgagctattccatcatagccaggagctgaataatgaaatgtacgagatttctccaagtttatctccttacatatagacgtgtgtataaccaataatttttacttgatggttttttggcaagtactccattgttattttcttcctaataactgtgtctgaatcttgattagtggcgcccattgggtttcaactttagcctatcccaacttgcttggaaccgaaatgattcattgttgttgttgttgta

SEQ ID NO: 842 - DNA, 1741 bp, Panicum virgatum
gctactctggtcgtccaggttcagtgaacggaaccggctcacataaacccccaacccgagacagaggattcccaccgcgctctccctggcctgtccgtccactcccctcctccgcatctttcggccggcgcccgcatcgccccagtcgccgcggcttcaggcatggccgcggaggcggagcagggcttccgcccgctcgacgaggcgtccctggtcacctacatcaaggccacgcccgcgctcgcctcccgcctcggcggcggcggctccgtcgagatcaaggaggtcggcgacggcaacctcaacttcgtctacatcgtcaagtccagctccggcgccatcgtcgtcaagcaggcgctcccgtacgtgcgctgcgtgggggactcgtggcccatgacgcgggagcgcgcctacttcgaggcctccacgctgcgggagcacggccgcctgagcccggagcacacccccgaggtctaccacttcgaccgggccatgtcgctgatggggatgcgctacatcgagcccccgcacatcatcctccgcaagggcctcatcgccggcgtcgagtacccgctgctcgccgaccacatgtcaaattacatggccaagacgctcttcttcacttccctcctctataacaacaccacggatcataagaagggagttgctgagtactgtgcgaatgtggagatgtgtaggctcacggagcaagttgtgttctcagacccataccgggtctccaaatttaatcggtggacctcgccgtatcttgacaaagatgctgaggcggttcgagaggacgatgagctgaagttagaaatagctgagttgaagtcaatgtttatcgagagagctcaggctctgattcatggagatctccacactggttctatcatggtgacccccaattcaactcaagtcattgatccagagtttgggttctatgggccaatgggttttgacattggagccttcctaggaaacctgattttggcatactatgcacagaacggacatgctgatcaaacaaatgatcgcaaagcttacaagaaatggatcttgaagacaattgaagagtcgtggaatttgttccaaaagaagtttgttgaactatggaataaacacaaagaagggaatggggaggcgtacctacctgatgtatacaacaactcaaacctgttgagccttgcgcagaagaagtacatgacaaacttatttcatgatagccttgggtttggttcagccaaaatgatcaggagaatagtcggaattgcccacgttgaggatctggagtcaattaaggatgccagcaagagagcagagtgcgagcgtgctgccctcaattgtgcaaagacgatcctgaagggtaggcgccaatttgagaccatcgagcaagtcattgagcatattcaatcgtttgatcgggactgagaagatatcaatctattcggcgttcaacgagacggattttcgttgttaacctatgcacacctgagtattgatgaattgtttgttctgaagcatatccatttctggccccttttagtttgaactgtgtacactactagagtaaagatcttattaaaggatattagccaggagccgaataatcaaatgtacgacatttctccaagcttatctcagtacatatagacgtgtgtattagcaaataaagttaattctgatgttttttttttgccaactactgccttgttattttcttcataatctagatccttgg

SEQ ID NO: 843 - DNA, 2270 bp, Sorghum bicolor
gtcacattcggttcgactattcgaatgcagcaggcaagaatcgggcctgcccagtgcctatccaaagcaagtccaggttcagagaactgaagaaaaactcaaccataaaaccccacaccaccacactgcagattcctcacggccccccctctctgtccatcctctgctctcctctcgccggcgcccgcgtcgctcgagtagcagtcagcctcagccatggccgcggaggcggagcagggcttccgcccgctggacgaggcgtccctgctcgcctacatcaaggccacgccggcgctctcttcccgcctcggcggcggcggcagcctcgactccatcgagatcaaggaggtcggcgacggcaacctcaacttcgtctacatcgtgcagtccgaagccggcgccatggtcgtcaagcaggcgctcccgtacgtgcgctgcgtgggggactcgtggcccatgacgcgggagcgcgcctacttcgaggcctccacgctgcgggagcacggccgcctgtgcccggagcacacacccgaggtctaccacttcgaccgggccatgtcgctgatggggatgcgctacatcgagcccccgcatatcatcctccgcaagggcctcatcgccggcgtcgagtacccgctgctcgccgaccacatgtccgattacatggccaagacgctcttctttacctccctcctctataacaacaccacggatcataagaacggagttgctaagtactctgcgaatgtggagatgtgtaggctcacggagcaagttgtgttctccgacccataccgtgtctccaaatttaatcggtggacctcgccttatcttgacaaagatgctgaggcagttcgacaggatgacgagctcaagttggaagtagctggactgaaatcgatgtttatcgagagagctcaggctctgattcatggagatctccacactggttctatcatggtgaccacaggttcaactcaagtcattgatccagagtttgggttctatgggccaatgggttttgacattggagccttccttggaaacctgattttggcatactacgcacagaatggacatgctgatcaagcaaacgatcgtaaggcttacaagaaatggatcttgaagacaattgaagagtcttggaatttgttccagaaaaagtttgttgaactatggaataaacacaaagaagggaatggggaggcatacctgcctgatatatacaacaactcaaagcttgtgagcgttgctcagaagaagtacatgacaaacctattccatgatagtcttgggtttggttcagccaaaatgatcaggcgaatagttggaatcgctcacgtcgaggatctcgagtcaattaaggatgccagcaagagagcagagtgcgagcgtgctgccctcagttgtgcaaaggagatcctcaagggaagacgccaatttgagaccatcgagcaagtcattgagcatattcaatcgtttgaccaggactgagaaggcggcagtctatttttgcgcttaaggagacatactttcgtcaattaacccacacatacctgagtatcggtgaatcgtctgttttgaagcaccggttgtttgtgttttctgtattgagattatatgatgaaaaggtgcccatttgtggtctgatagtttggactgtgtacactaccagagtaagatcttattctgccataggccccttggttctgaataatgaaatgtacgagatttctccgtgactatctcagtacatttagatgcttgtattttaccaataatttttgttatgatggtcctttggcaagtactgccttgttattgtcttcgtaatcttgatcttggtaactaagacctgttggcgtccatgccgtctaggaggatttacatctctaaattgaggtctgaaaatgtcaattcaatcgtcttaaactcttaatgttgttttctttggacatcagtgaactgtagcgcacagtattatacctcactgtagcacgggaagaactgtaggtttggggctccgaccggattcactacagcagtatcggagccagcgaaggagtgccgtttgtttgaaggggaatgaagccctgaaaaatgggcttgttcatttattgtgtattggttgccctggaactggaactatttcaactggaaccataagcttatttgtattaacaatttaacatgtattagctggaatagttctaccctcaaagccaggccaaacgaacgaggcctaaacatgtccttatactaggatacca

SEQ ID NO: 844 - DNA, 1737 bp, Zea mays
aagaactctacataaaaccccaccacaagggcgcagattccacacggttcctctctgaccactcctctcctctcctctcctctcctctcgccggcgcatcgcccgactgtcagtcagcctcagccatggccgcggaggaggagcagggcttccgcccgctggacgaggcgtccctgctcgcctacatcaaggccacgccggcgctcgcctcccgcctcggcggcggtggcagtctagactccatcgagatcaaggaggtcggcgacggcaacctcaacttcgtctacatcgtgcagtccgaggccggcgccatcgtcgtcaagcaggcgctcccgtacgtgcgctgcgtgggggactcgtggcccatgacgcgggagcgcgcctacttcgaggcctccacgctgcgggagcacggccgcctgtgcccggagcacacccccgaggtgtaccacttcgaccggaccttgtcgctgatggggatgcgctacatcgagcccccgcacatcatcctccggaagggcctcgtcgccggtgtcgagtacccgctgctcgccgaccacatgtccgattacatggccaagacgctcttcttcacctccctcctctataacaataccacggatcataagaacggagttgctaagtactctgcgaacgtggagatgtgtaggctcacggagcaagttgtgttctcggacccataccgtgtttccaaatttaatcggtggacctcgccttatctcgacaaagatgctgaggcagttcgcgaggatgatgagctcaagttggaagtagctgggctgaaatcgatgtttatcgagagagctcaagctctgattcatggagatctccacactggttctatcatggtgaccgaaggttcaactcaagtcattgatccagaatttgggttctatgggccaatgggttttgatattggagccttccttggaaacctgattttggcatactatgcacagaatgggcatgctgatcaagcgaatgatcgtaaggcttacaagaaatggatcttgaagacaattgaagagtcgtggaatttgttccagaaaaagtttgttgaactatggaataaacacaaagaaagcaatggggaggcatacctgcctgatatatacaacaagccaaagcttttgagcgttgttcagaagaagtacatgacaaacctatttcatgatagccttgggtttggttcagccaaaatgatcaggagaatagtcggaatcgctcacgtagaggatctcgagtcaatcaaggatgccagcaagagagcagagtgcgagcgtgctgccctcaactgtgcgaagacgatcctcaagggaagacaccagtttgagacgatcgagcaagtcgtcgagcatattcagtcattcgatcaggactgagaagacgacagtctatttgtgcgctgaagcctgaaggagccatactctcgtcaattaacccacgcatgcccgagtatcgatgaatcgtctgttttgtagtgatgaagcgcccggttgtttgtgatctctgtattggttgctaggtgagaaaagtatgtggtctcctggcttgaactgtgtgtacactattattccgggccggcatagcgagcagctgaataatgaaatgtacgggtcctcagtgaccatctcagtgcatataaacacgtgtgttaccaataaattttgttatggtgctggtggttctatggcaagtactgcatcgtgctgttgt

SEQ ID NO: 845 - DNA, 2734 bp, Triticum aestivum
ggcgcgccagccagaccacccgagcatccccatcccaaaccctagccgccgccgccgatggcgaagcgcccgcgcaacttccgggcggtgcggtccaactccttcgagtcctacctccggcgggccatatccgaggccgggctcgccgtgccgggctgctgcgccgacgacgtcgccgccgcgctccgcgcccgccacccggacctgcgccgcaagcagcacgccccgctcgtcgccgccgtccgccgcgccctcctcaccgtccccctcgcccccgcccccggcgccgacgcctccgactccgactccgagatggactcccgcgcgtcctccccctcctcccgccgccggcgccacgacgcccacgccaccgcctcctcctccacctcctactccgagcacgacgacgacgcccgcgccccctcgcctccccccgccttcgacgtcaccaaggccatgctccgcacccgctacgcctccctcacgccccggaaggagcccgccgcagtcgccgctgcggccgccagccagcagctcgagatcgagctcaacgcggagaagccccgccggcgcgtcacgaccgatggcggcggcggcggcgaccccaagcaggaggcaggggccggcgaagggggcggcggcggaggggccaagggccccaggttttctgatctcggggggatggagtccgtgattgacgagctgatgatggaggttgtggttcccctgtgccacccggagctgccgctgcggctcggggttcggcctgtggcggggattctgctgcacgggccgccgggctgcgggaaaaccacgctcgcccacgcaatcgccaatgagaccggcgtgccattctacaagatatctgcgccggaagtcgtatctggggtctctggggcttctgaggaaaatatcagagtcttgtttaagaaggcgtacagaactgctccctcaattgtatttatagacgagatagacgcaattgcgtccaagagggagaatttgcaacgtgaaatggagcggcggatagttacacagttaatgacatgcatggatgaattccaccagaatgctggatcggatggtggtgacttggactcgcaatcatctgaaaagaagcctggctatgtcattgtaattggagctaccaataggccggatgctgttgaccaagcgcttcggagaccagggaggtttgatcgagaaatatctcttggtgttccagatgagattggacggaaacagattttgaagatgcttactcagaacctaacactggagaaagaccaatttgacctgttcaagatagcaagggctaccccaggatttgttggcgcagacttgaaggcattggtagataaagcagggaatctggcaatgaagagaataattgttgaaagaaaaaaacagagtggtgggggtgatgtaaacaacaagcaggactggtggcgacatccctggagtgaaggtgagatggacagcctatgtatcactatggatgactttgaggaagcagccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgcaagctgggtttttgctgtttggacctccaggctgtgggaaaacactaatagcaaaagcagttgcacatgatgcaggggcaaattttattcacattaaggggcctgagctactgaacaagtatgttggggagagtgaatcagaagtaaggaagatattcacccgtgcaaggattaactccccatgcatcctattttttgacgagatagatgctctgacaacaaaaagagggaaagagggaggatgggttgttgaacgtctcctaaaccagttacttgttgaactcgatggtgctgatcagcgtcatggtgtttatgtcattggagctacgaacagaattgatgttatagatgaggctgtcctacggcctggcagatttgggaagaaacactttgtacctttacctggtgctgatgagcgggttgcgatattgaaagcacatactgaaaagaaaactctttcggtagatgttgatttgaacgcaattgcacgtcgagaggagtgcaataatctcactggtgccgacctggcatcactggtgaacgaagcagccatggcagcattggaggagaggtgcgaattcctggcgaaaggggactcgtcaatgagtactgacttgactaataagattaaactgcggcactttgagcatgctctctctaaagtaaagccctcggtatctgaacagcaaaggaaacacttcgacgcgctgtcaaagaaatattcggccaactgatccgccatcgtcattgtgcttacgaggaccatactgcagttttgcttttttgttttcgctcatatgatagcttagtgtagagattgcgtgggcgactctacactaaagctatacaattttggtagtgaggaacttgttttcggtgtctggaaaatatgaactcgttatgcttgttgtacggcttcgactggtgcttgatgcatcggccgctttgtaatgttttgaagcgaggaaacacggagaaactttgtgtgaactgcagaattgtcgatcaattgcatctaattttgttaaggaggataaaaaaaaaaaaaaacga

SEQ ID NO: 846 - DNA, 2692 bp, Triticum aestivum
ggcgcgccagccagaccacccgagcatccccatcccaaaccctagccgccgccgccgatggcgaagcgcccgcgcaacttccgggcggtgcggtccaactccttcgagtcctacctccggcgggccatatccgaggccgggctcgccgtgccgggctgctgcgccgacgacgtcgccgccgcgctccgcgcccgccacccggacctgcgccgcaagcagcacgccccgctcgtcgccgccgtccgccgcgccctcctcaccgtccccctcgcccccgcccccggcgccgacggcgacgaatccgactccgagatggactcccgcgcgtcctccccctcctcccgccgccggcgccacgacgcccacgccaccgcctcctcctccacctcctactccgagcacgacgacgacgcccgcgccccctcgcctccccccgccttcgacgtcaccaaggccatgctccgcacgcgctacgcctccctcacgccccggaaggagcccgccgcagtcgccgctgcggccgccagccagcagctcgagatcgagctcaacgcggagaagccccgccggcgcgtcacgaccgatggcggcggcggcggcgaccccaagcaggaggcaggggccggcgaagggggcggcggcggaggggccaaggggcccaggttttctgatctcggggggatggagtccgtgattgacgagctgatgatggaggttgtggttcccctgtgccacccggagctgccgctgcggctcggggttcggcctgtggcggggattctgctgcacgggccgccgggctgcgggaaaaccacgctcgcccacgcaatcgccaatgagaccggcgtgccattctacaagatatctgcgccggaagtcgtatctggggtctctggggcttctgaggaaaatatcagagtcttgtttaagaaggcgtacagaactgctccctcaattgtatttatagacgagatagacgcaattgcatccaagagggagaatttgcaacgtgaaatggagcggcggatagttacacagttaatgacatgcatggatgaattccaccagaatgctggatcggatggtggtgacttggactcgcaatcatctgaaaagaagcctggctatgtcattgtaattggagctaccaataggccggatgctgttgaccaagcgcttcggagaccagggaggtttgatcgagaaatatctcttggtgttccagatgagattggacggaaacagattttgaagatgcttactcagaacctaacactggagaaagaccaatttgacctgttcaagatagcaagggctaccccaggatttgttggcgcagacttgaaggcattggtagataaagcagggaatctggcaatgaagagaataattgttgaaagaaaaaaacagagtggtgggggtgatgtaaacaacaagcaggactggtggcgacatccctggagtgaaggtgagatggacagcctatgtatcactatggatgactttgaggaagcagccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgcaagctgggtttttgctctttggacctccaggctgtgggaaaacactaatagcaaaagcagttgcacatgatgcaggggcaaattttattcacattaaggggcctgagctactgaacaagtatgttggggagagtgaatcagaagtaaggaaaatattcacccgtgcaaggattaactccccatgcatcctgttttttgacgagatagatgctctgacaacaaaaagagggaaagagggaggatgggttgtggaacgtctcctaaaccagttacttgttgaactcgacggcgctgatcagcgtcatggtgtttatgtcattggagccacgaacagaattgatgttatagatgaggctgtcctacggcctggcagatttgggaagaaacactttgtacctttacctggtgctgatgagcgggttgcgatattgaaagcacatactgaaaagaaaactctttcggtagatgttgatttgaacgcaattgcacgtcgagaggagtgcaataatctcactggtgccgacctggcatcactggtgaacgaagcagccatggcagcattggaggagaggtgcgaattcctggcgaaaggggactcgtcaatgagtagtgacttgactaataagattaaactgcggcactttgagcatgctctgtctaaagtaaagccctcggtatcagaacagcaaaggaaacacttcgacgcgctgtcgaagaagtattcggccaactgatccgtgatcgtgcttacaaggaccataccgcagctttgcttttttgttttcgctcatacgacagcttagcgtaaagattgcgtgagcgactctctacactaaggctatgcaattttggtagtgaggaacttgttttcggtgtttggaaaatatgaactcgttatgcttgttgtacggcttcgactggtgcttgatgcatcggccgctttgtaatgttttgaagcgaggaaacacggagaaactttgtgtgaactgcagaattgtcgatcaattgcat

SEQ ID NO: 847 - DNA, 2503 bp, Hordeum vulgare
ccccctcctcccgccgccgccaccgcgcccacgccaccgcctcctcctccacctcctactccgaacacgacgacgacgacgacgacgccccctcccctccccccgccttcgacgtcaccaaggccatgctccgcacccgctacgcctccctcacgcccaggaaggagcccgcggccgccgccgcagccgcagcaagccagcagctcgagatcgagctcaactcggagaagccccgccggcgcgtcacgaccgatggcggcggcggcggcggcggcgaccccaagcaggaggcaggggccagcgaaggaggcggcggcggaggggccaaggggcccaggttttctgatcttggggggatggagacggtgattgacgagctgatgatggaggttgtggttcccctgtgccacccggagctgccgctgcggctcggggttcggcctgtggcagggattctgctgcacgggccgccgggctgcgggaaaaccacgctcgcccacgcaatcgccaacgagactggcgtgccattctacaagatatcggcgccggaagtcgtatctggtgtctctggagcttctgaggaaaatatcagagtcttgtttaagaaggcgtacagaactgctccctcaattgtatttatagacgagatagatgcaattgcgtccaagagggagaatttgcaacgtgaaatggagcggcggatagttacacagttaatgacatgcatggatgaattccaccagaatgttggatcggatggtggtgacttggactcgcaatcatctgaaaagaaacctggctatgtcattgtcatcggagctaccaataggcctgatgctgttgaccaagcgcttcggagaccagggaggtttgatcgagaaatatctcttggtgttccagatgagattggacggaaacagattttgaagatgcttactcagaacctaacactggagaaagaccaatttgacctgttcaagatagcaagggctaccccaggatttgttggcgcagacttgaaggcattagtagataaagcagggaatctggcaatgaagagaataattgttgaaagaaaaaaacagagtggtgggggtgatgtaaacagcaagcaggactggtggagacatccttggagtgaagatgagatggacagcctgtgtattactatggatgactttgaggaagcagccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgcaagctgggtttttgctgtttggacctccaggctgtgggaaaactctaatagcaaaagcagttgcgcatgatgcaggggcaaattttattcacattaaggggcctgagctactgaacaagtatgttggggagagtgaatcagaagtaaggaaaatattcacccgtgcaaggattaactccccatgcatcctatttttcgacgagatagatgctctgacaacaaaaagagggaaagagggaggatgggttgttgaacgcctcctaaaccagttacttgttgaactcgatggtgcagatcagcgtcatggtgtttatgttattggagctacgaacagaattgatgttatagatgaggctgttctacggcctggtagatttgggaagaaacattttgtacctttacctggtgctgatgagcgggttgcgatattgaaagcacatactgaaaagaaaactctctcggaagatgttgatttggaaacaattgcacgtcgagaggagtgcaataatctcactggtgctgacctggcatcactggtgaacgaagcagccatggcagcgttggaagagaggtgcgaattcctggcgaaaggggactcgtcaatgagtactgacttgactaataagataaaactgcagcactttgagcatgctctatctaaagtaaagccctcagtatcagaacagcaaaggaaacacttcgacgcgctgtcaaagaaatattcagccaactgatccatcgccgtgcttacaaggaccatactgtagccttgtttctacttcccctgttccaaaataaatgtctcaaccttgtactagctctagtataaaattgtactaagcctctagacaattattttgggacggaggaagtattatttttgctcataccatagcttggtgtagagattgcgtgtgctgaccctctacactaaagctatgcaattttggtagtgagggacttgttttcggtgtttggaaaatatgaactcgttatgcttgttgtacggcttttaccggtgctccgtccccttgtaatgttttgaattgagaaacacggagaaactttttgtggactgagcattcttgatcaatgcagaattctttctcttattggaacctgatgctaaggctcagtcggggctttt

SEQ ID NO: 848 - DNA, 2875 bp, Brachypodium distachyon
tcctcccccgccacgaaacctcaaccagctagaacaaaatcgcccccttcccaaaaaccctagccgccgccgttgcgacgccgatggggaagcggccgcggaacgtccgcgccatccggtctaactccttcgagtcctacctccggcggctcatagccgacggcgggctggccgtgccgggctgctccgccgacgacgtcgccggcgccctccgctcccgcaaccccgacctacgccgcaagcagctcggccccttcgtcgccgccgtccgccgcgcgctcctctcctccatgcccgcccccgccgaggccttctccgccgactcggacgtcgactcccgagcctcctccccgtcctcctcccgccgccaacgccgccgcctcagccacgacgcttcctcctccacctccttctccggagacgacgacgatggcggcgctcgcccgccctcccctccccccgccttcgacgtcaccaagtcgatgctccgcgcgcgctacgcctccctgacgcccaaaaaggaccccgggaccaaccagcagctcgagatcgaggtcaatgcagagaagccccgccggcggatgacagctgatggtggtgccggtggcgactccaagctggaggctgcggcggttgcgccagctactaccgaaggaggcggcagggtggggaaggggccaatgttctctgacctcggcggtatgaaaacggtgatagacgagctgatgatggaggtggtcgttccgctgtgccatccgcagctgccactgcggcttggtgttcggcctgtggccgggattctgctccatggaccgcctggctgtggaaaaacaacgcttgcccacgccattgccaacgagactggcgtgccattctacaagatatcagcgccggaaatcgtctctggggtttctggagcttctgaggaaaacatcagaatcttgtttcaaaaagcttacaggactgctccatcaattgtatttatagacgagatagatgcaattgcatccaagagggagaatttgcaacgagaaatggaacggcggatagttacacagttaatgacatgcatggacgagttccaccagaatgttgggtcagacggtagtgacttggattcgcaatcatccgaaaagaagcctggctatgttattgtcattggagctaccaatagacctgatgctgttgaccaagcacttcggagaccagggaggtttgatcgagagatatctcttggtgttccagatgagactgcacggcaacagattctgaagatgcttactaagaaccttacactggaggcagaaggccactttgacttgttcaagatagcaagggctacaccaggatatgttggtgcggacttgaaggcattagtggacaaagcagggaatcttgcaatgaaaagaataattattgcaagaaaaaaacttttgggggatgatgaaaacaatgagcaggactggtggagacttccttggaatgaaagcgagatggagaacctatgtattgctatggatgactttgagaatgcagtcacaatggttcaaccatcattgagaagggaaggattttcttctgtccctgatgtcacatgggaggacgttggaggtcttgattcattaaggaaagaattttaccgctgcattgttcgttgtatcaagtacccggaagattataaggaatatggagtgaacatgcaagctgggtttttgctgtttggacctccaggctgtgggaaaacgctgatagcaaaagcagttgcacatgacgcaggggctagttttattcacattaaggggcctgagctattgaacaagtatgtcggggagagtgaatcagaagtaaggaaaatattcacccgtgcacgaactaactctccgtgcatcctattttttgacgagatagatgctttgacgacaaaaagagggaaggagggagggtgggttgttgaacgtctcctaaatcagttactcattgaactcgatggtgctgatcagcgacatggtgtttatgttattggagctacaaacagaattgacgtcatagacgaggctgttctacgacctggtagatttgggaagaaacattttgttcctttacccggtgctgatgaacgggtttcgatattgaaagcacatgccaaggataaacccgtctctgctgatgttgatttggacacacttgcacgtcgacaggagtgcaataatctcagtggtgcagacctagcttcactggtgaacgaagcagccatggcagcgttgggagagaaaatcgaattcctagagaatgggacagcctcaagaagtttgtcatttacgcgtgagattgaactcttgcactttgaacatgctctatctaaagtaaagccatcggtatcagaacagcaaaggaaacactttgacatgctgtcaaagaaatattcggccgattgatccatctttggtgcctacttacaagggacgtgctgcagtacactcatgaaccatgatggcatccagcacccagcatattcatttacagaaacagaaacatggctgccgccagtcacttctgttattgtttcgttcatcatgtccacccgcaattttgatcatcctcaatgtagaagtgagtaatacaattatgtttgcgggaaatagctataatggtttggtcattgtttggcagttaggaacccattctagtcgttttacaactttgactggtgcttgttgtatccagattgggatgttgaacgcttgatgttccagtttccgaaacacgtacggtggttctcttgcaagtcaagtcgcaatacttgctgttaaggctttccaaacagccatctcgtatcaatttgtcaggataccatacatttaagtgtcatcacatt

SEQ ID NO: 849 - DNA, 2690 bp, Secale cereale
gactcacccgaggctcccccatcccaaaccctagccgccgccgccgatggcgaagcggccgcgcaacttccgggcggtgcggtccaactccttcgagtcctacctccggcgggtcatatccgaggccgggctcgccgtgccgggctgctgcgccgacgacgtcgccgccgcgctccgggcccgccacccggacctgcgccgcaagcagcacgcccctctcgtggctgccgtccgccgcgccctcctcagcatcccccctcccccccgccccggcgccgaggcctccgactccgactccgacatggactcccgcgcctcctcccccttctcccgccgccgccaccggcgccacgacgcccacgccaccgcctcctcctccacctcctactccgagcacgacgacgatgcccgcgccccctgcctcccccccccttcgacgtcaccaaggccatgctccgcacgcgctacgcctccctcacgcccaggaaggagcccgcagccgccgccgcggcagccgccgccagccagcagctcgagatcgagctcaactcggagaagccccgccgacgcgtcacgaccgacggcggcggcgctggtgaccccaagcaggaggcaggggccagcgaaggaggcggcggcggaggggtgaaggggcccaggttttctgatcttggggggatggaatccgtgattgacgagctgatgatggaggtggtggttcccctgtgccacccggagctgccgctgcggctcggggttcggcctgtggcggggattctgctgcacgggccgccgggctgtgggaaaacaacgctcgcccatgcaattgccaacgagactggtgtgccgttctacaagatatcggctccggaagtcgtatctggggtctctggagcttctgaggaaaatatcagagtcttgtttaagaaggcataccgaactgctccctcaattgtatttatagacgagatagacgcaattgcgtccaagagggagaatttgcaacgtgaaatggagcggcggatagttacacagttaatgacatgcatggatgaattccaccagaatgttggatcagatggtggtgacttgcactcgcagtcacctgaaaagaagcctggctatgtcattgtcattggagctaccaataggcctgatgctgttgaccaagcgcttcggagaccagggaggtttgatcgagaaatatctcttggtgttccagatgagattggacggaaacagattttgaagatgcttactcagaacctaacactggagaaagagcaatttgacctgttcaagatagcaagggctaccccaggatttgttggcgcagacttgaaggcgttggtagataaagcagggaatctggcaatgaagagaataattgttgaaagaaaaaaacagagtggtggggctgatataaacaacaagcaggattggtggcgacatccctggagtgaaggtgagatggacagcctatgtatcactatggatgactttgaggaagcagccacaatggttcaaccatcattgagaagggaaggattttcttctgtgcctgacgtcacatgggaggatgttggaggtcttgattcgttaaagaaagaatttgaccggtgcattgttcgttgtatcaagcaccctgaagtttataaggatttcggagtgaacatgcaagctgggtttttgctgtttggacctccaggctgtgggaaaacactaatagcaaaagcagttgcacatgatgcaggggcaaattttattcacattaaggggcctgagctactgaacaagtatgttggggagagtgaatcagaagtaaggaaaatattcacccgtgcaaggattaactccccatgcatcctattttttgacgagatagatgcactgacaacgaaaagagggaaagagggaggatgggttgttgaacgcctcctaaaccagttacttgttgaactcgacggagctgatcagcgtaatggtgtttatgtcattggagctacgaacagaattgatgttatagatgaggctgtcctacggcctggcagatttgggaagaaacactttgtacctttacctggtgctgatgagcgggttgcgatattgaaagcacatactgaaaagaaatctctttcggaagatgttgatttgaacgcaattgcacgtcgagaggaatgcaataatctcactggtgctgacctggcatcactggtgaacgaagcagccatggcagcattggaagagaggtgtgaattcctggcgaaaggggactcatcaatgagtaccgatttgactaataagataaaactgcggcacttcgagcatgctctgtctaaagtaaagccctcggtatcagaacagcaaaggaagcacttcgacgcattgtcaaagaaatattcggccaactaaaccactgtcgtgcttacaaggaccatactgcagttttgttgttttgtttttgcgcatacgatagctcagcgtagagattgcgtgggcgactctctacactgaagctacacaattttggtagcgaggaacatttttttcggtgtttggaaaatatgaactcattatgcttgttgtacggcgtcgactggtgcttgatgaaccagtccctttgtaatgtttcggatcatgaagaaactttgcgtgaactgtgaacattttttaccaatgcacaattctct

SEQ ID NO: 850 - DNA, 1249 bp, Oryza sativa
aagaagccctcctcctccaaaagccccaaaagccctagccgcctcccccttcgtcctccgctccacgagaccacgacgcagggttttctggttcttgctgtcttgggatctttgatttgctgcgaaggcgaaggcgaagatgaggcccgtgttcgtggggaacctcgactacgacacccgccactccgagctcgaccgcctcttctaccgctacggcaggatcgaccgcatcgacatgaagtcaggatttgcttttgtctactttgaggatgagcgtgatggtgatgaggccatacgagcccttgatggctatccttttggccctgggaggcgcaggctttcggtggagtggtcacggggtgatcgtggttccaggcgtgatggctatagcaaaccacctgtgaatactaaacccacgaagacactatttgtcattaactttgaccccatcaacaccagagtcactgatatcgaaaggcatttcgaaccatttggaaagctttcgaatgttcggatcaggaggaactttgcttttgtgcagtttgaaacacaggaagaggccacaaaagcacttgaagctactcattctaccaagttgttggacagggtgatttctgttgagtatgccttcagggatgatacagaacgaggtgacaggtatgatggtgcaagaggtggctatggtaggcgagatgatagtccatatcgtcgatcagttagtccagtgtacaggtcacgcccaagtcctgactacggtcgtcaaaggagtcctgtgtacggttcgtatgacaggagtcctgttaatgatcgctatcgaagccgatctcctgtccggcgatcaagatccccacttgccaacagaagagcttatgattgacagagttttctcaagggtggttggctggttgctgaagggtttgcatctgcctctctagatctttagcagtgatagcaagaacttgtcttctccgtactatatatataatttagatatgggtactcatgggtggttcgtagtcgaactgaaaatcttttaccttttgttgacctggaactccgtactagtataatttagatatgatgtgttgtgcatcaaggcaaaactctgtgcgatgtacctgtgccacaacgttttctatgactaccgcactttatatttctagcctcctgttgttagtctgtcaaatttaatcttttgttatttgtggccaatttgtttggataacaaaccacggtttgccaagcattt

SEQ ID NO: 851 - DNA, 1183 bp, Setaria italica
gccgcctgtctccatccccctctcgtccgcgcgacgacgacgcaggttctgttcgggggatttgttcgtcgccgactcgccggcggccaagatgaggccggtgttcgtggggaacctggactatgacacccgccactcggagctcgaccacctcttctaccgctacggcaggatcgagcgcatcgatatgaagtcaggatttgcttttgtttactttgaggatgagcgtgatggtgatgatgccatacgggctcttgatggttatccctttggccctgggagacgccggctttcagtggagtggtcacggggtgatcgagctgcgagacgtgatggcaacaaaccagaagcaaacactaaggccactaagacgttgtttgtcattaactttgacccaatcaccacaacagtcggtgatatcgaaaagcactttgcaccatttgggaatatatcaaatgttcggataaggaggaactttgcttttgtccagtttgaaacactggaagaagccagaaaggctcttgaagctactcatgctaccacgcttttggatagagtgatttctgttgagtatgcctttagggatgatggtgaaagaagtgacaggtatgatagccctagaagagctggtggctatggtaggtgcggggataacccatatcgccgttctattagcccagtataccgctcacgacctagtcctgactatggtcgcccaccaagtcctgtatatggttcatatggcaggagcagaagtcctgttcgtgatcgctatcggagatctcctggctaccgatcgagatctccgcctgccaaaaggagagcttatgactaattcagaaccgtctctgctacctggggctggaagcttgtatccgctctttcccaatgctatcaactagtagcaagaattttctgtgcctgtactggagcgttttgcctcaagtgtcttgaactcctgtgttttaaagtagacacctttagctatgtgcctatgtaagagaaagttgtcttgaactcctgggttggccgagtcgctggtagggaggctgacccaggttgctcagagctcgcatggttatctcctgggaactggtttcgggctgagtttcaccatggctcggtgattgtttctgagatgactactgacgtgcctcgtgatatccttatttcgtcctggcca

SEQ ID NO: 852 - DNA, 1984 bp, Secale cereale
ttcactcatcagcttcgcgcaggccagatccagcctcgcgtgtcctcccctgcccctccctccacacgcccgcctcatggccgccgacacggcggccgcacgcgccatcctcctcctcctcgtcgccgtcgccgtcgcggcgctcctccgcaccggcgaggcctcggtgcacgagtacagcggcctcagcttcctcaacaagggcaatgccttcatcctccacgccggcagcgagggcctctacgcccccgtctcccccgccaatgccaccgtcgaggaagaggacgacgaggccgccgccgatgccttcatacggtttgacaagattacttttaggagaccagaggaggctaatgattctgtgagagaaattagttcatctaaggttcagataattgtctttgaaatagaagatcgtgaaatgattggtggatcagcatatggtggtcaaaaagcaatttgttgtacatcagatcttgcaaagttgggagcttgtgttgaaggctctgtcatctaccgcccatcgcaggtgaatcctggctggccacagttgtttgttgcttcttttgatggaagtgatctgattgcaacactaccttcaaggaccattccagtaaagaaaactgggatgtacaatatgtacttcatacactgtgacccggcacttgatggactggaaatcgacgggaaaaccatatggaaaaatcctactggctaccttccaggtcggatggcacctctcaagaacttttttggactgatgtcatttgcgttcgtgatacttggtatctattggttttatcaatacatgaagttctggcgagaggttcttccacttcagaactgtattactcttgttattacattgggtatgcttgagatggcattgtggtattttgaatatgctgagttcaatgagactggagttcgggcaaaggccatcacattttgggctgtaacatttgggactattaaaagaacagtggctcgtcttattattctcattgtctcgatggggtatggagttgtgaggcctactttgggtggtctgacatcaaaagttgtcatgcttggaggaacattctttgtagctacagaaattcttgagctagtggaaaatcttggtactgtgaatgatctttctggaaaagctcggctatttttggtatatccagtggctatcttggatgcttcattcattgtttggatatttatttctctagccaagacccttagccaacttcaggcaagaaggttgatggccaaacttgatatttataggaaattcactattgcattggctattactgttctggtatctatcggctggattggctatgagatttacttcaaatcgacagatgtgttcaatgagcggtggcagtatgcatggataattcctgctttctggcatgccctatcattctcacttctttgcgtcatttcctacctgtgggcaccttctcagagctcaatgagatttaccaacgacgcaagtgaaaagtttgatcgagaggacagcctgtcattaataaggccaaggcccattgtttccaacaacgggtggagcgtagcttcgtcaacagacgccaaagtgacgaagaacacggatagtgtgacatcttttgacgaagatgacgaagaaaacaaaagggagtaacgcatctgatgatgccacctcatcagatcctttgaagtggatatgctagaacaattttggtatttagcagatggaacggctgtgctaatttctagtcattgggatacctccttggaggggcttcttccttgttaaatccttttcctccattggttttttcacacagtgcatgcatcactgtaaggatgattatatatgataggaacagttcatctgtggtgttatgtgggatgtatggtgtatgatacttctctttagatctcgtattgcttctagtttatgtgaacacggatattggcagtactgcgagtgcaattatttgtt

SEQ ID NO: 853 - DNA, 2371 bp, Oryza sativa
caacaattcaacaacacacggggagacactccctctcaccaaggaataaacgaggtctctcaccaaccaaaccccctcctactcctcctcccgtttattaccgcggcttctcttggcctcttgcggtttctccccgaccgagctagcgtccgcttcactcacctcgtcgtcttcacttcacttcacgcacgctcagatccagcctcgcttcgctgccccccacctccatggcggccgtgtcggcggcggccgcccgcctgcaccacctcctgagcctctgcgtggccgtcgctgggctgctgctgatgctgctcggcggcggggaggcgtcggtgcacgagtaccgcgggctcggcttcctcaacaagggcaatgcgttcatcctccacgccggcagcgagggcctctacgcgccgtcctcccccgcgaatgcgacgaccgcggaggacgacgaggatgccgccgccgccgccgtggccgacgccttcatccgatttgacaagattacgtttaggagaccaaaggatgctgcaaaggaaactggttcagcaatggttcagatacttgtttttgagatagaagatcgtgagatgattggtggatcagcatatggaggtcagaaagctatttgttgtacctcagatcttgcgaagttaggagcttgcacggaaggttctgtcatctatcggccatcacaggtgaatcctggctggccacagttgcttttttcatcttttgatggaagtgacacgattgcaacactaccttcaaggatcattcctataacaaaaaccgggatgtacaatatgtacttcatacactgtgatccatcacttgctggtctggagatagaggggcaaaccgtatggaaaaatcctactgggtatcttcctggtcggatggcacctcttaagaacttttttggaattatgtcattcgcttttgttgtacttgggatttattggttctatcagtacatgaagttttggcgtgaagttctgccactgcaaaactgtattactcttgtcattacattgggcatgcttgagatgtcattgtggtattttgagtatgctgagttcaacgagactggtgttcgaccaaagggcatcacattttgggctgtaacatttgggactgttaaaagaacagtagcccgtgttattattctcattgtctcaatgggatatggagttgtcaggcctagtttgggtggtctcacatcaaaggtggttatgcttggaggaacattctttttagctacggaaatccttgaattggtagaaaatcttggtgccgtaaatgatctatctggaaaagctcgattgttcttggtttatcccgtggctattttggatgctgcattcgttgtttggatttttatttcgctagctaagacccttgacaaacttcaggccagaaggtcaatggccaaacttgacatttacaggaaattcacaatagcattggctgtaactgttctggtgtctattggctggattggctatgagatttacttcaaatcaacagatgtattcaatgaacgatggcagtatgcatggataattcctgcgttctggcatgtcttgtctttctcacttctttgtgtcatttcatacctgtgggcgccgtcacagaactcaatgaggtttacctatgatgcaagcgaaaactttgatcgagaggacagtctgtcactaataaggccaggtcccattgcttccaagaacgggtggagtttatcttcttcaccagacaccaaagcaacaaagaacgttacagttacatcttttgatggagatgacgaagaaaacaaaagggagtagaaggggcactgtgcatttcatgagggagagaagatacagccacattcaaattttggtatgcagcagatcacactttactaattctagttgtcgggatacgccaagggaattatggaagtaatctttattgaattcatttcctccatatagtagtttttcacacggtgcgccacgttataggcatcactgtatggatgatgatatatatgataggaacaatttatctatgccatccagaggatgtgtggtgtataatgtgtatttttgtagatttgatgctgcttctggtttatgtgaactccaagattgtcatgtacggtagaagagaatgttgtttttctgtgttttatttatttattcttgattactaaggctgtgcttttggggggctgagaacccttcccagcacgcgtgcaaaatgggacagtggttagcgaaagattataatgagatgtggagtactagtattagctaaacaaacttaaaaagtagactaaggcagtgtttgaaggagggttgggaaacccttctctccgccatgtata

SEQ ID NO: 854 - DNA, 1759 bp, Hordeum vulgare
ttcatatttcctccacttttcaggtttgacaagattacttttaggaggccagaggaggccaatgattctgtgaaagagactagttcatctaaggttcagatacttgtctttgaaatagaagatcgtgaaatgattggtggatcggcgtatggaggtcaaaaagcaatttgttgtacatcagatcttgcaaagttgggagcttgcgtcgaaggctctgtcatctaccgcccgtcgcaggtgaatcctggttggccacagttgtttgttgcttcttttgatggaagtgatctgattgcaacgctgccttcaaggaccattccagtaaagaaaactgggatgtacaatatgtactttatacactgtgacccggcacttgctggactggaaatcgacgggaaaaccatatggaaaaatcctactggctaccttccaggtcggatggcacctcttaagaacttttttggactgatgtcatttgctttcgtgatacttggtatctattggttttatcaatacatgaagttctggcgagaggttcttccacttcagaactgtattactcttgttattacattgggcatgcttgagatggcattgtggtattttgaatatgctgagttcaatgagactggagttcgggcaaaggccatcacattttgggctgtaacatttgggactattaaaagaacagtggctcgtcttattattctcattgtctcgatggggtatggagttgtgaggcctactttgggtggtctgacatcgaaagtggtcatgcttggaggaacattctttgtagctacagaaattcttgagctagtggaaaatctaggcactgtgaatgatctgtctggaaaagctcgtctatttttagtctatccagtggccatcttggatgcttcattcattgtttggatatttatttctctagccaagacccttagccaacttcaggcaagaaggttgatggccaaacttgacatttataggaaattcactattgcattggccattactgttctggtatctattggctggattggctatgagatctacttcaaatcgactgatgtgttcaatgagcggtggcagtatgcatggataattcctgctttctggcatgccctatcattctcacttctttgcgtcatttcctacctgtgggcaccttctcagagctcaatgagatttaccaatgatgcaagtgaaaaatttgatcgagaagacagcctatcattaataaggccaaggcccattgtttccaagaacgggtggagcgtaacttccgcaccagatgccaaagcaacgaacaacacgaacaccgtggcatcttttgacgaagacgacgaggaaaacaaaagggagtgacgcatctgccgaaggagagagcattccacccacataagatcccttgaattggatgtgctagaacagttttggtatttagcagaggacaggccgtgctaattctagtcgtttggatacggtccttggaggcgtttctttcatgttaaatccgttatccctccactaggtttattcacacagagcctgcatcactgtagtctgtaaggatgattatatgtgataggaacaattcatctgaggcgttattttgagatgtatggtgtataatggtttcatttgtagatctcatgttgcttctagtttatgtgaagactgatgttggcagcaagtgcaattatttattgctacaaatgtgtcgaaatttccattttggtttcagcatcccaagatt

SEQ ID NO: 855 - DNA, 2152 bp, Setaria italica
caaacaagaatcagctggtctgggccggccgaccaaagcactactgtcctcttccccgcatctccagatttcctaccgacggccgcgggggccacacggcgacagcttccttggcttttcttccggttttgcccccaccgagctcagccgtggaaactgtggaggcgttgcactcccactccgctcccacgccagatccagcctcgccagctcgacccccatggcggccgcgcgcttcctcctcgccgtcgcgctcgcgctcctcctccgccccggggaggcgtccgtgcacgagtaccgcggcctcggcttcgccaacaagggcaacgccttcatcctccacgccggcagcgagggcctctacgcggcctcctccgccaacgccaccgccgaggacgacgaggacgctgccgcggcggccgacgccttcatccggtttgacaagattacttttagaagaccagaagatgctattgattctgtaaaggaggctacttcagctaaggttcaggtacttgtttttgagatagaagaccgtgaaatgattggtggatcagcttatggtggtcagaaagctatttgttgtacatcggatcttgcaaagttgggagcttgcacagaaggttctgtaatctaccgcccatcccaggtaaatcctggttggccaaagctgtttgttgcatcttttgatggaagtgatctgattgcaacactgccatcaaggaccattccaataaccaaaactgggatgtacaatatgtactttatacactgtgacccatcacttgctgacttggagatcgaggggaaaaccatatggaaaaatcctactgggtaccttccaggtcggatggcacctctgaagaacttctttggactcatgtcttttgcttttgttgtacttgggatctattggttctatcagtatatgaagtcctggagagaggttcttccactccaaaactgcattactctcgtgattacactgggtatgttggagatggcattatggtattttgagtatgccgaattcaatgagactggagttcggccaaagggcatcacattttgggctgtcacatttgggactgttaagagaacagctgctgaaattattgttctcattgtctcaatgggatatggagttgtcacgcctactttgggtggcctgacatcaaaagtggtcatgcttggaggaacattctttctagcaacagaaactcttgaattggtagaaaatcttggtgctgtgaatgatctatctggaaaagctcggcttttcttggtttatccagtggccattttagatgccgcttttgttatttggatattcatttctctagctaagaccattggtaaacttcaggcaagaaggctgatggccaaacttgagatttataggaaattcgcaattgcattgattgtatctgttctggtgtctgttggctggattggctatgagatttacttcaaatcaacagatgtattcaatgaacgatggcaatacgcatggattattcctgccttctggcatgtcttgtctttctcacttctttgtgtcatttgctacctgtgggcaccttcgcagaactcaatgagatttgcttatgatggaagcgaattctttgaccggaaggacaatctatcattaattaggccagcgcccagtgcttccaaaaatggatggagtttatcttctacaccagaagacaaagcaacaaagaacgtgaattccgtagcatctttcgatgaggatgatgaggaaaacaaaagggagtaggacttactaccaatttgaccagggaaggaatatgagacgacatgtgatcctttcaagtggatttagggcaattttggtatttagcagaggattggccttgttaattctagttaatgaaatacatcacttgaggctatttctgttcatttccgctatagtttattgcacggccagtcatactgtttatcatcatagtctgaatgatggtacatgataggaacaattagtctgtggcattatgaagggtttatgctgtatgatatttatattatagacaccatatcgcttctgaactcggcttatgccatgtatgttagagaataaactgttctactggatctttgctagaagttcactttaactgtctactgt

SEQ ID NO: 856 - DNA, 2216 bp, Panicum virgatum
caaagaaaggtctgggccggccgaccaaagcacaaccctcctcctccccccattttcctaccgacggccgcgggggccacacggcgacagcttccttgtttttttcttccggttttgcccccgccgagctcagccggggaggcgctgcactcccactccgctccacgccagatccagcctcacaagctcgaccccatggccgtccgcttcctcctcgtcgtcgccctcgcgctcctcctccgcccgggggaggcgtccgtgcacgagtaccgcggcctcggcttcgccaacaagggcaacgccttcatcctccacgccggcagcgagggcctctacgcggcctcccccgccaacgccaccgccaccgccggggacgatgaggacgccgccgcagtggccgacgccttcatccggtttgacaagattacttttaggagaccagaggatgctgttgattctgtaaaggagaccagttcagctaaggttcaggtacttgttttcgagatagaagaccgtgaaatgattggtggatcagcttatggaggtcagaaagctatttgctgtacctcagatcttgcaaagttaggagcttgcacagaaggttctgtcatctaccgcccatcccaggtaaatcctggttggccaaaattatttgttgcatcatttgatggaagtgatctgattgcaatgctaccatcaaggaccattccgataaacaaaactgggatgtacaatatgtactttatacactgtgatccttcacttgctggtttggagattgaggggaaaaccatttggaaaaatcctactgggtacattccaggtcggatggcacctcttaaaaacttttttggactgatgtcttttgcttttgtcatacttgggatctattggttctatcagtacatgaagtcttggagagaggttcttccacttcaaaactgtattactctcgtgattacactgggcatgttggagatggcattgtggtattttgagtatgctgagttcaatgagactggcattcggccaaagggcatcacattttgggctgtcacatttggaactgtcaagagaacagctgctgaagttattgttctcattgtctcgatgggatatggagttgtcacgcctactttgggtggcctgacatctaaagtggtcatgcttgggggaacattctttgtagcaacagaaactcttgagttggtagaaaatctgggtgccgtgaatgatctatcaggaaaagctcggcttttcttggtttatccagtagccattttagatgccgcatttgttgtttggatattcatttctctagctaagaccattggtaaacttcaggcaagaagactgatggccaaacttgagatttataggaaattcgcaattgcactgattgtatctgttctggtgtctgttgcctggattggctatgagatttacttcaaatcaacagatgtattcaatgaacgatggcaatacgcatggattattcctgccttctggcatgttttgtctttctcacttctttgcgtaatttgctacctgtgggcaccttcgcagaactcaatgagatttgcttatgatgcaagcgaattctttgaccggaaggacaatctatcattaattaggccagcacccagtgcttccaaaaatggatggagtttatcttctactccagatgacaaagcaacaaagaatgtgaataccgaatcatcttttgatggggatgacgaggaaaacaaaagggagtagaacttattgtcaattcaattgggggagggaatatgcaaagacatgtgatccattgaagtggacaatagagcaattttggtgtttagcagaggattggccttgctaattctagttaatgaagtacttcacttgaggttatttctttacttgattcatttccactatagcttattggcttattgcacggccagtcatgctgttatcatcatagtctgaatgatggtacatgataggaacagttagtctgtggcattatgaagggtttatgctgtataatatttatattatagacatcatattgctggttcgcatgaactcggcctatgccatctatgttagagaataaactattttgctggtctttgttagaatttgacttaattgcctaatcattcggtacgtttctgtgatcaatttttatcaagtcagaccatgggtcaaaagcagcaattcaacta

SEQ ID NO: 857 - DNA, 2124 bp, Sorghum bicolor
aaaaagaataagctggtccgggccgaccaaagcactgtccttcactccccatttcctaccgacggccgagggggccacatcctttggcttttctcccggttttgccccccggtccccctgccgagctccagcaggggaggcgctgcgcctgcgctccactccgcttcacgccagatccaacctcaccagctcgcccccatggccgtccgcctcctcctcgccgttgccgtcgctctcctcctccgccccggggatgcgtccgtgcacgagtaccgcgggctcagcttcgccaacaagggcaacgccttcatcctccacgccggcagcgagggcctctacgcggcctcccacgccaacaccaccgccgaggacgatgaggacgccgccgcggtggccgacgccttcatccggtttgacaagattacttttaggcgaccagaagatactaacaattctgtgaaggagactagttcagctaaggttcaggtacttgtttttgagatagaagaccgtgaaatgattggtggatcagcctatggaggtcagaaggctatttgttgtacttcagatcttgcgaaattaggagcttgcacagaaggttctgtcatctaccgcccatcccaggtaaatcctggttggccaaagttgtttgttgcatcttttgatggaagcgatctgatcgcaacgctaccgtcaaggaccattccaattaccaaaactgggatgtacaatatgtactttatacactgcgatccttcacttgctagtttggaaatcgaggggaaaaccatatggaaaaatcctactgggtaccttccgggtcggatggcacctcttaagaacttttttggactgatgtcttttgcatttgttgtacttgggatctattggttttatcagtacatgaaatcttggagagaggttcttccacttcagaactgtattactcttgtgattacactgggcatgtttgagatggcattgtggtattttgagtatgctgagttcaatgagactggagttcggccaaaaggcatcacattttgggctgtcacgtttggaactgtcaagaggacggctgctgaagttattgttcttattgtctcaatgggatatggtgtcgtcacgcctactttgggtggcttgacatcaaaagtggtcatgctcggaggaacattttttctagcaacagaaattcttgaattggtagaaaatcttggtgctgttaatgatctatttggaaaagctcgtctgttcttgatctatccagtggccattttagatgccgcatttgttgtttggatatttatttctctagctaagactattggtaaacttcaggcaagaaggttgatggccaaacttgaaatttataggaaatttgcaactgcattgatcatatctgttctggtgtctattgggtggattggctatgagatttactccaaatcaacagatttatttaatgaacggtggcagcatgcctggattattcctgccttctggcatatcttgtctttcttacttctttgtgtcatttgctacctgtgggcaccttcacaaaactcaatgagattttcttatgatgcaagcgaattctttgatcgaaaggataatctctcattaattaggccagcacccagtgcttccaagaatggatggagtgtatcttctacaccagagcccaaagctacaaaggacatgaataccgtagcagatcttgaaggggatgatgaggaaagcaaaagggagtagaatgtactgtcaatttgattaggggagggtatatttgaggtccattgaagtgggtgccatagcaattttggtatttaggagaggattggccatgctagttattattattaatggatcacgctacttgaggttatttctttctttggttctttaccaccatagttcttcgcatggccagttatgttgttatcatcatagtctgaatgatggtatatgatagaaacaattagtctgatgtataatatttgtattactggcaccatattgcttctggcccgtgtgaactctacatatgctacgaatgttagggaatacattgttttgctggatctttgttaaaatttcacttgattgtctaatgtcccaata

SEQ ID NO: 858 - DNA, 1893 bp, Saccharum officinarum
ctcgccccatggccgcccgcctcctcctcgccgttgccgacgctctcctactctgcgccggggatgcgtccgtgcacgagtaccgagggctcggcttcgccaacaagggcaacgccttcatcctccacgccggcagcgagggcctctacgcggcctcccacgccaacaccaccgccgaggacgacgaggacgccgccgcgctgcccgacgccttcatccggtttgacaagattacttttaggcgatcagaagatactaacgattctgtgaaggggactagttcagctaaggttcaggtacttgtttttgagatagaagaccgtgaaatgattggtggatcagcgtatggaggtcagaaggctatttgttgtacttcagatcttgccaaattaggagcatgcacagaaggttctgtcatctaccgcccatcccaggtaaatcctggttggccaaagttgtttgttgcatcttttgatggaagtgatctgatcgcaacgctaccgtcaaggaccattccaattaccaaaactgggatgtacaatatgtactttatacactgtgatccatcacttgctagtttggaaatcgaggggaaaaccatatggaaaaatcctactggatacgttccgggtcggatggcacctcttaagaacttttttggactgatgtcttttgcatttgtcgtacttgggatctattggttttatcagtacatgaaattttggagagaggttcttccgcttcagaactgtattactcttgtgattacactgggcatgtttgagatggcattgtggtattttgagtatgctgagttcaatgagactggagttcggccaaaaggtatcacattttgggctgtcacgtttggaactgtaaagaggacggctgctgaagttattgttctcattgtctcaatgggatatggtgttatcacgcctactttgggtggcttgacatcgaaagtggtcatgcttggaggaacattctttctagcaacagaaattcttgagttggtagaaaatcttggtgctgttaatgatctatctggaaaagcccgtctgttcttggtctatccagtggccattttagatgccgcatttgttatttggatatttatttctctagctaagaccattggtaaacttcaggcaagaaggttgatggccaaacttgacatttataggaagtttgcaactgcattgatcgtatctgttctggtgtctgttgggtggattggctatgagatttactccaaatcaacagatgtatttaatgaacgatggcagcatgcctggattattcctgccttctggcatgtcttgtctttcttacttctttgtgtcatttgctacctgtgggcaccttcacagaactcaatgagattttcctatgacgcaagcgaattctttgatcgaaaggacaatctatcattaattaggccagcacccagtgcttccaagaatggatggagtttgtcttccacaccagtgcccaaagctacaaaggacgtgaataccgtaacagattttgaaggtgatgatgaggaaaacaaaagggagtagaatgtactgtcaatttgattaggggagggtatatttgagaatcttttgaagtgggtgctagagcaattttggtacttattactttattaggagaggattggccatgctagttattattaatggagcacgccacttgaggttatttctttcgttggttctttaccaccatagttcttcgcatggccagttatgttgttatcatcatagtctgaatgatggtatatgatagaaacaattagtctggtgtataatatttatattgttggcaccatattgcttctggtccgtgtgaaccctacatatgctacgaatgttagaagaataaatt

SEQ ID NO: 859 - DNA, 1659 bp, Triticum aestivum
tttaggaggccagaggaggctaatgattctgtgaaagaaactagttcatctaaggttcagataattgtctttgaaatagaagatcgtgaaatgattggtggatcagcatatggtggtcaaaaagcaatttgttgtacatcagatcttgcaaagttgggagcttgtgttgaaggctctgtcatctaccgcccatcgcaggtgaatcctggctggccacagttgtttgttgcttcttttgatggaagtgatctgattgcaacgctgccttcaaggaccattccagtaaagaaaactgggatgtacaatatgtactttatacactgtgacccggcacttgctggactggaaatcgacgggaaaaccatatggaaaaatcctactggctaccttccaggtcggatggcacctcttaagaacttttttgggctgatgtcatttgctttcgtgatacttggtatctattggttttatcaatacatgaagttctggcgagaggttcttccacttcagaactgtattactcttgttattacattgggtatgcttgagatggcattgtggtattttgaatatgctgagttcaatgagactggagttcgggcaaaggccatcacattttgggctgtaacatttgggactattaaaagaacagtggctcgtcttattattctcattgtctcgatggggtatggagttgtgaggcctactttgggtggtctgacatcgaaagtggtcatgcttggaggaacattctttgtagctacagaaattcttgagctagtggaaaatctaggtactgtgaatgatctgtctggaaaagctcggctatttttggtctatccagtggctatcttggatgcttcattcattgtttggatatttatttctctagccaagacccttagccaacttcaggcaagaaggttgatggccaaacttgacatttataggaaattcactattgcattggctattactgttctggtatctatcggctggattggctatgagatttacttcaaatcgacagatgtgttcaatgagcggtggcagtatgcatggataattcctgctttctggcatgccctatcattctcacttctttgcgtcatttcctacctgtgggcaccttctcagagctcaatgagatttaccaatgacgcaagtgaaaagtttgatcgagaggacagcctgtcattaataaggccaaggcccattgtttccaacaacgggtggagcgtagcttcgtcaacagacgccaaagcgacgaagaacacagatagtgtgacatcttttgacgaagacgacgaagaaaacaaaagggagtaacgcatctgatgaggccacctcatcagatcctttgaagtggatatgctagaacaattttggtatttagcagagggatcggccgtgctaattctagtcgttgggatacggtccttggaggggtttcttccttgttaaatccttctcctccattggttttttcatacagtgcatgcatcactgtaaggatgattatatatgataggaacagttcatgtgtggtgttatgggggatgtatggtgtatgatacttctctttggtagatctcgtattgcttctagtttatgtgaacacgaatgttggcagtacttgctgcgagtgcaattatttgt

SEQ ID NO: 860 - DNA, 2128 bp, Zea mays
caaagagaactggtctgggccgaccaaaacactttccttccctccccgtttcctaccgacggccgagggggccacatccttcggcttctgtcccggttttgccccccggcccctgccgagctcagcaggggaagcgcggcgctctactccactccgcttcacgccagatccaacctcaccagctcgcccccatggccgtccacctcctccttgccgttgccgtcgctctcctcctctgccccggggatgcgtccgtgcacgactaccgcgggctcagctttgccaacaagggcaacgccttcattctccacgccggcagcgagggcctctacgcggcctcccacgccaacaccaccgccgaggacgacgaggacaccgccgcggtggccgacgccttcatccggtttgacaaggttacttttagacgaccagaagatactaacgattctgtgaaggagactagttcagctaaggttcacatacttgtttttgaggtagaagaccgtgaaatgattggtggatctgcctatggaggtcagaaggctatttgttgtagttcagatcttgcaaaattaggagcttgcaaagaaggttctgtcatctatcgcccatcccaggtaaatcctggttggccaaagttgtttgttgcatcttttgagggaagtgatctgatcgcaacgctgccgtcaaggaccattcaaattaccaaaactgggatgtacaatatgtactttatacattgtgatccttcacttgctagtttggaaatcgaggggaaaaccatatggaaaaatcctactgggtatcttccaggtcggatggcgcctcttaagaacttttttggactgatgtcttttgcatttgttgtgcttgggatctactggttttatcagtacatgaaatcttggaaagaggttcttccacttcagaactgtattactcttgtgattacactaggcatgcttgagatggcattgtggtattttgagtatgctgagttcaatgagactggagttcggccaaaaggtatcacattttgggctgtcacgtttggaactgtgaagaggacggctgctgaagttattgtcctcattgtctcaatgggatatggtgttgtcgcacctaccttgggtggcttgacatcgaaagtggtcatgcttggaggaacgttctttctagcaacagaaattcttgagttggtagaaaatcttggtgctgttaatgatctatctggaaaagctcgtctgttcttggtctatccagtggccattttagatgccgcatttgttgtttggatatttatttctttagctaagaccatcggtaaacttcaggcaagaaggttgatggccaaacttgacatttataggaaatttgcaactgcattgattgtatctgttctggtgtccgttgggtggattggctatgagatttactccaaatcaacagatgtatttaacgaacgatggcagcatgcctggatcattcctgccttctggcatgtcttgtctttcttacttctttgtgtcatttgctacctgtgggcaccttcacagaactcaatgagattttcctacgacgcaagcgaattctttgatcgaaaggacaatctgtcattaattaggccagcaacgagtgcttccaagaacggctggagtttatcttctgcgccagaggccaaagcaacaaaggacgtgaatacagttgcagattttgaaggcgatgatgaggaaaacaaaagggagtagaatgtactgtcgatttggttaggggagggtatattctgagatcatttgaagtgggtgctagagcagttttggtacttaggagaggactggccatgctaattactaccagtggagcacgccacttgtggctgtttctttctttggttcattaccaccacagttcttcgcatgggtggctagttatgtacttatgttgtcatcgtcatagtctgaatgatggttatgataggggggaaaatagtctggtgtataatatttatattattggcaccatattgcttctggatcgtgggaactctacatatgctgcgaatgttagagaataaattgttttgctggacctttgctagaattccacttgattgtctaatgtttcgata

SEQ ID NO: 861 - DNA, 2240 bp, Zea mays
gtttttagtgctggtttgacaattgtcattgatcctcgaactttgaacaccaaagaagaattgctgccttgctggtctgggaagcactttctttcactccttccctccccatttcctactgacggccgagggggggcacattctttggcttttgtcccggttttgccctccggctcctgccgagctcagcagggggaggcgctgcgcttcgcttcacgccagatccaacctcaccggccaccagcttgcctccatggccggtcgcttcctcctcgtcgttgccgtcgccctcctcctccgccctggggatgcgtccgtgcacgagtaccgcgggctcagcttcgccaacaagggcaacgccttcatcctccacgccggcagcgagggcctctacgcggcctcccacgccaacaccaccgccgaggacgccgccgcagtggccgaagccttaatccggtttgacaagattacttttaggcgatcagaggatactaataattctgtaaaggagactagttcagctaaggttcaggtactcatttttgagatagaagatcgtgaaatgattggtggatcagcatatggaggtcagaaagctatttgttgtacttcagatcttgcgaagttaggagcttgcacagaaggttctgtcatctaccgcccatcccaggtaaatcctggttggccaaagttgtttgtagcatcttttgatggaagtgacctgatcgcgacactaccgtcaaggaccattccaattaccaaaactgggatatacaatatgtactttatacactgtgatccatcacttgctagtttggaaatcgaggggaaaaccatatggaaaaatcctactggataccttccgggtcggatggcacctcttaagaacttttttggactgatgtcttttgcatttgtcgtacttgggatctattggttttatcagtatatgaagtcctggagagaggttcttccacttcagaactgtattactcttgtgattacactgggcatgtttgagatggcattgtggtattttgagtatgctgaatttaatgagactggagtacggccaaaaggcatcacattttgggctgtcacgtttgggactgtcaagaggacggctgctgaagttattgttctcattgtctcaatgggatatggtgttgtcacgcctactttgggtggcttgacatcaaaagtggtcatgcttggaggaacattctttctagcaacagaaattcttgaattggtagaaaatcttggtgctgttaatgatctatctggaaaagctcgtctgttcttggtctatccagtggccattttagatgctgcatttgttatttggatatttatttctctagctaagaccattggtaaacttcaggcaagaaggttgatggccaaacttgacatttataggaaatttgcaactgcattgatcatatctgttctggtgtctgttgggtggattggctatgagatttactccaaatcaacagatgtatttaatgaacgatggcagcatgcctggattattcctgccttctggcatgtcttgtctttcttacttctttgtgtcatttgctacctgtgggcaccttcacaaaactcaatgagattttcttatgatgcaagtgaattctttgatcgaaaggataatatctcattaattaggccagcacccagtgcatccaagaatggatggaatttatcttctacaccagagcccaaagctacaaaggatgtgaataccgtagcagattttgaaggtgatgatgaggaaaacaaaagggagtagaatgtactgtcgatttgattacggagggtatatttgagatcctttgaagtgtgtgctagagcaattttggtatttaggagaggattggccatgctagttattattaatggagcactccgctcgatgttatttcttcgattcgttaccactacagtagttcttcacatggcgagttatgctgttatcttcatagtcttaatgatggtatatgatagaaacaattagtctggtgtataatatttataataatggcaccatattgcttctggttcctgtgaactcgacatatgttatgaatgtcagagaataaattacgatagaaacaattagtctgatgtataatatttgtattactggcaccatattgcttctggttcctgtgaactctacatatgctatgaatgtcagagaataaattgttttgctggatctttgttag

SEQ ID NO: 862 - DNA, 1888 bp, Triticum aestivum
ctttcctgtaaactatgctggaggagataatcaggtcgccgacgtggaccatccgacaccgcgagcgacgcgaccactccagagctccaacgcggaacggcgatgtggcgggcgaggcggtggccgcggccgcgatggttctcgtccgacaccgcggcagtgggcgccgattcgggcaatccggcgcggcgtcgggtggcggcgctgtgggggaacggggaccacggccggctggggctgggggcgctggagtcgcggtggagccccacggcgtgccccttcttcctcacgcgccccgccgacccgcctacctcgctcgcctgcggcggcgcccacaccctcttcctcaccgagggtgggcgcgtgtttgctacggggctgaacgactttgggcagctcgggataggctcctcgatgcctcatactctggaccctgttgaagtctctggatttcacgagaaagttgtacaaatttcagctggcaaccatcattcttgtgcagtaacagcggatggtgagctcttcgtttggggcaaaaattcgagtggccagcttggccttggcaaaagtgcaggaaaagtagtctctaccccaagaaaggttgactacttggctgatgttagagtgaaaatgactgctttgggatcagagcactcaattgttgttacagaggatggtgaagccttgagttggggagctgctggtgctggtagacttggacatggccataaatctagcttcctgggattcgctatgacctcaaatgaatatactccaaggttgataaaaaaccttgatggtatcaagattaaaaggatagctgcgggaatgctgcactcagcttgcattgatgaaaaaggtactgtgttcatgtttgggcagaagactgagaaggtacttggaagatcaaatgatgcacctagaccaagtgctgttgaagagatacaattttcagaagaagttgcttgtggaggttatcatacttgcgctgtaacagatcgtggagatttgtattcttggggttcaaatgaaaatggctgccttggtcttggaggtacaggcatggttcgcttcccagaagttgtaagaagttcattatttaagcttcctgtatctaaggtatcctgtggttggaagcacacagctgtaatttcaggtgaagatatctacacgtggggctggggaggtgccaacggtaccttcttcgaagagggccattcttctggcgggcaattagggcatggaaacgacgtcgactattgcgagccgatgatggtagaacttggcaagaatgcaagtgctgttcatgtatcatgtggcttcaatcatacaggcgcgatactcgagtacgcggaaaactgactgctgtgccatctgcagcactgtaagtgcaaccaggcatgtttggtactactcagtcatacctgcacaaggaaaaagaataagctgacctcgaacgagtgatgaactcgtcaaacagaattacaggttagtctagctgtatagtcttctttcatacatcttcattgtcagcttgtatctatgatgtttgatggcctgtaaagaagtggtgtttgacgtcgcacaggctgtgatgtaaacggccagttgaaaatgtaaacatgattttaactaaaataaatcttgtcttgtacagttacaaacttgcaatgtacatggatcgtccattgttatttttacatggcgctcaactatctctctttggtgttgcgattccgtttgacaactattttcggtggatgtcgcgctttttacgcgtcagaatttgaagggcttggggcatggtcaaattaatgttaaaacatatgcaaagattgagttaatatgctacttatggtctttgccttgttctttgtgcataggaatg

SEQ ID NO: 863 - DNA, 1669 bp, Triticum aestivum
tgtaaactatgctggaggagataatcaggtcgccgacgtggaccatccgacaccgcgagcgacgcgaccactccagagctccaacgcggaacggcgatgtggcgggcgaggcggtggccacggccgcgatggttctcgtcccacacggcggcggtgggggtcgattcgggtaatccggcgcggcgtcgggtggcggcgctgtgggggaacggggaccacggccggctggggctgggggcgctggagtcgcggtggagccccacggcgtgccccttcttcctcacgcgccccgccgacccgcctacctcgctcgcctgcggcggcgcccacaccctcttcctcaccgagggtgggcgcgtgtttgctacggggctgaatgactttggacagctcgggataggctcctcgatgcctcatactctggaccctgttgaagtctctggatttcatgagaaagttgtagaaatttcagctggcaaccatcattcttgtgcagtaacagcggatggtgagctcttcgtttggggcaaaaattcaagtggccagcttggccttggcaaaagtgcaggaaaagtagtctctaccccaagaaaggttgactacttggctgatgttagagtgaaaatgactgctttgggatcagagcactcaattgttgttacagaggatggtgaagccttgagttggggagctgctggtgctggtagacttggacatggccataaatctagcttcctgggattcgctatgacctcaaatgaatatactccaaggttgatcaaaaaccttgatggtatcaagattaaaaggatagctgcgggaatgctgcactcagcttgcattgatgaaaaaggtactgtgttcatgtttgggcagaagactgagaaggtacttggaagatcaaatgatgcacctagaccaagtgttgttgaagagatacaattttcagaagaagttgcttgtggaggttatcatacttgcgctgtaacagatcgtggagatttgtattcttggggttcaaatgaaaatggctgccttggtcttggaggtacaggcatggttcgcttcccagaagttgtaagaagttcattatttaagcttcctgtatctaaggtatcctgtggttggaagcacacagctgtaatttcaggtgaagatatctacacgtggggctggggaggtgccaacggtaccttcttcgaagagggccattcttctggcgggcaattagggcatggaaacgatgtcgactattgcgagccgatgatggtagaacttggcaagaatgcaagagctgtgcatgtatcatgtggcttcaatcatacaggcgcgatactcgagtatgcggaaaactgacagcgatgccatctgcagcactgtaagtgcaaccaggcatgtttggtactacccagtcatacctgcacaaggaaaaagaataagctgacctcgaacgagtgatgaactcgtaaagcagaattacaggttagtctagctgtatagtcttctttcatatattttcattgtcggcttgtatctatgatatttgatgacttgtaaagaagtgtgtaacgttgcccaggctgtgatgtgcacggccagtttaaaatgtaaagatgttttggactaaaataaatattgtcttgtatagttacaaacttgcaatgtacat

SEQ ID NO: 864 - DNA, 1833 bp, Brachypodium distachyon
cacccagaaacatcaggcattcaggcgcgacagggcaactacgtggactcgcggacgccgcgagcgacgcgaccgctcgggagagctccaacgagaacgcgatgtggcgagcgaggcggtggccgtggccaagcccgcggtcgaggccgcgatggctctctactgaagcggtggcgggttcgggcgagccggcgtggcgtcgggtggcggcgctgtgggggaacggggactacggtcggctggggctgggggcgctggagtcgcggtggaaccccacggcgtgccccttcttcctcgcgcgcgccggcgacccgcccgcctccctcgcgtgcggcggcgcccacaccctcttcctcacacagagtggtcgtgtgttcgctacggggctgaacgacttcgggcagcttgggataggctcatctacgacccatatcgtggaccctattgaggtcactggatttggcgagaaagttgtacaaatttcagctggcaaccatcattcctgtgcagtaacagcggatggcgagctctttgtttggggcaaaaattcgagtggccagcttggccttggtaaaggtgtgggaaaagtagtgtctaccccgaggaaggttgactacttggctgatgttagagtgagaatggttgctttggggtcagaacattcaattgctgttacagagggaggtgaagctttgagttggggagctgctggcgctggtagacttggacatggccacaaatctagcatcctgggattcggtatggtctcaagtgaatatacaccaaggttgatcaaaaaccttgatggtgtcaagattaaaaggatagctgcaggaatgctgcactcagcttgcattgatgaaaaaggtactttgttcatatttgggcagaagactgagaaggtatttggaagatcaaatgatgcacctagaccaactgttgttgaagagatacagttttcggaagaagttgcttgtggaggttatcatacttgcgctttaacagatggtggcgatttgtattcttggggttcaaatgaaaatggttgccttggcctcggggttacgggcatggttcgttccccagaagttttaaggagtacattatttaagcttcctgtatctaaggtatcctgtggttggaagcacacagctgtaatttcaggtgaagatatttacacatggggttggggaggtgccaatggtacattctttgaagagggccagtcttctggtgggcaattggggcatggaaacgatgtcgattattttgagcctatgatggtggaacttggcaggaatgcaagagctgttcatgtgtcatgtggcttcaatcataccggtgcgatatttgagtacaaggagaattgactgatgtgccatcttcaggaccgcaagtgcaaccaggcatgtttggtaccactaagttatacctgcatataaaggggagaaaagaataagttttgctcttggttctgcactcgtcttgtatgtgaaaaggaatataaacaagccgattacacacctcaaatgagtgtatctagaaaaactcgttaaacagaatgggagacaagccagatgtcgtacataccgaattttacaggttagcctagctgtatagtgttcatattattttcttcttcttgccagcttgtatctatcatatttgacaagcctgtaagaactctggtgtttgcggtcgcaaatacagaaatgctgatgtgcacgaccgggtcgtgtaaaataagatgttaaccaaaataaaccatgtttgtgtagttataaacttgcaccttacatggatcatccattattttttaggatggcatttaac

SEQ ID NO: 865 - DNA, 1816 bp, Oryza sativa
cacctaccttgggctccgcctccgccgcgcgaacgcgagcaggagcagcctctcgtcgccgacgtggactcacccgacgccgcgagccgagagcgcgagagcgcgagaggcgagagcagcaaccaccgccgatgtggcgggcgaggcggtggccgtggccgtggcggtcgcagcggcgcgcggcgaggatgctctcgtcgggtgagccagcggcggggcggcggagggtggcggcgctgtgggggaacggggactacgggcggctggggatgggggcgctggagtcgcggtggagccccacggcgtgccccttcttcctcaccggccgccccggcgacgacgacgacgacccgcccgcctccctcgcctgcggcggcgcccacaccctcttcctcaccgagagcgggcgcgtgttcgccgcgggtctcaacgacttcgggcagctcgggataggctcctccgtgactcattccctggagcctattgaagtttctggctttgatgagaaagttgtggaagtttcagctggcaaccatcattcttgtgcagtaactgcggatggcaagctcttcgcttggggcagaaattcaagtggccagcttggtcttggcaaaagggcaggaaaagtagtttctaccccaagaaaggtggactgcttggctgacgctagagtgaaaatggttgctttggggtcggagcattcaattgctactaccgaggagggtgaagtcttgagctggggagctgctggtgctggcaggcttggacatggacataaaactagcatactgggattctctataactacaagtgaatatactccaaggttgatcaagaatcttgatggtgtcaagattaaaaggatagctgcgggaatgctgcactcagcttgtatcgatgaaaaaggtacattgttcatattcgggcagaagactgagaagggatttggaagatcaggtgatgaacttagaccaactgttgttgaggaggtaccattttctgaagaggttgcttgcggaggttatcatacttgtgttgtgacagatagtggagatttgtactcttggggttcaaatgaaaatggctgccttggtcttggtggtacagacatggttcgctctccggaggttctgaagagttctttatttaagtttcctgtatctaaggtatcatgtggttggaagcacaccgctgtaatttcaggtggagatatttacacgtggggctggggaggtgctaacggtacttttttcgaagagggccattcttctggtggacagttaggacacggaaacgatgttgattactttgaacctatgatggtggaattcggcaagaatgcaagggccgtccatgtgtcatgtggtttcaatcatactggtgcaatatttgaatacagcgagaactgaatttttacatcacagcaggaccccatccaaagcatgcttattaccaagttataagtgcacatacaagagaaaggaagataggataaagttttgctctttaattcgagtgtataaaaagaaaaataaattaaactgattacacccctcgcatagggtgggggtggggggtctaaattaagataaacagaacaagaggcaatctggatgcatttgttgtatgtatcagaattacaggttagtagaactgtatattgttctttcattatttttcttttaatccatatgtataatcttcacgaccaataataacaactctgatgcttcaaaccgtctatgctgtacatgatatggctaatttgtttttcatttagcaatgttgcaaatgtctttcatacatgtgatgaggt

SEQ ID NO: 866 - DNA, 1850 bp, Sorghum bicolor
cgcctgccagcgaacgctgtcttgggtcctgtgtcgccgacgtgggctcgccgtcgccgcgagctccaccttccttcgtctctccgctccgcgccgagcgcgatgtggcgagcgacgaggcggtgtccgccgctgctgcggtggttctcttcggacgcagccgcctccaaggcggcgccgcggcggcagcgggtggcggcgctgtgggggaacggggactacgggcggctggggctgggcgtgctggagtcgcgctggagccccacggtctgccccttcttcctcgcccgcgccgccgacccgcccgcctccctcgcctgcggcggcgcgcacaccctctttctgacccagagtgggcgagtgtttgctacagggctgaacgactttgggcagctcggggtaggatcctcggttacacatacgctggagcctgttgaagtttctggatttcacgagagagttgtagaagtttcagctggcaatcatcattcttgtgcagttaccgcggatggtaagctctttgtttggggcagaaactcaggtggccagcttggccttggtaaaggggcaggtaaagttgtttctaccccaacaaaggttgattgtttgactgacttcagaataaaaatggttgctctgggatcagagcattcaattgctgttacagaggaaggtgaagtcttgagttggggagctgctggttctggtaggctcggacatggccgtcaatctagcatcctgggattttctctgaccacaagtgaatatactccaagattgatcaaaaactttgatggtatcaagattaaaaagatagctgcaggaatgttgcactcagcttgcattgatgaaaaaggtactttgttcatatttgggcagaagactgagaagggatttggaagatcaaatgaagcattcagaccaaatattgttgaagagattccattttcagaagaagttgcttgtggaggttaccatacttgtgttgtaacagatagcggtgatctgtattcttggggttcaaatgaaaatggctgccttggtctgggaggtacagatatggtttgctctccagaaattttgaaaagctcgctatttaaacttcctgtatctaaggtatcttgtggttggaagcacacagctgtaatttcaggtgatgacatttacacatggggttggggaggcgccaatggaactttttttgaagaggggcattcttccggtggacagctaggacatggaaatgacgtagactattttgaacctatgatggttccctttggcaagaatgcaagagccgtccatgtatcgtgtggcttcaatcatactggtgcaatttacgagtactccgaggactgattgatgtgccacctgcagacagcagatcagcatgtcttggagacttggactaattatcgaattatactcagtagaagtgcacataaacagcagaaagaagctctgatattggacctgcacctatgtgaagagaaatatagtctatagaacagagtgataccacccccctgattgagcgagggggatgtaaatcaaacagaataagagataaactggatgcattttatgatgcatcagagttacaggtcagtgtatagcgttccagtcgttccttcatttattgggtggttatgtattattttgccagctaataagaaatccattgcctgaggtctcagcaggctgttcgtgtacatgatgagtacttcactgcttggtgtctatgctagctgtgtttctgtgtaaataatacatgaatcaattaatcctgtttgtacaattaaaaatgtacatatatcagtgcatcgttcattattttttttggaagattt

SEQ ID NO: 867 - DNA, 1779 bp, Setaria italica
ccttccagcgaacgaacgctctcgtctctcgtttcgtctcgtcgcccacgtgggctcgccgtcgccgcgagctccaccttcctctccagtctccactccgccaccattccagcccgagcgcgatgtggcgggcgacgaggcggtggccgccgctgctgcggtgtctctcgtcggacgccgcctcctccagggcgccgcggcagcgggtggcggcgctttgggggaacggggactacgggaggctggggctgggcgcgctggagtcgcggtggagccccacggcctgccccttcttcctctcccgcgccgccgacccgcccgcctccctcgcctgcggcggtgcgcacaccctcttcctcacccagagcgggcgtgtgttcgccacggggctaaacgactttgggcagctcgggataggatcctctgttacacatacgctggagcctgttgaagtttctggatttcacgagagagttgtagaagtttcagctggcaaccatcattcttgtgcaattactgcggatggtaaactctttgtttggggccgaaactcaggtggtcagcttggccttggaaaaggggcaggcaaagtagtttcaagcccaacaaaggttgattgtttgactgacttcagagtgaaaatggttgctttgggatcagagcattcaattgctgttacagacgaaggtgaagtcttaagttggggagcttctggttccggtaggcttggacatgggcctcaatctagcatactgggattctcccttacctcaagtgaatatactccaaggttgatcaaaaaccttgacggtatcaagattaaaaagatagctgcaggaatgttgcactctgcttgcattgatgaaaaaggtactttgttcatatttgggcagaagactgagaagggatttggaagatcaaatgaagcattcagaccagttattgttgaagagataccgttttcagaagaagttgcttgtggaggttaccatacttgtgttgtagcagatagtggtgatctgtattcttggggttcaaatgaaaatggatgccttggtctgggaggtacagacatggttcgctctccagaaattttgaaaagctcactatttaagcttcctgtgtctaaggtgtcttgtggttggaagcacactgctgtaatttcaggtgatgacatctacacctggggttggggaggcgctaatggtacttttttcgaagagggccattcttctggtggacaactggggcatggaaatgacgtagattattttgaacctatgatggtgccgtttggcaagaatgcaagagcagtccatgtatcatgtggcttcaatcatactggtgcaatttatgagtactgcgaggactgactgacctgccatctgcggaatggcatgtttcggactaattatccaatcatactggcatactgcacaggtgaacagataaacagcagaaaaaagctaaggtattggatctgcatctatgttaagagagatatagaacagaatgataacaccccttgagtgagggggatgtaaattaaacagaataagagataagccggatgccttttgtgatgcatcagggttacaggcagtgtatagtgttcattcatttatttggtggatatgtattattttgccggctaataagaaatccatcgcctgtgatctgaccaggctggtgttgtacatgatgagtgcttggtgtctatgtttgctgcgtttctatatgtaaattgatatctgaatcagaacaaatcctgtttgtaca

SEQ ID NO: 868 - DNA, 1462 bp, Leymus cinereus x Leymus triticoides
ccgttctcctcgctccgctcgttctggattcaaatttcgaatccccccaccctttccgcccccctgcaccaaatacctgacccgattccttttcctccccgcctctcccaccatgagtgacgcacccggcgcaccagcctcagctatgggcagtggcagggagctcgccaacccaccgtcggacggcatctccaacctccgcttctccaaccacagcgaccacctcctcgtttcctcctgggacaagacggttcggctatatgacgccgaggcgaacgtgctcaagggggagttcgcgcaccccgggcctgtgctcgactgctgcttccacgacgactcctcggggttcagcgctggcgccgaccacaccgtgcggagattagcatttacttcgtcaaaggaggatgttctggggcgccatgatgctccagttcgctgtgtggagtactcttatgctgcaggacaagtcatcactggcagctgggataagacaattaaatgctgggatcccagaggagttagcggaccagagcgtacacttgttgggacatatgctcaaccagagcgtgtatattctatgtcattggtaggaaataggttggttgtcgcaacagcaggaagacatgtcagtatttatgatttgcgcaatatgtctcaacctgagcaaaaaagggaatcctctttgaaatatcaaacacgctgtgtccgatgtttccccaacggaacagggtatgctctaagttctgtcgaaggacgggtgtctatggagttcttcgacctttccgagtctgcacaatctaaaaagtatgctttcaagtgtcaccggaaatctgagtctggcagggacactgtttatcctgttaatgccattgcattccatccaatatacggcacatttgccactggaggccatgatggatttgtgaatgtgtgggatggtacaaacaagaagagattgtaccagtactcaaagtacgtgtcaagcattgctgctctgtcgttcagtaaggatgggcatctgcttgctgtggcatcaagctatggttacgaagagggagagaaaccccacgagcctgatttgatatttattcgaggggtgaatgaagtggaggttaagccgaagcccaaggcattggccgcaccccagtagtactgcaatcatttcgcaataaggtagtcagacgtatcaggtgtgttgtctgggagaagacattatgcagagagcaagtgcgaggcgtttctttatctagttcactttttagtgtcaattgcattagttgacggaatcgcttctctatgttggagtcaagtgacagtatccatatctgaccacttctctgtgctgtttcgcatgtaatgtctagaaagagctgcttaggagtggtcatattccagctcgttgtatattttgatacagaaattgtcgcacttatatttagcttataatcgatttagttttgca

SEQ ID NO: 869 - DNA, 1622 bp, Secale cereale
tcgctccgccgttctggattcaaatttcgaatccccccaccttcgcccccctgaaccaaactacccgacccgattccttttcctcccccttcccaccatgagtgacgcacccggcgcagcagcctcagctatgggcagtggcagggagctcgccaacccgccgtcggacggcatctccaaccttcgcttctccaaccacagcgaccacctcctcgtttcctcctgggacaagacggttcggctatacgacgccgaggcgaacgtgctcaaaggggagttcgcgcatcccgggcctgtgctcgactgctgcttccacgacgactcctccgggtttagcgctggggccgaccacaccgtgcggagattatcatttacgtcgtcaaaggaagatgttctggggcgtcatgatgctccagttcgctgtgtggagtactcttatgctgcaggccaagtcataactggcagctgggacaagacaattaaatgctgggatcccagaggagttagcggaccagagcgtacacttgttgggacatatgctcaaccagagcgtgtatattctatgtcactggtaggaaataggttggttgttgcaacagcaggaagacatgtcagtatttatgatttgcgcaatatgtctcaacctgagcaaaaaagggaatcctctttgaaatatcaaacacgctgtgtccgatgtttccccaacggaacagggtatgctctaagttctgtcgaaggacgagtgtctatggagttcttcgacctttccgagtctgcacaatctaaaaagtatgctttcaagtgtcaccggaaatctgagtctggcagggacactgtttatcctgtcaatgccattgcattccatccaatatacggcacctttgccactggaggccatgatggatttgtgaacgtgtgggatggcacaaacaagaagagattgtatcagtattcaaagtacgcgtcaagcattgctgctctgtcgttcagcaaggatgggcatctgcttgctgtggcatcaagctatggttacgaagagggagagaaaccccacgagcctgatgcaatatttatccgtggggtgaatgaagtggaggttaagccgaagcccaaggcattggccgcaccccagtagtactgcaatcattccgcaagaaggtagccaaacgtatcaggtgtgttgtctgggagaagacattatgcagagagcaaatgcgaggcgtttctttatctagttctctttttagtgtcaattgcattagttgacggagtcccttctctatgttggagtcaaatggcagtatccatatctgaccatttccctgtgttgtttcacatgtactaatgtctagaaagaactgcttaagaggtcatattccagctcgttttatattttgttacagaaattgttgcacttgtatttagcttatcatcgatttagttttgcaattttagcttattatagtatatgattaaaaaaaggtcaaatctgtcgcacttgtgggcaggtgctaatttgaccggacgtatgcacaaaatttgaacttatcggttgttggagcaagtataataagatgatgatgtgtgctatagtacttgccacatcagatttgtgccaaaaa

SEQ ID NO: 870 - DNA, 1553 bp, Triticum aestivum
cgcgccgccctcccgttctcctcgctccgcccgttctggattcaaatttcgaatccccccaccgtttccgcccccctgcaccaaatacccgacccgattccttttcctcccccctcccaccatgagcgacgcacccggcgcagcagcctcagctatgggcagcggcagggagctcgccaacccgccgtcggacggcatctccaacctccgcttctccaaccacagcgaccacctcctcgtttcctcctgggacaagacggttcggctgtacgacgccgaggcgaacctgctcaaaggggagttcgcgcaccccgggcctgtgctcgactgctgcttccacgacgactcctccgggtttagcgctggcgccgaccacaccgtgcggagattatcatttacttcgtcaaaggaggatgttctggggcgtcatgatgctccagttcgctgtgtggagtactcttatgctgcaggacaagtcataactggcagctgggacaagacaattaaatgctgggatcccagaggagttagcggaccagagcgtacacttgttgggacatatgctcaaccagagcgtgtatattctatgtcactggtaggaaataggttggttgttgcaacagcaggaagacatgtcagtatttatgatttgcgcaatatgtctcaacctgagcaaaaaagggaatcctctttgaaatatcaaacacgctgcgtccgatgtttccccaacggaacagggtatgctctaagttctgtcgaaggacgagtgtctatggagttcttcgacctgtctgagtctgcacaatctaaaaagtatgctttcaagtgtcaccggaaatctgagtctggcagggacactgtttatcctgtcaatgccattgcattccatccaatatacggcacatttgccactggaggccatgatggatttgtgaatgtgtgggatggcacaaacaagaagagattgtatcagtactcaaagtacgcgtcaagcattgctgctctgtcgttcagcaaggatgggcatctgcttgctgtggcatcaagctatggttacgaagagggagagaaaccccacgagcctgatgcaatatttatccgtggggtgaatgaagtggaggttaagccgaagcccaaggcattggccgcaccccagtagtgctgcaatcatttcgcaagaaggtagtcaaatgcatcaggtgtgttgtctgggacaagacattatgcagagagcaaatgcgaggcgtttctttatctagttctctttttagtgtcaattgcattagttgacggaatcccttctctatgttggagtcaaatggcagtatatctgaccatttctctgtgttgtttcgcatgtattaatgtctagaaagagttgcttgggagtggtcgtattcgttttgtattttgatacagaaactgttgcttttttatttagcttatgtatagtcgatttagtcttgcaactttagtatatactatatcataaaagaggctaaatctgtcgcacttgtgggcggtacgaacaaaattgaactaatcagtgtgag

SEQ ID NO: 871 - DNA, 1586 bp, Triticum aestivum
cccctcccaccatgagtgacgcacccggcgcagcagcctcagctatgggcagcggcagggagctcgccaacccgccgtcggacggcatctccaacctccgcttctccaaccacagcgaccacctcctcgtttcctcctgggacaagacggttcggctgtacgacgccgaggcgaacctgctcaaaggggagttcgcgcaccccgggcctgtgctcgactgctgcttccacgacgactcctccgggtttagcgctggcgccgaccacaccgtgcggagattatcatttacttcgtcaaaggaggatgttctggggcgtcatgatgctccagttcgctgtgtggagtactcttatgctgcaggacaagtcataactggcagctgggacaagacaattaaatgctgggatcccagaggagttagcggaccagagcgtacacttgttgggacatatgctcaaccagagcgtgtatattctatgtcactggtaggaaataggttggttgttgcaacagcaggaagacatgtcagtatttatgatttgcgcaatatgtctcaacctgagcaaaaaagggaatcatctttgaaatatcaaacacgctgcgtccgatgtttccccaacggaacagggtatgctctaagttctgtcgaaggacgagtgtctatggagttcttcgacctgtctgagtctgcacaatctaaaaagtatgctttcaagtgtcaccggaaatctgagtctggcagggacactgtttatcctgtcaatgccattgcattccatccaatatacggcacatttgccactggaggccatgatggatttgtgaatgtgtgggatggcacaaacaagaagagattgtatcagtactcaaagtacgcgtcaagcattgctgctctgtcgttcagcaaggatgggcatctgcttgctgtggcatcaagctatggttacgaagagggagagaaaccccacgagcctgatgcaatatttatccgtggggtgaatgaagtggaggttaagccgaagcccaaggcattggccgcaccccagtagtgctgcaatcatttcgcaagaaggtagtcaaatgcatcaggtgtgttgtctgggacaagacattatgcagagagcaaatgcgaggcgtttctttatctagttctctttttagtgtcaattgcattagttgacggaatcccttctctatgttggagtcaaatggcagtatatctgaccatttctctgtgttgtttcgcatgtattaatgtctagaaagagttgcttgggagtggtcgtattcgttttgtattttgatacagaaactgttgcttttttatttagcttatgtatagtcgatttagtcttgcaactttagtatatactatatcataaaagaggctaaatctgtcgcacttgtgggcggtacgaacaaaatttgaactaatcagttgttggagcaagtataataaaatgatgtaagcgagctataggagttgccacaacagatttgtgttaagtagagagggagaagaaagaagataaggatgctgtaatttatagtcatgacatggcatagacttcaacaagctctgtaag

SEQ ID NO: 872 - DNA, 1652 bp, Brachypodium distachyon
aaaaacccgtccgttgaccagctatccagttgcgctcaaaaaaaaaaaagctatccaggtagacccagatccaggagaagatttcgaattctgctttcattcgtttttaaaccttctgctcaccgtcccctcctcctctgccaccgccctcgccttcttctccttgctccgagcctccgaccatcgcggggttcaaatttcgaatccctcccagcacacccaccctctccgcaggacgcaccaaaccctaaccggatttctcctccttctcgctcccaccatgagtgacgcctccgccgcaccagcagccgctatgggcagcggcagggagctcgcgaaccctccagccgacggcatctccaatctccgcttctccaaccacagcgaccacctcctcgtctcctcctgggacaagacggttcggctatacgatgccgatgcaaacgtgctcaagggagaattcgcgcaccccgggcccgtgctcgactgctgcttccacgacgactcctcggggtttagtgctggcgccgaccatacagtgcggagattagtatttacttcgtcaaaagaggatgttcttgggcggcatgatggtcctgtttgctgtgtggagtactcttatgctgcaggacaagtcatcacaggtagctgggacaagacaattaaatgctgggatcctagaggagtgagtggaccagagcgtacacttgtagggacatatgctcaaccagagcgtgtctattctatgtcattggtaggaaataggttggttgttgcaactgcaggaaggcatgtcaatatttatgatttgcgcaatatgtcacaacctgaacaaaaaagggattcgtctttgaaataccaaacacgctgtgttcgatgttttcctaacggaacagggtatgctttaagttctgtcgaaggacgagtttctatggaattctttgacctttcagagtctgcacaatctaaaaagtatgctttcaagtgtcatcggaaatccgagtctggcagggacaccgtttatcctgtcaatgctattgcattccatccaatatatggcacctttgccactggagggtgtgatggatatgtaaatgtatgggatggcactaacaagaaaagactatatcagtactcgaagtacgcatcaagcatcgcggctctgtcattcagcaaggatgggcatatgctcgctgtggcatcaagctacacttacgaagagggagagaaatcccatgagcctgatgcaatatttatccgaggggtgaatgaagttgaggtaaagccgaagcccaaggcattgaccgcacccaagtagtgctgcaatcagtttgcaacggggcaggtgtttttgctgggagaaaagacataatgcagaaagttaggcgagacgtttctttctctaggttacttcgtaatgtcaatcatgttgacggaatccctttatgttgacctgaaatgtcactatccatagctcactacctttctctatggtgtatctaccatgtaatgtctacaaagagctgttttaagtgtcgtattcccgttcattctatgtttcaattggatctatgtcattataattttcaccggttggagacatgccattacaataacttgacttcgagaaataccactctaacttttttata

SEQ ID NO: 873 - DNA, 1574 bp, Panicum virgatum
tctcggctctctctgcctcccactccgctctctgcaccgccgttcaaaattcgaatccagaattccccaagcttttcttaaatcgtccgctccccatcgacctccccctcgtgctcgcctcgcccgttgcgcgttcaaatttcgaatccctcctcctccggcgcccaagccctagctcgattcctcctcctcctcctcctcggccgcctgccatcatgagcgccgccgccgccgcgccagccgctatgggcagcggcaaggagctcgccaacccgccctccgacgggatctccaacctccgcttctccaaccacagcaacaacctcctcgtgtcctcgtgggacaagacggtgcggctgtatgacgctgacgccaacgtgctcaagggggagttcgtgcaccccgggcccgtcctcgactgctgcttccacgacgactcctcgggcttcagcgctggagccgaccacaccgtgaggaggctagtatttagttcatccaaagaagatgttctggggcgacacgatggtccagttcgttgtgtggaatactcttatgctgcaggacaagtcatcacaggcagctgggataaaactgttaaatgttgggatccaagaggagtgagtggaccagagcgtacacttgttgggacatatactcaaccagaacgtgtatattctctgtcgttagtaggaaataggttggttgttgcaactgcagggaggcatgtcaatatttatgatttgcgcaatatgtctcaacctgagcaaaagagagactcgtctttgaaatatcaaacacgatgcgttcgatgtttcccaaacggaacaggatatgctctaagttctgtcgaagggcgagtttctatggaattctttgatctatctgagtccgcacagtctaaaaagtatgctttcaagtgtcatcggaaatctgaagctgggagggacagtgtttatcctgttaatgcaattgccttccatccaatatatggaacatttgccactggaggttgtgatggatttgtgaatgtgtgggatggcattaacaagaaaagactatatcagtactcaaagtacgcatcaagcattgctgctctttcattcagtaaggatggccatcttcttgctgtggcatccagctacacttacgaagagggggaaaaatcgcatgagcctgatgcaatattcatcaggacagtgaatgaagttgaggtaaaaccgaagcccaaggcattggccgctccccagtagtactgtaatcagttggtggacagtatcagtcagatggctagatgatccttacttctcttgatgtcaattatgttagttgacgcagagcttgattacgttgaggtgaaatgttagtaaatccatctatttctgaattgtgtccgtgaaacatttcatgttccagctgattgtataattcgatagagattatgttttagtttattttgattctatgttgagttagaacttatttgtttctccattttagtaagtttggaactctggaggtggaggaaaataaaatactggcatgtagcatctatgtcaatttagtgttagtttggc

SEQ ID NO: 874 - DNA, 1870 bp, Panicum virgatum
cgccgagcgaacgggtggcaagcacgccgtggaatcttccggcctcgtctgactgttcgagtcgtctccctcctctctcggctctctctgcctcccactccgctctctccaccgccgttcaaaattcgaatccagaattccccaagcttttcttaaatcgtccgttccccatcgacctccccctcgtgctcgcctcgcccgttgcgcgttcaaatttcgaatccctcctcctccggcgcccaagccctagctcgattcctcctcctcctcctcctcggccgcctgccatcatgagcgccgccgccgcgccagccgctatgggcagcggcaaggagctcgccaacccgccctccgacgggatctccaacctcctcttctccaaccacagcaacaacctcctcgtgtcctcgtgggacaagacggtgcggctgtatgacgctgacgccaacgtgctcaagggggagttcgtgcaccccgggcccgtcctcgactgctgcttccacgacgactcctcgggcttcagcgctggagccgaccacaccgtgaggaggctagtatttagttcatccaaagaagatgttctggggcgacacgatggtccagttcgttgtgtggaatactcttatgctgcaggacaagtcatcacaggcagctgggataaaactgttaaatgttgggatccaagaggagtgagtggaccagagcgtacacttgttgggacatatactcaaccagaacgtgtatattctctgtcattagtaggaaataggttggttgttgcaactgcagggaggcatgtcaatatttatgatttgcgcaatatgtctcaacctgagcaaaagagagactcgtctttgaaatatcaaacacgatgcgttcgatgtttcccaaacggaacaggatatgctctaagttctgtcgaagggcgagtttctatggaattctttgatctatctgagtccgcacagtctaaaaagtatgctttcaagtgtcatcggaaatctgaagctgggagggacagtgtttatcctgttaatgcaattgccttccatccaatatatggaacatttgccactggaggttgtgatggatttgtgaatgtgtgggatggcattaacaagaaaagactatatcagtactcaaagtacgcatcaagcattgctgctctttcattcagtaaggatggccatcttcttgctgtggcatccagctacacttacgaagagggggaaaaatcgcatgagcctgatgcaatattcatcaggacagtgaatgaagttgaggtaaaaccgaagcccaaggcattggccgctccccagtagtactgtaatcagttgttggacagtatcagtcagatggctagatgatccttacttctcttgatgtcaattatgttagttgacgcagagcttgattacgttgaggtgaaatgttagtaaatccatctatttctgaattgtgtccgtggaaacatttcatgttccagctgattgtataattcgatagagattatgttttagtttattttgattctatgttgagttagaacttatttgtttctccattttagtaagtttggaactctggaggtggaggaaaataaaatactggcatgtagcatctatgtcaatttagtgttagtttggctatgtatgttctgagttgagtgtttggtagctgctaattctgttgtaacgatgcccactgggtgcaggcaaatggctagttaggttcactaggatatgcctaatttcatactctacgtttatttttatggggcatattgggatttgaaagagtcaaccttcatatattttgacattaatttgaatcatctctaaagatctaaaataggtgaatttcttaagcc

SEQ ID NO: 875 - DNA, 1848 bp, Zea mays
taccatagttttgaaaacatacttttttaaaaatacaatcaaacactttataacatttatgatgatattactaaaagtcttggtactacaaaaatattttatttccacaggctctcagtagttaactcagcaatggcgccgatctaacgggaagagaggcacgtcccacgccgcggaatcttctcgcctcgcctcgtctcctctgttctccagttctctcatagtcactcccccaactctgctgcttcccgtggccgtggttcaaaattcgaatccagaaagacttccccaagcattttccgtttctttaaaccgtcatcgtcctccctcgtgctagcctcgctcgttgcgcgttcaaatttcgaaccacctccgccttcgacgccccaaaccctagcccgacccctcctcctccacctgcgccaccgcccaccatgagctccgccgccgcgccagctgccgtcggcagcggcaaggagcttgccaacccgcccgccgacggaatcaccaacctccgcttctccaaccacagcaacaacctcctcgtctcctcatgggacaagacggtgcggctctacgacgccgacgccaacgtgctcaagggggagttcatgcaccccggggccgtcctcgactgctgcttccacgacgactcctcgggctttagcgccggtgccgaccacaccgtgcggaggttggtatttagctcgtccaaggaagatgttttggggcggcatgatggtccggttcgttgcgtggaatactcttatgctgcaggtcaagtcatcaccggcagctgggataaaactgtaaaatgctgggatccaagaggagttagtggaccagagcgcacccttgttgggacatatgctcaacctgaacgtgtatattctctttcgttagtaggaaataggttggttgttgcaacagctggaagacatgtaaatatttatgatctgcgcaatatgtctcaacctgagcaaaaaagagactcttctttgaaatatcaaacacgatgtgttcgatgttttcccaacggaacaggatatgctcttagttctgttgaagggcgagtttctatggaattctttgatctatctgagtctgctcaatctaaaaagtatgctttcaagtgtcatcggaagtctgaggccggcagggacaccgtttatcctgtcaatgcaattgctttccatcccatatatggaacatttgccaccggagggtgtgatggatttgtgaatgtgtgggatggcattaacaagaaaagactatatcagtactcgaagtacgcatcaagcatcgctgctctatcattcagtaaggatgggcatctgcttgctgtggcatccagctacacttatgaagagggagaaaaaacgcatgaacctgacgctatatttatccggacagtgaatgaagtcgaggtgaagccgaagcccaaggcattggcagccccccagtagtgctgtgacctgttctggaggctagatgacccgtacttctctgcgttgatgtcaattacattagttgacggagtgcttgtttgtgttgaaagagctgaaacgcctgtgtttcttaatctggaaccctcttctcccgttttacttgtccgtggaaacatttcatgttccagctggttgtatattccgaaacagaccatgtttaagttcactcggttcttcgttgacttaagttatttatcaaatatttaagtatcgtacgtaagtttgaaacctggggggaagaactatgctggctttgttgtactgccaatttcaatttaggaaggatgaaattgaagtttggacttgtgccgcataggcaaatggcccgttaactgttgcg

SEQ ID NO: 876 - DNA, 1946 bp, Oryza sativa
agatcaaacattactcatcctggtactaaccagtgcaacgcaggtgtatttttctagtctaaaaaaaaactggtcaactcggcccatgccgagacaacggaccaatcctatcgtaccgtcggtctcaccctctctccgcttcctttccggttctcaaaaccttcggctccccgtcgtcctcctcatcctcctcactctgcccgttgcaaattcaaatttggattccccttcctccccacacgctcccctcctcctgccgagccgaaaccctaacgatccaattcctcctccctttgggcctcccaccatgagcgccgccgccgccccagcagccgccgtcggcagcggcaaggagctcgccaacccgccgacggacgggatctccaacctccggttctccaaccacagtgaccacctcctcgtctcctcctgggacaagacggtgcgcctctacgacgccgacgcgaacgtgctcaagggtgagttcgtacacgccggggccgtgctcgactgctgcttccacgacgactcctccgggtttagcgccggcgccgaccacaccgtgcgtaggttagtatttggttcagcaaaagaggatcttttaggacggcatgatgctcctgttcgctgcgtggagtactcttatgctgcaggtcaagtcatcactggcagctgggataagactatcaagtgttgggatccaagaggtgtaagtggaccagagcgtacgcttgttgggacatatgctcaacctgagcgtgtatattctctgtcgttagtggggaataggttggttgttgcaacagcaggaagacatgtcaatatttatgatctgcgtaatatgtctcaacatgagcaaaaaagggactcttctttgaaatatcaaacacgttgtgttcgatgtttccccaatggaacaggatatgccctaagttctgttgaaggacgagtttctatggaattctttgatctatctgagtctgctcaatctaaaaagtatgctttcaagtgtcatcggaaatcagaagctggccgggacaccgtttatcctgtcaatgcaattgcattccatccaatatatggtacatttgccactggtgggtgtgacggatttgtgaatgtatgggatggcattaacaagaaaagactatatcagtattcaaagtatgcgtcaagcatagctgctttgtcatttagtaaggatgggcacctgctcgctgtggcatccagctacacttatgaagagggagaaaaatcccatgaacctgatgcaatatttatccggtcagtgaatgaagtggaagtaaagccgaagcctaaggcactggcagcaccttagaagtgttttagttgtctcacgacaggggtaatcgtgtggtttgatgtgtatggtgagagtaaagcgtcattcaaattagtatttttgtatcctcgcaagaaaaaaagtatttatgtcggacactccatttccctagttctcttaagttcatgtcaaccacatctgttgacgaaattccttgtttatgttgaagggatggtcagcatctaactctgttgcctctgcctgttcatttcgcttggaacctctagaaatatttgcttaaatgttgatgtattccatattattgtatattatggtaccatgttcatttattctgttttaagttttggaactgggatcttatatcagtcgtcttgttgaacctgtctctggatagaagcactatgtagttatatgtaaacaccacaagttccaagctggactactaagttgccgttttctcgtttgatgtagaagacactccaagtctccaactgccctacatttttgaattcgttaaaaagattgaagcatggttcaagtacatttcttgcttctgaacctggtggagtcacatttgatcttggtttttgaaactcccttaggccttgtttgtttacacggg

SEQ ID NO: 877 - DNA, 1761 bp, Sorghum bicolor
caatccgatctaacgtggggaggcacgcccacgccgtggcagtggaagtggaaccttctcgcctccatcctcctctccccatcccagcagccactccccactccgcttcccgtggccgtggttcaaatttcgaatccagaaagatagatttccccaagcatttccggttctgtttctcccctttctttaaaccgtccaatcgtcctcccctcgtgctcgcctcgctcgttgcgcgttcaaatttcaaaccccctcctccgcctcctacgccccgaaccctagtcctcctcctcccctgcccccgccgcgcaccatgagctccgccgccgcgccagctgccgtcggcagcggcaaggagcttgcgaacccgccggccgacgggatctccaacctccgcttctccaaccacagcaacaacctcctcgtctcctcatgggacaagacggtgcggctctacgacgccgacgccaacgtgctcaagggggagttcgtgcaccccggggccgtcctcgactgctgcttccacgacgactcctcggggtttagcgccggagccgaccacaccgtgcggaggttggtatttagctcgaacaaggaagatgttttggggcggcatgatggtccggttcgttgcgtggaatactcttacgctgcaggtcaagtcatcactggcagctgggataaaactgtaaaatgctgggatccaagaggagtgagtggaccagagcgtacccttgttgggacatatgctcaacctgaacgtgtatattctctttcattagtaggaaacaggttggttgttgcaacagcaggaaggcatgtaaatatttatgacctgcgcaatatgtctcaacctgagcaaaaaagagactcttctttgaaataccaaacacgatgtgttcgatgtttccccaacggaactggatatgctctaagttctgttgaagggcgagtttccatggaattctttgatctatccgagtctgctcagtctaaaaagtatgctttcaagtgtcaccggaaatctgaagctggcagggacaccgtttatcctgtcaatgcaattgctttccatcccatatatggaacatttgccactggagggtgtgatggatttgtgaatgtgtgggatggcattaacaagaaaaggctatatcagtactcgaagtacgcatcaagcattgctgctctatcattcagtaaggatggccatctgcttgctgtggcatccagctacacctatgaagagggagaaaaaacgcatgaacctgacgctatatttatccggacagtgaatgaagtcgaggtgaagccgaagcccaaggcattggctgccccccagtagtgttgtgacttggtggcggtatcagtcacatggttagatgacccgtacttctctaagagtctaaagttgatgtcaattgcattagttgacgcagagcttgtttgtgtggaaagaagtgaaacgtctgtttcttaatctggtccttcatctttcgttttagttgtccgtggaaacatatcatgttccagctgattgtatattctgagacagattatgttttagtttattcgattcttcgttgaccttatttatcaaatatttaagtaatcgtaagcttggaacctggagggaagaactatgctggaggggagtatttgtaattcctggctttgttgtaacgatgcctatttattaggagttgaagtttggaaagtggagggaaggacttgtaccgcgcaggcaaacggccagttaac

SEQ ID NO: 878 - DNA, 1378 bp, Cenchrus ciliaris
  misc_feature (20)..(20): n is a, c, g, or t
  misc_feature (321)..(321): n is a, c, g, or t
ccgctcccccaacgacctcnctcgtgctcgcctcgcccgttgcgcgttcgaatttcggatccctcctcctccgtcgcccaagccctagcccagtccatcctcctcctcctcgaccgcatgagcgccgccgccgcgccagccgccatgggcagcggcaaggagctcgcgaacccgcccgccgacgggatctccaacctccgcttctccaaccacaccaacaacctcctcgtctcctcgtgggacaagacggtgcgtctctacgacgccgacgccaacgtgctcaagggggagttcgtccaccccgggcccgtcctcgactgntgcttccacgacgactcctcagggttcagcgccggagccgaccacactgttcggaggttagtatttggttccgccaaagaagatgttctgggtcgtcatgacggcccagttcgttgtgtggagtacgcttatgctgcaggccaagtcatcactggcagttgggataaaactgttaaatgctgggatccaagaggagtgagcggacctgagcgtactcttgttgggacatatactcaacctgaacgtgtatattcactgtcattagttggaaataggttggtggttgcaacagcaggaaggcatgtcaatatttatgatttgcgcaatatgtctcaacctgaacaaaaaagagactcgtctttgaaatatcaaacaagatgtgttcgatgtttccccaacggaacaggatacgctctaagttctgtagaagggcgagtttctatggaattctttgatctatctgagtctgcgcaatctaaaaagtatgctttcaagtgtcaccggaaatctgaggctgggagggacactgtttatcctgttaatgcaattgccttccatccaatatatggaacatttgccactggaggttgtgatggatttgtgaatgtgtgggatggcattaacaagaaaagactatatcagtactcaaagtacgcatcgagcattgctgctctttcattcagtaaggatggccacctgcttgctgtggcgtccagctacacttatgaagacggagaaaaatcgcatgagccagatgcaatatttatcaggacagtgaatgaagttgaggtgaaaccgaagcccaaggcattggcggctccccagtagtattgtgatcagttggtggcagtaccagtcggatgggtagatgatccttactcctcttgatgctgggtcaagatgcagtttcacgggtggaacttatcgtagtctatctactgctgaattgtgtccgtggaaacgtttcatgttccagctgattgtatatttcgctacggattatgtttctgtttatgttgatcctttattgacttaaaaaagggggggcccggtaccc

SEQ ID NO: 879 - DNA, 1440 bp, Saccharum officinarum
agcatttccgtttctttaacaaaccgtccgctgcccatccatcgtcctccctcagtccctcgtgtgctcgcctcgctcgttgcgcgttcaaatttcgaaccccctcctccgcctcctacgccccaaaccctagtccgatccctcctcctcctctgccaccgccgaccatgagctccgccgccgcgccagctgccgtcggcagcggcaaggagcttgccaacccgcctgccgacgggatctccaacctccgtttctccaaccacagcaacaacctcctcgtctcctcatgggacaagacggtgcggctctacgacgccgacgccaacgtgctcaagggggagttcgtgcaccccggggccgtcctcgactgctgtttccacgacgactcctcggggtttagcgccggagccgaccacaccgtgcggaggttggtatttagctcgtccaaggaagatgttttggggcggcatgatggtccggttcgttgcgtggaatactcttatgctgcgggtcaagtcatcactggcagctgggataaaactgtaaaatgctgggatccgagaggagtgagtggaccagagcatacccttgttgggacatatgctcaacctgaacgtgtatattctctttcattagtaggaaacaggttggttgttgcaacagcaggaaggcatgtaaatatttatgatctgcgcaatatgtctcaacctgagcaaaaaagagattcttctttgaaatatcagacacgatgcgttcgatgttaccccaacggaacaggatatgctctaagttctgttgaagggcgagtttccatggaattctttgatctatccgagtctgctcagtctaaaaagtatgctttcaagtgtcaccggaaatctgaagctggcagggacaccgtatatcctgtcaatgcaattgctttccatcccatatatggaacatttgccaccggagggtgcgatggatttgtgaatgtgtgggatggcattaacaagaaaagactataccagtactcaaagtacgcatcaagcatcgctgctctgtcattcagtaaggatggccatctgcttgctgtggcatccagctacacttacgaagagggagaaaaaacgcatgagcctgacgcaatatttatccggacagtgaatgaagtcgaggtgaagccaaagcccaaggcattagccgcccccccagtagtgttgtgatctgttggcggcggtatcagtcatgtggttagatgacccgtacttctcttaagttgatgtcaattgcattagttgatgcagtgcttgtttgtgttgaaagaagtgaaacgcctgtttcttaatctgggtcctcttcttccgttttacttgtcctcggaaacatttaatgttccagctgattgtatatttcgagagagatttagtctatttgatttgcattatcttaagaact

SEQ ID NO: 880 - DNA, 1513 bp, Pennisetum glaucum
ctctgttctctctgtctctctcctccactctgctcaaccccgtagttcaaaattcgaatccagagctccccgagcttttctttaaaccgtccgctcccctcccccaacgacctccctcgtgttcgcctcgcccgttgcgcgttggattttcgaatccctcctcctccgtcgcccaaagccctagcccaatccatcctcctcctcctcctcgaccacctgccgccatgtgcgctgccgccgcgccagccgccatgggcagcggcaaggagctcgcgaacccgcccgccgacgggatctccaacctccgcttctccaatcacagtaacaacctcctcgtctcctcgtgggacaagacggtgcggctctacgacgcggacgccaacttgctcaagggggagttcgtccaccccgggcccgtcctcgactgctgcttccatgacgactcctcagggttcagcgccggagccgaccacactgtgcggaggctagtattcggttcagccaaagaagatgttctgggtcgtcatgatggcccagttcgttgtgtggaatactcttatgctgcaggccaagtcatcactggcagctgggataaaactgttaaatgctgggatccaagaggagttagcgggcctgaccgcactcttgttgggacatatactcaaccagaacgtgtatattccctgtcattagtaggaaataggttggttgttgcaactgcaggaaggcatgtcaatatttatgatttgcgcaatatgtcccaacctgagcaaaaaagagactcgtctttgaaatatcaaacaaggtgtgtgcgatgtttccccaatggaacaggatatgctctaagttctgtagaagggcgagtttctatggaattctttgatctatctgagtctgcacaatctaaaaagtatgctttcaagtgccaccggaaatctgaggctgggagggacactgtttatcctgttaatgcaatttccttccatccgatatatggaacatttgccactggaggttgcgatggatttgtgaatgtgtgggatggcactaacaagaaaagactatatcagtactcaaagtacgcgtcaagcattgctgctctttcattcagtaaggatggccacctgcttgctgtggcgtccagctacacttacgaagacggagaaaaatcgcatgagccagatgcaatatttatcaggacagtgaatgaagtcgaggtgaaaccgaagcccaaggcgttggccgctcctccccagtagtattgtgatcagttggtgacagtacaccggtgggatggttagatggtactcactctcttgatgtcaattacattagttgacgctgagcttcacgggtaaacctaccttattcggtctaccgctgaattgtgtccgtggaaacgtttcatgtcgttccactgttccagccgattgtatatttcgctacagattatgtttctgatcctttgttgacttattattcgtgccttgatttagtaagttttggaactctg

SEQ ID NO: 881 - DNA, 1606 bp, Setaria italica
tctctctctctctctctctctctctctctctctctctctgctcaaccccgtagttcaaaattcgaatccagagttccacaagcttttctttaaaccgtccgctcccccaacgacctccctcgtgcaagcctcgcccgttgcgcgttcgaatttcgaatccctcctcccccggcgcccaaggccctagcccaattcctcctcctcgtcgtcctcgaccacctgccgccatgagcgccgccgccgcgccagccgccatgggtagcggcaaggagctcgcgaacccgcccgccgacgggatctccaagctccgcttctccgaccacagcaacaacctcctcgtctcctcgtgagacatgggaaacggtgcggctctacgacgccgatgccaacgtgctcaagggggagttcgtccaccccggggccgtcctcgactgctgcttccacgacgactcctcagggttcagcgctggagccgaccacactgtgcggaggttagtatttagttcagccaaagaagatgtactgggtcgtcatgatggtccagttcgttgcgtggaatactcttatgctgcaggacaagtcatcactggcagctgggataaaactgttaaatgctgggatccaagaggagtgagtggacctgagcgtacacttgttgggacatatactcaaccagaacgtgtatattctctgtcattagtaggaaataggttggttgttgcaacggcaggaaggcatgtcaatatctatgatttgcgcaatatgtctcaacctgagcaaaagagagactcatctttgaaatatcaaacacgatgcgttcgatgtttccccaacggaacaggatatgctctaagttctgtagaagggcgagtttctatggagttctttgatctatctgagtctgcgcaatctaaaaagtatgctttcaagtgtcaccggaaatctgaggctgggagggacactgtttatcctgttaatgcaattgccttccatccgatatatggaacatttgccactggaggttgtgatggatttgtgaatgtgtgggatggcattaacaagaaaagactatatcagtactcaaagtacacttcaagcatcgctgctctttcattcagtaaggatggccatctgcttgctgtggcgtccagctacacttacgaagagggagaaaaatcgcatgagcctgatgcaatatttatcaggacagtgaatgaagtcgaggtaaaaccaaagcccaaggtattggccgctccccagtagtatattgtaatcagttggtgacagtatcagtcagatggttagatgatcctccccttgatgtcaattacattagttgacgctgagcttgactacgttgaggtgaaatgtatcttgatccatctactactgaattgtgtccgtggaaacgtttcatgttccagctgattgtatatttcgtagattatgttttagtttattttgattctttgttgacttatttgtgtcttaatttagttagtttggaactctggatgaaagaacagtcctggcatctgtcactgtagcgttaagtgcgactctgtatgctccgaattgagtatttgatgactgctgattctgtcgt

SEQ ID NO: 882 - DNA, 1384 bp, Phalaenopsis aphrodite
agaaatcattcaaattccagttttcaaacctctttccgcctccgctctctctctccttccttctccatttctctctctagaacccaaagcaggttcattcttgcttatcacaatcaccggaaaagaatctctaatctcttgcttccgctgccatgagcggagctcctccttccggcagtggtagagaactagccaaccctccctccgacggcatctcgaacctccgcttctcaaatcacagcgaccaccttctcgtttcatcctgggacaagagtgttcgtctctacgatgccagtgcgaatgtgctgaagggtgagttcatgcacggcggccccgttctcgactgctgcttccacgacgattcatctggtttcagtgccagtgcggactgtaccgttcggaggcatgtcttcagctctggcaaggaggatattttgggacgtcatgatgctccagtacgttgtgttgaatactcttatgcagcaggtcaagtgattaccggcagctgggacaaaacattgaaatgctgggatcccagaggtgcaagtgggccagaacacactcttgttggaacatacccacagccggaacgggtttactctctttctttagttggccatcgccttgtagtagcaactgcaggaagacatgtaaatgtctatgatttgcgaaatatgtctcaacctgaacaacggagagagtcatccttgaaatatcaaactagatgcgtccgatgctatcctaatgggacaggttttgctctcagctctgtggagggtagagttgctatggaattctttgacttgtctgaggcaagccaatctaagaagtatgcatttaagtgccatcgaaaatcagaggccggaagggacaccgtataccctgtgaatgctattgcattccatcccatatatggaacctttgccactggaggttgtgatggttatgtcaatgtttgggatggaaataacaagaagagactgtatcagtactcgaagtacccaagtagcattgcagctttatccttcagcaaagatggtcgcctgctggcagtcgcatccagttacacttttgaagagggagatatacctcatgaagaggatgcaatttttcttcggagtataaatgaagttgaagtcaagccaaagccaaaagcaatccctgctgcaacacccctataattaaacaattgaagaagaaaatgctactatcgggtaccatcccgctgttataactctgttagatcccacatggaaggaaaagcttcagacaagtactaaaacttccctctctcccttgccttccattctatcagctgttgctatgttagtgctcacagcaatggattgaatcttattttggagaaagcattttgcttaattgc

SEQ ID NO: 883 - DNA, 1554 bp, Prunus mume
gtagcaactctgttatgttgggcttgcaaaaatgagcccaagcttgttgaaacaagcaaatcgtcccctcattttgaatttgaaagaacctctggtctggatcacaaaatcaccttcgtctctctcttgttttcttccatttttcaaaccgccttccctctttcttttctctctcatcacactctccatctccaacgacactatcaactcttcaaaattcaaaaaccctaaaacacacacactctctctctccgtccaattccgccatgacagctgtccctccgccggcgccgggccgcgagctctccagccccccctccgacggcatctctaacctccgcttctccaaccacagcgatcatttgcttgtctcttcatgggacaagaccgtccgattgtacgacgccagcgccaatgtgctgcgaggagagttcaagcacggcggtcccgtactcgattgctgcttccacgacgactcttccggcttcagcgccggcgccgacaacactgttagacggctcgttttcagctctagtaaggaagacatcctaggaaggcacgatgcaccagtgcggtgcgttgagtactcttatgcagcagggcagttgatcactggtagttgggataaaacactcaagtgttgggaccccagaggtgcaagcggacaggagcgtactcttgttgggacgtacccacaacccgaacgtgtttattctctttctcttgtcggaaatcggttggtggttgcaacagcaggaagacacgtcaatgtctatgatttgagaaatatgtcccagcctgagcaacggagggagtcttcgttgaagtatcaaactcgatgtgtgcgctgttatcctaatggaacaggttatgctcttagttctgtggaaggacgggttgcgatggagttttttgatctctcagaggctagtcagaccaaaaaatatgcattcaagtgtcacagaaaatcagaggctggaagggacattgtctatccagtaaatgcaattgcattccaccccatctatggcacttttgcgactggaggttgtgatggctatgtgaatgtatgggatgggaacaacaagaagaggctgtatcagtactcaaagtacccaacaagcattgcggcactttcttttagccgagatggccgcctattggctgtggcttcaagttatacatttgaagagggagataaaccccacgaaccagattccatctttgttcgaagtgtaaatgagatagaggtcaagccaaagccaaaagtgtaccctaatccaccagcataactgaaatttgttgaagaatcaaaagaggtggaaaaaaaagtgaaatcgtaggactttggcttttgttttagtcactctggctatatatatatttgtttaattcgatcctgtctggttccgttgtggcctgtgtatgagactttggccatcggaactctaaaatttcttctgctgtcagaaacgatgatgccctgtaacgcaattgttatgatttcatctacatgaaaaatgcctccagtccaatcagttcttttcttgcatc

SEQ ID NO: 884 - DNA, 1761 bp, Aristolochia fimbriata
gactgcctgcacttaccacctccgttgctatgtagcgttgcatgattcaaacttcaaacggcccactttagtgtcggagaggatctcatcgggacgatccacgaaattcaaaaacacagaccgccagagtctctcagaaggagtgtgtctgtctctcattctcggttctggaacttactgcggacggcaattgtcttctccctccgaaaaccctaagcttcgattcttggtttagagccatgactgcggttcatcctcccgcgccgggtagagagctcgcgaagcctccatcggatggtatctctaacctccggttctccaatcacagtgatcatctcctcgtttcgtcatgggataagagtgttcgactgtatgatgcgagtgcgaatgtgttgaggggcgagttcttgcacggaggtcctgtgctggactgctgtttccatgatgattcttccggtttcagcgctagtgcggatcataccgtgcggaggtatgttttcagttctggcaaggaggatattttggggaggcatgatgctcctgttcgttgtgttgagtattcttatgcagcaggacaagtgatcactggcagttgggacaaaacattgaaatgctgggatcctagaggagcgagtgggcaagaacgtacccttgttggtacttatccccaacctgagcgtgtttattctctgtcactggtgggcaatcgattagttgtagcaactgctggaaggcatgtgaatgtttatgatttacgtaacatgtcccaacctgaacaaagaagggagtcatctttgaagtaccaaactcgatgtgtccgttgttatcccaatggaacaggttttgctctcagttctgtggaaggtcgtgttgctatggagttctttgacttatctgaggctggtcaagcaaaaaagtacgcattcaagtgccatcggaaatcagaggctggaaaagatactgtctacccagtaaatgcaattgcattccacccaatctatggtacatttgctaccggtggatgtgatggatatgtaaatgtttgggatgggaacaataaaaagagattatatcagtactcaaagtacccaacaagcattgctgcattatccttcagcagagatgggcgtctattggctgtggcatccagttatacgtttgaagagggagataaacctcacgaacccgatgcaatctttgttcggagcgtgaatgaagtagaagtgaaaccaaagcccaaggtataccctaccccttcgtaagatttgaaatttccaggagctgctcttcggccaattgtagcagctatatcaggctcttccttgttaggatcttggtggtggtgctagcgaaagtgtaagtaatgctagtacttcatcaagcagagtgcaaacatgagacactgattagattttgtaaaagttgtaagttcctcaatgaacgggtcctgtattgaactctgacctgcttaatgagattctgacaaggttaaaatttctgtcttgctatttatgtgccacccaagtggttgaggattgtgatttagaaaatagagccacacatctgagaactgctatccgtatgttcttgtaaaaaccattcctcgactgacttcaagagagcagggtccccttcctcaaaatcgccataaaagggagcaagtagacctaccctgcaccctccatttctttcttgtgaaaatcaaacggatagccttcgctttaaagctgcctacgacaaattacactatttttctaaagt

SEQ ID NO: 885 - DNA, 1145 bp, Carica papaya
aaatctccttccctctctctctacttctctctctttcaaaaccctagcattttctctctgctcagacacaccatcgtctaccagtcacgcaatgacagctgtggcgcagccgccggcgtccgggcgcgagctctccaatccaccttccgacgggatctcgaacctacggttctcgaatcacagcgatcacctgctcgtttcttcgtgggataagactgtgagactgtacgacgcgagcgccaatgtgttgcgcggagagttcatgcacggcgggcccgtccttgattgctgctttcatgacgattcctccggcttcagtgcaagtgcagataatactgtcagacggctggttttcaacattggaaaagaggatgttttgggaagacatgaagcaccagttcgctgtgttgaatattcttatgcggcaggacaagtgatcacaggcagctgggacaaaacacttaaatgttgggaccctagaggagcaagtggacaagagcgcacgctggtaggcacatatccacaacctgaacgtgtctactcactatctcttgttggaaatcgtctagtagtggcaactgctggaagacatgtgaacatctatgacttgcgaaatatgtctcaacctgagcaacgaagggaatcttcattaaaatatcaaactagatgtgtgcgatgttaccctaatggaacaggatatgcacttagttccgttgaaggaagagtagcaatggagttttttgacctctcagaagttagtcaggccaaaaaatacgcattcaagtgccaccgaaaatcagaggctggacgggatattgtttatccagtaaatgccatagcattccatcctgtctatggtacatttgcgactggaggttgtgatggttttgtaaatgtttgggacggcaataacaagaaaaggttatatcagtactctaagtacccatcaagcattgcagcactttcgtttagcagagatggtcgtttgttggctgtgggatcaagttacacatttgaagagggggataaaccacacgaaccagattctatcttcatacgcagtgtaaacgaaattgaagtcaagccaaaacccaaagtctaccctaatcctccagtataattagaagaacaaaatcttcattctg

SEQ ID NO: 886 - DNA, 1312 bp, Prunus persica
ctctctctctctctctctctctccgtccaattccgccatgacagctgtccctccgccggcgccgggccgcgagctctccagccccccttccgacggcatctctaacctccgcttctccaaccacagcgatcatttgctcgtctcttcatgggacaagaccgtccgattgtacgacgccagcgccaatgtgctgcgaggagagttcaagcacggcggtcccgtactcgattgctgcttccacgacgactcttccggcttcagcgccggcgccgacaacactgttagacggctcgttttcagctctagtaaggaagacatcctaggaaggcacgatgcaccagtgcggtgcgttgagtactcttatgcagcagggcagttgatcactggtagttgggataagacactcaagtgttgggaccccagaggtgcaagcggacaggagcgtactcttgttgggacgtacccacaacccgaacgtgtttattctctttctcttgttggaaatcggttggtggttgcaacagcaggaagacacgtcaatgtctatgatttgagaaatatgtcccagcctgagcaacggagggaatcttcattgaagtatcaaactcgatgtgtgcgctgttatcctaatggaacaggttatgctcttagttctgttgaaggacgggttgcgatggagttttttgatctctcagaggctagtcagaccaaaaaatatgcattcaagtgtcacagaaaatcagaggctggaagggacattgtctatccagtaaatgcaattgcattccaccccatctatggcacttttgctactggaggttgtgatggctatgtgaatgtatgggatgggaacaacaagaagaggctgtatcagtactcaaagtacccaacaagcattgcggcactttcttttagccgagatggccgcctattggctgtggcttcaagttatacatttgaagagggagataaaccccacgaaccagattccatctttgttcgaagtgtaaatgagatagaggtcaagccaaagccaaaagtgtaccctaatccaccagcataactgaaatttgttgaagaatcaaaagagaagggaaaaaaaaagtgaaatttggcttttgttttaagttactctggctatatatatttgtttaagtcgatcctgcccagttccattgtggcctgtgtatgagactttggccaacggaactcaaatttcttctgctgtcagaaacgatgatgccctgtaacgcaattgttatgatttcatctacatgaaaaatgcctcagtccaagcagttattttcttgca

SEQ ID NO: 887 - DNA, 1399 bp, Sesamum indicum
cttctcttcctcttcctcttccttctcactgctatttttgaaatcctaatctgatctcgctgcactaaaaccctagtgacctaacacacaatctctacttgattatgacggcgccgccgccgcctccatccacggggagagagctctcgagccctcccacggacggcatttccaacctccgtttctccaaccatagtgaccacctcctcgtttcctcctgggacaagagtgttcgactgtacgacgcgagcgccaatgcgcttaggggagagtttatgcacggaggtccggtgctggattgttgctttcatgatgattcttcaggctttagtgcttgtgctgaccacactgtcagaaggctagtgttcaactacaatagggaagatgttttggggagacatgatgcacctgttcgttgtgttgaatactcatatggaacgggtcaagtcattactggtagttgggacaaaaccttaaagtgttgggaccccagaggtgcaagtggtcaggaacgttctcttgttggaacatatactcagcctgagcgtgtttattcaatgtctcttgttggcaatcggttggtggttgcaactgctggaagacatgttaatgtatatgatctacgaaacatgtctcaacctgaacagcgaagggaatcttctttgaagtatcaaacaagatgtgttcgatgttatcctaatgggacaggttatgctcttagttctgttgaaggacgtgtcgcaatggagttttttgatctctccgaggctggtcaatcgaaaaagtatgcatttaaatgtcatcgaaaatcagaagcaggaagagatattgtgtacccggtgaatgccattgcatttcaccctatatatggtacttttgccactggaggttgtgatggttatgttaacgtatgggatggaaacaacaagaagaggttgtatcagtataccaagtacccaacaagcatagcagctttgtcgtttagcagagatggtagattattggcagtcgcatcaagttatacatatgaagagggagataaagaccatgagccagatgccatatttgtgcgtagtgtaaatgaagtagaagtcaagccaaagccaaaagcgctgcccaatcctgctacatgaacattgcaaatttccagatcgttttgtaatatttctgaactatagattggttgttatcaaaatcatttttctcgttgattgctctgattcttgatgggggatggacttgagactttgtaatatgcttagaagttagaaatagaatattattacaatttacacataatgataggtgaaatagacagtaaccgttgccgacgccgtctaagtttataatcagttgcagaatgggacatattctgtctatttgcttgcaggtactgccg

SEQ ID NO: 888 - DNA, 1405 bp, Malus domestica
acctccggaacaaaaccaccaccgccgtttttctgtacattttcaaaccgcccttccctctctctttctctctcatcactccactctccatctcaacactctcaaaattcataaaccccaaaactcattccttctctctccatcacattactcgcacaccctccgaaccatcgcgccatgacagctgtgcctccgccggcgccaggccgagagctctccaacccccccaccgacggcatctccaacctccgcttctccaaccacagcgatcacctgctcgtctcctcttgggacaagacagtccgattgtacgacgccagcgccgatgtgctgcgtggagaattcatgcacggcggtcccgtactcgattgctgcttccacgacgattcctccgggttcagcgccggcgccgacaacaccgtcaggcggttcgtattcagctccagtaaggaggacatcttaggaaggcacgacgcgccagtgcgttgcatcgagtactcttatgcagcaggtcagttgatcactggtagttgggataaaacagtgaagtgttgggaccctagaggtgcaagtggacaggagcaaacccttgttgggtcatacccacaacccgagcgtgtttattctctttcacttgtaggaaaccggttagtggttgcaaccgccggaagacatgtcaatgtctatgatctgagaaatatgtcccagcctgagcaacggagggagtcttcattaaagtaccaaactcgatgtgtgcgttgttatcctaatggaacaggttatgctcttagttctgttgaaggacgggttgcaatggaattttttgatctttcggaggctagtcaaaccaaaaaatatgcatttaagtgtcatagaaaatcagaggctggaagggacattgtgtacccagtaaatgcaattgcattccaccccatctatggtacttttgctactggaggttgcgatggctatgtgaacgtatgggatgggaacaacaagaagaggctgtatcagtactccaagtacccaacaagcattgcggcgctttcttttagcagagatggccgcctattggctgtggcatcaagttacacgtatgaagagggggataaaccccacgagccagatgccatcttcgttcgaagcgtaaatgagatagaggtcaagccaaagccaaaagcgtaccctaatccgccagcgtaaatgaagtaaagtattttgcctttcgtattagttactccggatatgtttgtttaatttgacgatgtaaggctccaaaatatgtaaagaggccatgtgtaccagtcttcggccatcttccgaaacttcttccgctgttagaaacgatgatgctttgtaacgcacttgttatgatttcatcttacatagaatgcctcctttccaa

SEQ ID NO: 889 - DNA, 1326 bp, Manihot esculenta
ctttcgcaatcgatcccgacatgacagctgtcgtccctccgccgggctccggccgcgagctctccagcccaccttccgacggaatatccaacctccgcttctctaatcacagcgaccatctcctcgtctcctcttgggacaagagtgtgagattgtatgatgcgagtgctaatgcgttgcgaggagagtttatgcatgggggaccagtgcttgattgctgcttccatgatgactcctctgggtttagcgctagtgccgataatactgtgcgacggctggtttttagctatggtaaggaggatattttgggaaggcatgatgcacctgttcgctgtattgagtattcatatgcagcagggcaagtcatcactggtagttgggacaaaacactgaaatgttgggatcccagaggagcaagtggacaggagcgcactctcgttggcacatatccacaacctgagcgtgtttattctttatctcttgttggcaatcgtttagtagtagctactgcaggaagacatgtaaatatttatgatttgcgaaatatgtctcaacctgagcaacgaagggaatcttcactgaaatatcaaactcgatgtgtgcgttgttatcccaatggtacaggatatgctcttagttcagttgaagggagggttgcaatggagttttttgatctttcagaggctagtcaagcaaaaaaatatgcattcaaatgtcatcgaaaatcagaggctggaagggacattgtctatcctgtaaatgctattgcatttcatcctgtttatggtacatttgcaactggaggttgtgatggatttgttaatgtgtgggacgggaacaataaaaagaggctttatcagtactcaaagtatccgtcaagcattgcaggactctcatttagcagagatggtcgtctgttggctgtggcatcaagctacacatttgaagagggagacaaaccgcacgaaccagacgctatatttgtgcgcagtgtaaatgaaattgaagtcaagccaaaaccaaaagtgctccccacccctcctgcttaattaaattgctgaagccccattttatgtggtattctcaaatatacgtggtagtatttagtgattttctatgggcttcatttctctattatgaagctgtctaaacttcatatgaaaactggtttaattgagcaagaattcttctccttgtttttcttttcctctttcgccctcaatatttgaagaaatcattgtaggtttatgctcaaagctgaacatgttggattctgtatatactggatttctatttctttctatatatgcaaatgtttgtgagcgc

SEQ ID NO: 890 - DNA, 1448 bp, Citrus clementina
ttccacctaggagtggcagcagcagcagcggccactcgttcaattttcaaacctcctttcccccctcagcccctctctctcgcttaaatcactaacagaacacgtccctaaactcctcttctcaattcccccccaaccaatcacggcatgacagctgtccacccgcctcctacctccggtcgcgagctcgggaaccctccaagcgacgggatctcgaaccttcgattctccaaccacagcgatcacctcctcgtctcctcttgggataagagcgtgagattgtacgatgcgagcgcgaatgtgctccgaggagagttcatgcacggtgggcccgtgctcgattgctgcttccacgacgattcttccggtttcagtgccagcgccgatcacactgttagacggctagtattcagccatggaaaagaggatatcctagggaaacatgatgcacctgtgcgttgtattgagtactcgtatgcagcagggcaagtgattactggtagttgggacaaatctctcaagtgttgggatcctagaggagcaagtggacaggagcgaacccttgttggaacataccctcagcctgagcgtgtctactccctatctcttgttggaaaccgtctggtggtggccactgcaggaagacatgtaaatgtctatgatttacgaaacatgtctcagcccgagcaaaggagagaatcttctttaaagtatcagactagatgtgtgcgttgttatccaaatggaaccggatatgctctgagttctgttgaaggacgggttgctatggagttttttgatctctcagaagctagtcaagccaaaaaatatgcatttaagtgccaccgaaaatcagaggccggaagggacattgtgtatccagtgaatgccattgccttccaccccatctatggtacttttgcgaccggaggttgtgatggttttgtgaatgtgtgggatggaaacaacaagaagaggctgtatcagtactcaaagtacccgacaagcattgcagcactctcattcagtagggatggccgacttttggctgtagcatcaagttacacatttgaagaaggagataagccacatgaacctgatgctatatttgtacggagcgtgaatgaaattgaagtcaagccaaaaccaaaagcttacccaaaccctcctgcataaattaggttaacacttttccaatttactgtagtgtgttttcagatgtaatattttgaaatactctgtaaaagcttcattacttaagatgaagcttcatctgaaaactaaatttgtattatagattggaattttcattctcttcatcttccatcctgtttgcaccgaccgatagtaaagttggttcaaagaatttcatttgttcttttccctgttatttttgttgaattacttggactgtagtatttcacggaattgattttgatgcatttgtt

SEQ ID NO: 891 - DNA, 1607 bp, Eucalyptus grandis
ccccctccccgatttcaaatctcgcttccctctccccccgccgatctccaaaaccctaaaaaatctcccgctctccccccccccccaaccgggcgccgggaaataaactcccccgtgccgcccgcgccggggcgcgagctctccagcccgccgtccgacgggatctccaacctcaggttctccaaccacagcgatcacctgctcgtctcctcttgggataagaccgtgcggttgtacgacgccagcgccaacgtgcttagaggggagttcctgcacggaggcgcggtgctcgactgctgtttccatgatgattcctctggatttagcgccagcgccgatcatgctgtccgccggcttgtttttaacgctgggaaggaggatattttggggaaacacgatgcacctgtacgttgtgttgagtactcttatgcagcagggcaagtcataactggtagctgggacaaaacattgaaatgttgggatcctagaggtgcaagtgggcaggatcgcactcttgttgggacatatccacagcctgaacgtgtctactctctctcacttgttggaaatcgacttgtggtagcaacagctggaagacatgtgaacatatatgatttacggaacatgtctcaacctgagcagcgtagggagtcttctctgaaatatcaaaccagatgtgtgcggtgctatccaaatggaacaggatatgctctcagttctgtggagggacgagttgccatggagtttttcgatctttcggaggcaagtcaggctaaaaaatatgcttttaagtgtcacagaaaatcagaggcaggaagggacattgtctacccagttaatgcaattgcattccacccaatctatgggacatttgcaacaggaggttgtgatggttttgtcaatgtttgggatgggaataacaagaaaaggctgtatcaatactcaaaatatccaacaagcattgcagcactctcgttcagcagagatggccgtctcttggcagtgggatcgagctacacatttgaagagggagataagcctcatgaacccgatgccatctttgtgcgtagtgtaaacgagatagaggtcaagccaaagccaaaagtgtaccccaatcctcctgcataaagtgcagtttggtatattagctctccttgctagtgttgtgaattgacatgtgattccgtgggaagcctcgtctttcccgtatgacctagagctgttctttgctatcctttgcccctctagtctgcttgccagtccattaatcctgatgagctggagaaaaagtgtacacaatggaaataccacgatctataactgttcatcaatgaggagtaaaggatggttgcagaacttatcgaccgtgagatactagaagagtttcatctcgatcctcatttggaatgctctgtgatgtcttgtaatttaaattttggattcttgtgaaaatttgccgatcgtcttctcgttttcttctgtgttccatctctttgtacatcctaaattgaaaatgattaaagggggttggggcctcacgaaccatctggaggacccaatctcatctgaggaatcaggttttaagtagatcgaatgttcatcaataa

SEQ ID NO: 892 - DNA, 1161 bp, Elaeis guineensis
tcgcctctctgatctccggcctccgccatgagcgccgccgtccttcctacgagcagcggcgggagggagctctccaatcccccctccgatggcatttccaacctgcgcttttcgaaccacagcgaccaccttctcgtttcctcgtgggacaagactgttcggctttacgacgcgagtgccaatatcctcaagggggaattcatgcacggaggccccgttctcgattgctgcttccatgatgatttctctggtttcagtgcgagtgctgacaacacggtccggaggtttgtctttggtactggcaaggaggacattttgggacgtcatgaagctcctgtgcgttgtgttgaatactcttatgcagcaggacaagtaatcacaggtagttgggacaaaacactgaagtgctgggatcctagaggtgcaagtgggccagatcgtacacttgttgggacatatccacaacctgaacgtgtatattcactttctcttgttggccaccgattagttgttgcaactgcaggaaggcatgtgaatgtctatgatttgcgcaatatgtctcaaccagaacaacggagggagtcttcgttgaaatatcaaactagatgtgttcgttgttatcccaatggcacaggctttgcacttagttcggtggaaggtcgggttgctatggagttcttcgatttatctgaggctggccaatccaagaagtatgcattcaagtgccaccggaaatcagaggctgggaaggacactgtttatccagtcaatgcaatagcattccatcccatttatggaacatttgccactggaggctgtgatggatatgtgaatgtgtgggatggtaacaacaagaagagattataccagtattcaaaatacccgactagcattgcagcattatccttcagcagagatggacgtctgctggctgtggcatccagctacacatttgaagagggggatatagctcgtgagcctgatgccatttttgtgcggaatgtgaatgaggtcgaagtcaagccaaagcctaaggcattgcctgcacctcctccatgagttgatttcatcactagaaacaagatagtttaaatttgtagaatgcttattcgagaatacttattctatttcttgtggttacgtgtacgtgtattctaacag

SEQ ID NO: 893 - DNA, 1449 bp, Citrus sinensis
ttccacctaggagtggcagcagcagcagcggccactcgttcaattttcaaacctcctttcccccctcagcccctctctctcgcttaaatcactaacagaacacgtccctaaactcctcttctcaattcccccccaaccaatcacggcatgacagctgtccacccgcctcctacctccggtcgcgagctcgggaaccctccaagcgacgggatctcgaaccttcgattctccaaccacagcgatcacctcctcgtctcctcttgggataagagcgtgagattgtacgatgcgagcgcgaatgtgctccgaggagagttcatgcacggtgggcccgtgctcgattgctgcttccacgacgattcttccggtttcagtgccagcgccgatcacactgttagacggctagtattcagccatggaaaagaggatatcctagggaaacatgatgcacctgtgcgttgtattgagtactcgtatgcagcagggcaagtgattactggtagttgggacaaatctctcaagtgttgggatcctagaggagcaagtggacaggagcgaacccttgtcggaacgtaccctcagcctgagcgtgtctactccctatctcttgttggaaaccgtctggtggtggccactgcaggaagacatgtaaatgtctatgatttacgaaacatgtctcagcccgagcaaaggagagaatcttctttaaagtatcagactagatgtgtgcgttgttatccaaatggaaccggatatgctctgagttctgttgaaggacgggttgctatggagttttttgatctctcagaagctagtcaagccaaaaaatatgcatttaagtgccaccgaaaatcagaggccggaagggacattgtgtatccagtgaatgccattgccttccaccccatctatggtacttttgcgaccggaggttgtgatggttttgtgaatgtgtgggatggaaacaacaagaagaggctgtatcagtactcaaagtacccgacaagcattgcagcactctcattcagtagggatggccgacttttggctgtagcatcaagttacacatttgaagaaggagataagccacatgaacctgatgctatatttgtacggagcgtgaatgaaattgaagtcaagccaaaaccaaaagcttacccaaaccctcctgcataaattaggttaacacttttccaattttactgtagtgtgttttcagatgtaatattttgaaatactctgtaaaagcttcattacttaagatgaagcttcatctgaaaactaaatttgtattatagattggaattttcattctcttcatcttccatcctgtttgcaccgactgatagtaaagttggttcaaagaatttcatttgttcttttccctgttatttttgttgaatgacttggactatagtatttcacggaattgattttgatgcatttgtt

SEQ ID NO: 894 - DNA, 4672 bp, Ricinus communis
tgaccaatacaatacaaaatcctctcatttgaaatttaaattcaaaaaaccttaccacatagctagttttcaaatctgtttccctctctcagaatcaaaaaccctaagtctctatcagacaccaccaccacgctcctcctcttctccgaccaatgacagctgtggcgccgccgctgggctccggccgtgagctttcaaatccaccgactgacgggatctcgaaccttcggttctccaatcacagcgatcacctcctcgtttcttcctgggacaagagtgtgagactatatgacgcgagtgctaatgcgttaagaggagagtttttgcacggtggaccagttcttgactgctgctttcatgatgattcctctggtttcagtgctagcgctgataatactgtcaggcggctggtttttaactatggcaaggaagatattttgggaaggcatgatgcaccagttcgttgtattgagtactcttatgcagcaggccaagtcatcactggtagctgggacaaaactctgaagtgttgggatcctagaggagcaagtggacaggaccgcactcttgtcggcacatatccacaacctgagcgtgtttactctttatgccttgttggaaatcgtttagtagtagctactgcaggaagacatgtaaatatctacgatttacgaaatatgtctcaacctgagcaacgaagggaatcatcattgaaatatcaaactcgatgtgtgcgttgctatcccaatggtacaggatatgctcttagttcagttgaagggagggttgcgatggagttctttgatctttcagaggctagtcaagcaaaaaaatatgcattcaagtgtcatcgaaaatcagaagctggaagggacatagtatatccagtaaatgctattgcatttcacccggtctatggtacatttgcaactggaggttgtgatggctttgttaacgtgtgggatggaaacaataaaaagaggctttatcagtactcgaagtacccatcgagcattgctgcactttcatttagcagggatggtcggctattggctgtggcatcaagctacacttttgaagagggagacaagccccacgaaccagattccatcttcgtgcgcagtgtaaatgaaatagaagtcaagccaaaaccaaaagtgttacctaatcctccagcataattgacattgcagaagcctctgtttccatggtgtagtatgtcgcgatctatatatgggcttcatgtctctcttatgaagctgtctaaactttttatgtaaaaactgattcaagccagaattcctctcttcagttttcttttcctctttagctccacaattaacttcagcaaaatattataggcttatgctaaaagttgaaatgtcttggattctgtaaatcctgtacatctgtttctttcgacatatggagctgttcctgagaacctactgccaatttattattgtgtagaatcagcggacgatagatgctcattgttcttctgtaggacaagtggcggaaatattttgatactctgatgccttgtcatgttgatcaatacattcgggctcattctccaattgttcgttactcagggcaatggcagactataaattcaatgaaagccaatataaatctctccattttaaccggttgattcatgtcagtggtttaacaatttagcgttatggttatgcaaccgaattacatttttcactttatttgctcatcttcattcggagttacaggtttctcattcatggaagagattgcaacagatgcgagcagtgtcaagctataggagagcttgctgcaccaaccatttccttcatgacttgcaaacatcgatgaagcaaattaatcacctcactttccttaagattgtcacttccttaaaaaaaagcaaaatcagaaggaaatgcagtgagcatatagtcgaccttttatctaccaatacttccattttcaacaaagaaattggatattacagcatggaaaaaaaaaaaaagagcagcaacaatcatcaaagagaatcagagtatccaaaaaccacgagttttgaggtgctagcagctttgcattcaatatttagcaggaaagatgaaacctttttcttttccgtagccctctccccaaagatacaaattgcatatcacttagaaacaaggacactgatcattgtctaccaagtcatggaaactcgctccaccatcaactgcataaacctcccttatacttttggtgctgtttgtccttatactatgtaattacctaaatcctgaaggagctgctcttggacccgcagctgctgctctcattgctttggattgagcaagcaatgcatcataatcctgaatatagatgaaaagcaaattaagaaatgcatcactgcaacagaaagaaaaaatatatataccaagcaaaattaaatgaaagcattacccgtttctcgaatgcatcatcacttgagtcgactatcttatctgcaaggccatattctatagcttcttttgagttgaaatatttaggtcgctgtatatctttattaatttcttccttagtcttcccagttccttttgctaatagatcaatataatactcggtatttgcatcaagttccttggcctgaaaaaaatcgtagtaggatgtgagatttaaaaagatgcaagacaaccctgaacaggtgtgtgtgcagtgagagagcgagcgagagaggggaccttaatccacatatctataacagctccacttgatctgttaactttcggcagatacaattttgctgaaagtcaaagttaaatcattagaatgcatcaaataatgtaagatgctcacaagtcagagctctactttttgtgaatactatgccaatccacagccttttaagtataaacaagtaaccaacaggccgcatgggtacttttgctgctgcaatggttccaaatataatttcccatcaaacatttgttcaggggttgcaaaaatagagatcttccacaagaaagttaaacataaaactgaatatggattgaaagatggaaagcaaaactataaatgtccagaggctagcagcagaaggaagtaaataaaaagtagcgttccctgggttggtgggataggtctgcattgggcttataccatctaagggaaaaaactatagcagtagattaggatgagaaaataatattactgctctaatagtagccaaattgaaaaatatacccaccacaagtgctcatgctaatatttcaaacttaaaagagaagtaggatcatactggacgcatttggctgcaaagcacgataacccttggctcctagagagagaagcattcctgcctgaccatatgccatgccgcaatttacagtatagacagttgatttgcagtacttgaaggagacagataagggagaacatgattagtttcaggcacaattaattggtaaatgaaggatgagaaacaaaaatgtacaacaccacagaaacacaaaagaccactgttcttaaatataatataagacaacaagaatctgataatgccctctgcacatgattttagcttttctcatagaatatattaaggcctaagtgtaaatacaggagaagttcttgaccttatggacactaatgctaaatacagctgatgatacttacaaacatggcatcagcaatagcatatgcctctgtctcagaaccaacagtttccatcttctcgttctaaattgcaacaagaaatcaaattaataaagaaaaaacatatcttagaaagtgaatgcgccttgagcatttcaggatgttagtcaacattttatctagagtttcactaggaggaaaagggagaaaagaaaaagggaaaatgaaggcctctacctgcgtcccagatgagtttatgtataagtatataggctttgatgagtcatcgtaatccaaatacataaactgagcaacaagaagctcagtgactgctggtacaatctgcaggatccagaaacaatatcaagaaaatacaaaaatgatagcgaaggtagaatattaacgggtaaagtatagtctcacaggcattcccagataacatatccgagcatccaagagcaatgacggcaaatcaggaggagcacttcttggtctcccatatcctctgcctcctccacggtacatactcacactcatactatattttgaaggacccctatccatcatgcctgatacactgtacattcccccgtgttccaaatagttattcctcgaggagatgctttcctgccagaagttgtcaaaaccaagaatacatcaagataatgtatttgcagttgccacgttataattatgtttgagaagaaatcaacatccaagaagcactaaacaaagattaataaaatggaattgcttattactagaaaactataatccaactgcatgattaaacaaatggttaaagagagaaacctctgtaacactttctgactgtctacgaactggattatcttcagtcatgaacatgtccagttgtgaaggagtaagaccataaagatgtcgtggtacatttttgtaattttccatcactgcagttgataagatatagaaaactgaaagttaggaattgaattacaaccttctggtttacaataacgcacaagattcagagctattgagaatgagctctcggtaattc

SEQ ID NO: 895 - DNA, 1334 bp, Raphanus sativus
  misc_feature (17)..(17): n is a, c, g, or t
  misc_feature (81)..(81): n is a, c, g, or t
  misc_feature (1137)..(1137): n is a, c, g, or t
  misc_feature (1185)..(1185): n is a, c, g, or t
ttactcccatttcaaanctcaaaaacccctctctctcactcccccgaaaccctagaatttgtgatcttcaacggtaggagnaatcggaacatgagtcagcctcctcctccgtccgccggccgtgagctagcgaacccaccgtccgacggcatttcgaatctcagattctccaacacaagtgaccatctcctcgtctcttcctgggataagagtgtgaggttgtacgatgtgagcaccaattcgttgaaaggagagttcctacacggcggcgcagtactcgattgctgtttccacgacgattcctctggtttcagcgttggcagcgacaacaaagtcagacggattgtattcaatgttggcaaagaggatgttttggggacgcatgaaaagcctgtgcggtgtgttgagtattcttatgctgcagggcaagttattactggatcttgggataaaacagttaagtgttgggatccgagaggtgcaagtgggccggaacggactcaggtgggaacatacgtgcaaccagagcgtgtttactctctgtctctcgttgggaaccgtctcgttgtcgcaacagcaggaaggcatgtcaacatctacgatctcaggaatatgtctcagcctgagcaaagaagggagtcttcactaaagtaccagacgagatgtgttcgtagttatcctaatggaacagggtatgctcttagctctgttgaaggaagagttgcgatggagttctttgatctgtcagaggctgctcaagctaagaaatatgcttttaagtgtcatcggaaatcagaggctggaagagacattgtttaccctgttaatgccattgctttccatccaatttatggcacttttgcaaccggaggctgtgacgggttcgtcaacatctgggatgggaacaacaagaagaggctgtatcagtattcaaagtacccatcaagtatagcagcattgtcattcagtcgagatgggcatctactagctgttgcgtcaagttacacttttgaagagggggagaaatcgcacgagccagaagccatctttgtaagaaacgttaacgaaatcgaagtgaaacccaaacccaaagcatgtccaactcctgcggcatgataaggaagaaagctgtcctcnacagaagttggtcttttgtttttactaagagttccccatagatactgnaagtatgtctgagcttttaatttttttttgtcttgagtgtataaagtagaagtaaagacaatgatttgtagttcgtttggctttgaggacatattattacccaagagatattagattaattccagagaaatatagtaaaaatacaccag

SEQ ID NO: 896 - DNA, 1282 bp, Amsonia hubrichtii
acgctccggcccctagcatttcaacagcaaacagtctaaaaccctaactgctgcctatacaatctgcctccgactgacaccagcaatgacggcggcacctcaggtgagcaccggaagggagctgtcgagccccccgacggacggcatatcgaaccttcgattctccaaccacagcgatcacctcctcgtctcctcttgggacaagagcgttcggttgtatgatgcgagtgccaatgatttgagaggagagttcatgcacggaggtcctgtacttgactgctgcttccacgacgactcatcgggttttagcgccagtgctgacaatactgtgagaaggctagtgttcaactacggaagggaggatattttgggaaggcatgatgctccagttcgttgtgttgagtactcatatgcaactggacaagtgattactggtagctgggacaaaacacttaagtgttgggatcctagaggtgcaagcgggcaggaccgcactctagttgggacatatgcccaacccgagcgtgtttattctctttctgttgttggcaatcgccttgtggtagcaactgcgggaagacatgtcaatgtctatgatttacggaatatgtctcaacctgagcagcgaagggaatcctcattaaaatatcaaacaagatgtgttcgttgttatcccaatggaactggttatgctcttagttccgtggagggtcgggtggcaatggagtttttcgacctttctgagtctggtcaatcaaaaaaatatgcatttaagtgtcaccggaaatctgaggctggaagggacattgtctaccctgtaaatgccattgcatttcacccgatctatggtacatttgccactgggggttgtgatggatttgtcaacgtgtgggatggcaacaacaaaaagaggttgtatcagtacacgaaatacccatcaagcattgctgccttgtcgttcagtagagatggaagattgctggctgttgcatctagctatacatttgaagagggagataaaccccatgaacctgatgccatattcgtccgcagtgtaaatgaagttgaagtcaagccaaagccgaaagtgttgccaaatcctgctgcataaagggtatcgggaaagaagtgcctactcgttacatagtagcttggacatatgaacttgtactttacctgaacattatgcagccttggcataagtcaaatgcaaattatattttgggtccttaaaaagcaggcttcatagtttcagagagttttacactgtattgcgtggttt

SEQ ID NO: 897 - DNA, 1362 bp, Gossypium hirsutum
cacactgcacactctctgaaaccctaaaagctctcacccgtcagtccgtttacctctccaacggcccaatcaagcgatgacatccgcccagccgccggcaccgggacgcgagctctccaaccctccgacggatgggatctcgaacctccgattctccaaccacagcgatcacctactcgtctcctcatgggataagactgtgagattgtatgacgcgagtgccgattcattacgaggagagttcatgcacggtgggcctgtactcgattgttgcttccatgatgattcctctggatttagtgccagcgctgataatacggttaggaggatagtgtttagccatggaaaggaggatattttaggtagacatgatgctcccgtgcgttgtatagagtactcttatgcagcaggacaagttatcacaggcagttgggacaagacattgaaatgttgggatcccagaggtgcaagtggccaggagcgtactcttgttggcacatacccacagcctgagcgagtttactcattatctcttgttggaaatcgtttagttgtggcaactgcaggaagacaagtaaatgtttacgacctgcggaatatgtcgcaacctgagcaacgaagagaatcttcattgaaatatcaaactaggtgtgtaagatgttatccgaatggaacaggatacgctcttagttcggttgaagggcgggtggcaatggagttctttgatctttcagaggccagtcaagccaaaaaatatgcctttaagtgccatcggaaatctgaggctggacgggacattgtatatccagtaaatgctattgcattccatcccgtctatggtacatttgcaactggaggttgtgatggttttgttaatgtgtgggatggaaacaataagaagaggctgtatcagtactcaaagtacccaacaagcattgcagctctttcgttcagtagagatggacgattgttggctgtggcatcaagttacacgtttgaagagggggagaagccacatgaaccggatgccattttcgttcgaagtgtaaacgaaatagaagtcaagccaaaaccaaaagtgtaccctaaccctccagcatagccaagtaaggatctctatataatttatggtaatttgagaaatgtgatatgttgaatactttgtaagtcttcgatgatcttagagtgtgtttggtcaagtaaaaaagtagaaagaaaatacattttgagtatgcttggtaagaagaaaagtgagaggaaagaaaaaagagaacttattatttttcatcgaagcgtgtaaaagcaaatcattccataattggaatgataggaggagagaaaattagtgagattaaagcgtgc

SEQ ID NO: 898 - DNA, 1583 bp, Citrullus lanatus
atcaaattcaaaaaatcaaatttcgaaaaactccttccctctccctctctctctctctctctctctatctctctctatctctctctctcaaactattcagagacccacggaagaagaaaaaccctaattcttcatctcatctggcaccaccaaatcaatttgccccatgacagccgtccctcctccggctgctggccgggagctttcaaatcctccctccgacggcatttccaatctccgtttctccaaccacagtgatcacttacttgtttcctcttgggacaagactgtccgcttgtacgacgccagcgccaacgtcctccgcggtgagttcgtacatggtggtcctgtcctcgactgttgtttccacgacgattcttctggattcagtgccagtgttgacaacaccgtcaggagacttgttttcaaccataataaggaggacatattagggaggcatgatgcacctgtacggtgcgttgagtattcttatgcggcaggtcaattaattactggcagttgggataaaacactgaagtgttgggatcctagaggtgcaagtgggcaggaacatactctcgttggaacatatcctcagcctgagcgtgtttactcactttctcttgtggggaatcgtttagttgtagcaactgctggaaggcatgttaatgtctacgacttgagaaacatgtctcaacccgagcaaagaagggaatcctcgttgaaatatcagactcgatgtgtgcgttgttatccaaatggaacaggctatgctcttagttcagttgaaggacgagttgctatggagttttttgatccctcagaggccagtcaagccaaaaagtatgcattcaaatgtcacagaaaatcagaggctggaagggacatagtctatccggtcaatgccattgcattccatcctatctacggtacttttgcaacgggaggttgtgatgggtacgtaaatgtttgggatgggaacaacaagaagaggctttatcagtattcaaaatatccaacaagtattgcagcactgtcatttagtagagatgggcggctattagctgtagcctcaagttacacatttgaagagggagataaaccccacgagccagatgccatatatgtccgcagtgtaaatgaaatagaagttaagccaaagcctaaagtataccccaatcctccaacatgattaacatcacagaaatctcccctgcgatccatgcttttcattctgtagccctcgattggttttcatgctagagtcacttgatggtggtttagagccaaggtcccgagtgacgcagattgcgcccttagcatcatacaaaagagtccacgagacaggcttttttttttttttttttttttttttttttttttttttttttaaattttcttcttgcaaaacttctgttttgtgttcttggcgagatgagagagacagagccttggactttgggatgtacccaaaagtagtatgcttaatgtgtacagatgctgtgcttctataaactttcctcaattgttgttaaggatatggataacacttatatttttcatatatttttgcccttccaaca

SEQ ID NO: 899 - DNA, 1396 bp, Pinus pinaster
agttcggcctatattggccagcgatcaaagtctgctagaagaagcgtcgatttaacctcaggaggaaagggggaggaaatcatggcggcaacgtctcccgttggtgccggctcgggacgggagctcgcgaatcctcccactgacggcatttctaacttgagattttccaatcacagcgaccatttgctcgtctcctcatgggacagaaaggtgcgattatatgatgcaagcgcgaattcgttaaagggtcaattcgtacacggaggtccggttttagattgctgttttcacgacgacgcatcgggtttcagtggaagtgctgacaacactgtgagaaggtatgatttcagcaccaggaaggaggatatattgggcaggcatgaagctcctgttcgttgtgttgagtattcatatgcagcagggcaagtgataacggggagttgggacaagacattgaaatgttgggaccctagaggtgcaagtgggcaggagaagactcttgttggtacatattcacaaccggagcgcgtgtattctatgtcactagttggtcaccggttggtggtagccacagctggcaggcatataaatgtttatgatctccgtaacatgtcacaacctgaacaacgaagggaatcgtccttgaagtatcaaactagatgtgtgcgttgctatccaaatggaacaggttttgcccttagttctgtggaaggtcgcgtggctatggagttttttgatttatctgaagctggtcaagctaaaaaatatgcctttaaatgtcatcgcaagtcagaggctggcagagatactgtttatccagtaaacgcaattgcctttcatcccatttatggtactttcgccactgggggctgtgatggctatgttaatgtatgggatggcaacaacaaaaagaggttgtaccagtattcaaaatatcctacaagcattgctgctttatcatttagtagagatggtcgtttgttggctgtggcatcaagctacacatttgaggagggtgaaaaaccgcatgagccagatgccgtttttgtacgaagtgtaaatgaagctgaagtgaaaccaaagcccaaagtttatgctgcacccccgtgaggcccgtctacgttaatattctttcgtagagtatgctttctagtacatctgtccttgtctttctgatgtacttgattgttacattgttactgtgttgggtatataagatacgaaattctctgcttttgttggctgctatggtgtttcttttataatttaatactctatggattaatctcttgattctaaactactaccttgtggacatgactgagcatctctctaacagcttgtgtgggatgcctcactttttttagggtttttgtttgtactaaattgtacagtt

SEQ ID NO: 900 - DNA, 1339 bp, Arachis hypogaea
gagattccctctctgagtattctgccagaaccctaactaaccatggcaactgcagttacgccggcgtcgctcggccgagagctgtcggatcctccgtccgacggaatctccaacctccgcttctccaaccacagcgatctcctcctcgtctcctcttgggataagagcgtgcgcttgtacgatgccagcgccaatgtgctcaaggctgagttcatgcacggcggccccgtcctcgattgctgcttccatgatgactcttccggtttcagcgctgccggcgacaacaccgtcaggcgcctcctcttcgcctctaacaaggacgacatcctcggaaagcacgacgctcctgttcgttgtgttgagtactcctacgccgcagggcaattgatcactggtagttgggataaaaccctgaagtgctgggaccctaggggtgcaagtggacaggagcgcactctggttgggacatatccacaacctgagcgcgtttactccctatctcttgttggacatcggctagttgtagcaacggctggaaggcatgtcaatatttatgatttgaggaacatgtctcaacccgagcaacggagagaatcttcattgaaatatcaaactagatgtgtgcgctgctaccctaatggaacaggatatgcacttagttctgtggaaggacgggttgcaatggaattctttgacctctccgatgctagccaagcaaaaaaatatgcctttaagtgccaccgaaaatcagaagctggaagggacatcgtctatcctgtaaatgctattgcattccatcccgtatatggtacgtttgccacaggaggctgtgatggttatgttaatgtttgggatggaaacaacaagaagaggctataccagtactcaaagtatccaacaagcattgctgcactttcatttagcagagatgggcggctcctggctgttgcatcaagttatacatacgaagaggggcttaaaccccatgataaagatgccatatacatccgtggcgtaaacgagattgaggtcaagccaaaacccaaggtccttcctccagcttgatcgcagatgatgacccagattgcaagtagatttgatatgcttgtcaactaatgtgtgcatatgttcacgtctctctcgtggacaccaagaacaaagctatatataagctcattttgtttagtagttttatttctaagtacgatctgttgttggaaatgttctcttttctactattgtttgtccagattaccttcttttgttaaggtagttatgttgtaaagtaatttgacttgaaactgataaccagttattaccaatgttatgcctcccattt

SEQ ID NO: 901 - DNA, 1475 bp, Pinus taeda
atcaaagtctgctagaagaagcgtcgatttaacctcaggaagaaagtgggaggaaatcatggcggcaacgtctcccgttggtgccggctcgggacgggagctcgcgaatcctcccactgacggcatttctaacttgagattttccaatcacagcgaccatttgctcgtctcctcatgggacagaaaggtgcgattatatgatgcaagcgcgaattcgttaaagggtcaattcgtacacggaggtccggttttagattgctgttttcacgacgacgcatcgggtttcagtggaagtgctgacaacactgtgagaaggtatgatttcagcaccaggaaggaggatatattgggcaggcatgaagctcctgttcgttgtgttgagtattcatatgcagcagggcaagtgataacggggagttgggacaagacattgaaatgttgggaccctagaggtgcaagtgggcaggagaagactcttgttggtacatattcacaaccggagcgcgtgtattctatgtcactagttggtcaccggttggtggtagccacagctggcaggcatataaatgtttatgatctccgtaacatgtcacaacctgaacaacgaagggaatcgtccttgaagtatcaaactagatgtgtgcgttgctatccaaatggaacaggttttgcccttagttctgtggaaggtcgcgtggctatggagttttttgatttatctgaagctggtcaagctaaaaaatatgcctttaaatgtcatcgcaagtcagaggctggcagagatactgtttatccagtaaacgcaattgcctttcatcccatctatggtacttttgccactgggggctgtgatggctatgttaatgtatgggatggcaacaacaaaaagaggttataccagtattcaaaatatcctacaagcattgctgctttatcatttagtagagatggtcgtttgttggctgtggcatcaagctacacatttgaggagggtgaaaaaccgcatgagccagatgccgtttttgtacgaagtgtaaatgaagctgaagtgaaaccaaagcccaaagtttatgctgcacccccatgaggcccgtctacattaatattctttcgtagagtatgatttctagtacatctgtccttttcctcctgatgtacttgattgttacattgttactgtgttgggtatataagatacgagattctctgcttttgttggctgctatggtgtttcttttataatttaatactatggattaatctcttgattctaaactactaccttgcggacatgactgagcatctctctaacagcttgtgggggatgcctcacttttttagggtttttgtttgtactaaattgtacagttgaattttcctaccttcaagcgtcttttacattttaataaatctcaagtgtcagtcaaagttaccattgaaataaaaagcttgtgaatcgaaaaaaaaaaaaaaaa

SEQ ID NO: 902 - DNA, 1685 bp, Picea glauca
ggggacgaaatgtctttcctctctagcagctttgctactaacatattacttcgggggtaatggaggggaagtgggtttgtattcaaattattgagctggcccgcccgcccgccatttgttgttcccatgaggaggtctgagggcatcaaaactcaagttgcccagcagtgttaacaatctcttttcaattttttttaccagtttggcttcgattggcctgctatcgaatcctgccagaagaagcgccgatttaaccttagaacagctcgaggacgaggagggggaggaaatcatggcggcaacggcacccgttggcgccggctcgggacgagagctcgcgaatcctcccactgacggcatttctaacttgagattttccaatcacagcgaccatttgctcgtctcctcatgggacagaaaggtgcgattatatgatgcaagcgcgaatacgttgaagggtcaattcgtacacggaggtccggttttagattgctgtttccatgacgatgcatcgggtttcagtggaagtgctgatcacgctgtgagaaggtatgatttcagtaccagaaaggaggatatattgggcagacatgaagctcctgttcgttgtgttgagtattcatatgcagcagggcaagttataacagggagttgggacaagacattgaaatgctgggaccctagaggtgcaagtgggcatgagaagactctcgttggtacatattcacaaccggagcgtgtgtattctatgtcactagttggtcaccgcttggtggtagccacagctggcaggaatataaatgtgtatgatctccgtaacatgtcacaacctgaacaacgaagagaatcgtccttgaagtatcaaactagatgtgtgcgttgctatccaaatggaacaggttttgcccttagttctgtggaaggtcgtgtagctatggagttttttgatttatctgaagctggtcaagctaaaaaatatgcttttaaatgtcatcgcaagtcagaggctggcagagatactgtttatccagtaaatgcaattgcttttcatcccatctatggtactttcgccactgggggatgtgatggctatgttaacgtgtgggatgggaacaacaagaagaggttataccagtattcaaaatatcctacaagcattgcagctttatcatttagtagagatggtcgtttgttggctgtggcatcaagctacacatttgaggagggtgataaaccgcatgagccagatgctatttttgtacgaagtgtaaatgaagctgaagtgaaaccaaagcccaaagtttatgctgcacctccatgaggcccctctacattatatattctttcatagattatgctttctagtgcagcagtccttgttttcctgatgtacttgattgttacagttgttgctgtgttgggtatagaagctacaagattctatccttttgttggctgctatggtgtttcttttataatctaatactttatggagcgattacttgattccaaactactaactagcaggcatggctgagcatctttctaacagcttgtgtgagatgtctcgctgtttttagaggttttgtttgtactaaattgtacagagtttaaatttcttatctccagatgtcttttgcattttaataaatcctaaatatcagtcaaaattatcattgaaataa

SEQ ID NO: 903 - DNA, 1336 bp, Triphysaria pusilla
attgctgttgctgtttttgaatttgaatttcagatagccaatacagagcttatctatctctctaagatctcctaatttctgtaacttcccaatttcttcaaatctctgctaaaaccctagtcactttcttctgagacggtgaccatgacggcggcgccacaaccaccgactggccgtgagctgacgagccctccgaccgacggaatttccaacctccgtttctccaaccatagtgaccacctcctcgtttcttcatgggacaagagtgttcgtttgtatgatgcgagcgccaacgagctgcggggagagtttatgcacggaggcgccgtgcttgattgctgcttccacgacgattcgtcggggtttagtgcttctgctgatcacactgttcgaaggcttgtgttcaattacaatagggaggatattttagggaagcatgatgctcctgttcgttgcatcgagtactcatacgccactggccaagttataactggtagctgggacaaaaccattaagtgctgggacccacgaggttcaagtggtcaagaccgttcacttgttgggacatactctcagcccgagcgcgtttattcgatgtctctcgttggcaaccgcttggtcatcgcaactgctgggaggcatgtgaatgtgtatgatctccggaacatgtcccagcctgagcaacgaagagagtcttcgttgaagtatcagaccagatgtgtccgtagttatcccaacggaacagggtatgccctaagtagcgtcgagggtagggttgctatggagttctttgatctctcggaggctggccaatcgaaaaagtatgcatttaaatgtcatcggaaatccgaagcagggagagatattgtctaccctgtgaatgccattgcgtttcaccctatctatggtacttttgctacaggaggctgtgacgggtatgtgaatgtgtgggatgggaacaataaaaagagattatatcagtacgctaagtacccatcaagcattgctggtttgtcatttagcagagacgggaggctcttggccgttgcatctagttacacgtatgaagagggagaaaaacaacatgagccagatgcgatatttgtccgcagtgtgaatgaagtcgaagtgaagccaaagcctaaagtgctaccaaatcctgcttaatgaaagaaacaaataccttgttttaagactgtatgtgtgtgtgtggcctttttatttattttttcatatcctttcttcttgccatgttttggtgactgtaattgcaaaccctggatagattgttactataatcattttctcgttgattagtctataaatgggcttatca

SEQ ID NO: 904 - DNA, 1501 bp, Aquilegia formosa
aaaaaaaaaaaaaaaaaaaaaactcacctgaattggattccttttcactcaactgaaaaaccttccttccgccttttcttcaacaattcaaacttcaaactcacttccctctctctttctctcgatcaaccaaaaccctaaaaaaaaaaaaaaaccctagaatctgaatcaatgagtgcgattgttcctcctcctccggcaccagggaaagagcttttaaatcctccaagagatggtatttcgaatctaagattctctaatcacagtgatcatcttctcgtttcttcatgggacaagagtgtgagattatatgatgcgacatcaaatgtaatgatgggtgagttcttacatggtggaccagttttggattgttgttttcatgatgattcttctgggtttagtgcttctgctgataatactgttagaagatatgtgtttagctctggaaaagaagatatattgggaaggcatgaggcaccagttcgctgtattgagtactcatatgcggcaggacaagtgataaccggaagttgggacaaaactgtgaagtgttgggatcctagaggtgcaagtgggaaggagcgtactcttgttgggacttacccacaacctgagcgtgtatattctctttcacttgttggtaaccgtttagtggtagcaactgctggaagacatgtaaacgtctatgatttaagaaatatgtctcaacctgagcaaaggagggagtcatcattgaaatatcaaactagatgcgtttgttgctatcccaatgggacaggttttgctcttagttcggttgaaggtcgagttgcgatggaattctttgatctatcggaggcaggtcaagcaaagaaatatgctttcaagtgccaccgaaaatcagaggctggaagggacactgtgtatcctgtcaacgcaattgctttccatcctatctatggtacttttgcaaccggaggttgtgatgggttcgtaaatgtgtgggacggaaacaacaagaagaggctatatcagtactcgaagtacccaacaagcatagcagcgctatcatttagcagagatggtcgtttgatggctgtggcatccagttatacatatgaagagggggacaagccccatgaatcggatgcaatatttgtgcgcagtgtgaatgagatcgaagtaaaaccaaagccaaaggtgtatgccaatccttcctaaaagatgtacaaagctttttggggacatctttgttgaactttctgactactgctaggatgttacgtctctaatcactaaatggtggcctattgtgttccaaccagatgcccaactgatgaaaccagttcatcttaggcttttggcctctccagtgtatttgcagacgttacacacgaaaatatcaaatctttgtggtttaaaatgatgaagcactatgtttctatgatgtagaaaaatcaacttgttatgctatttagactattatggacaaccgcttttgttatctaacatttctaatggg

SEQ ID NO: 905 - DNA, 1494 bp, Aquilegia formosa
aaaaaaaaaaaaaaaactcacctgaattggattcttttcactcaactgaaaaaccttccttccgccttttcttcaacaattcaaacttcaaactcacttccctctctctttctctcgatcaaccaaaaccctaaaaaaaaaaaaaaaccctagaatctgaatcaatgagtgcgattgttcctcctcctccggcaccagggaaagagcttttaaatcctccaagagatggtatttcgaatctaagattctctaatcacagtgatcatcttctcgtttcttcatgggacaagagtgtgagattatatgatgcgacatcaaatgtaatgatgggtgagttcttacatggtggaccagttttggattgttgttttcatgatgattcttctgggtttagtgcttctgctgataatactgttagaagatatgtgtttagctctggaaaagaagatatattgggaaggcatgaggcaccagttcgctgtattgagtactcatatgcggcaggacaagtgataaccggaagttgggacaaaactgtgaagtgttgggatcctagaggtgcaagtgggaaggagcgtactcttgttgggacttacccacaacctgagcgtgtatattctctttcacttgttggtaaccgtttagtggtagcaactgctggaagacatgtaaacgtctatgatttaagaaatatgtctcaacctgagcaaaggagggagtcatcattgaaatatcaaactagatgcgtttgttgctatcccaatgggacaggttttgctcttagttcggttgaaggtcgagttgcgatggaattctttgatctatcggaggcaggtcaagcaaagaaatatgctttcaagtgccaccgaaaatcagaggctggaagggacactgtgtatcctgtcaacgcaattgctttccatcctatctatggtacttttgcaaccggaggttgtgatgggttcgtaaatgtgtgggacggaaacaacaagaagaggctatatcagtactcgaagtacccaacaagcatagcagcgctatcatttagcagagatggtcgtttgatggctgtggcatccagttatacatatgaagagggggacaagccccatgaatcggatgcaatatttgtgcgcagtgtgaatgagatcgaagtaaaaccaaagccaaaggtgtatgccaatccttcctaaaagatgtacaaagctttttggggacatctttgttgaactttctgactactgctaggatgttatgtctctaatcactaaatggtggcctattgtgttccaaccagatgcccaactgatgaaaccagttcatcttaggcttttggcctctccagtgtatttgcagacgttacacactaaaatatcaaatctttgtggtttaaaatgatgaagcactatgtttctatgatgtagaaaaatcaacttgttatgctatttagactattatggacaaccgcttttgttatctaacatttctaatggg

SEQ ID NO: 906 - DNA, 1483 bp, Nicotiana benthamiana
aaccccaaaacaatcagtactccttactcccaaactggccccaatttgaattcaaaatctggaagcattcatgtgactttttcatttttcaaaactctctctctctccccctccctccactctctgtaaaaccctagtcactcactcattacgctctcgcaacctctacctctcttttaaatcagcaaacgacagcgatatcatgacggcggtgccgcagtctgctggaagagagctcgcaagcccgcccaaggacggcatatccaacctccgtttctccaatcacagcgatcaccttttagtttcttcttgggataagacggttcgtttgtacgatgcgagtgcgaatgctttgagaggagagttcatgcacggaggtccagtgctcgattgttgcttccacgatgattcatctggattcagtgctagtgctgataataccgttagaaggcttgtgttcaactatggaagagaggatatcttgggaaggcatgatgcaccagttcgctgcattgaatactcatatgcaactggacaagtgataactgggagctgggacaaaaccttgaaatgctgggatcctagaggtgcaagtggacaggaacgtactcttgttggaacatatacacaaccagagcgtgtttattctctttcccttgttgggaaccgtttagtagtagcaactgctggaagacatgtaaatgtctatgacttgcggaacatgtctcaacctgaacaacgcagggaatcttccttgaaatatcaaacgagatgtgtgcgatgttatcccaatggaacaggctatgctctaagttctgttgaaggtcgggtagcaatggaattttttgatctctctgaggccggtcagtcgaagaaatatgcatttaaatgtcatcggaaaactgaagctggaagggacatagtctaccctgtaaatgcaattgcgtttcaccctatctatggtactttcgccactgggggttgtgatggttatgttaatgtctgggatggtaataacaaaaagagattgtatcagtaccctaaatatccttcaagcattgcagcattgtcatttagcagagatggtagactcttggctgtagcatcaagttatacatttgaagagggagaaaagccccatgagccggatgccataattgtccgcagcgtaaatgaagttgaagtgaagccaaagccaaaggttttgccgaatcccaccacatgaaactatttcagaagctcgtcctcatcctctctcgagtcgactagtttataatattttcgaaaactatgtacttgatatttcaatttgactgccaggactcatttctcttagctgcaaattctggagaacagttataaatttgtaattacccagttagcaattgtaccttttagatgactccgcagtctcattccctgacctacttgtcttgatcctaaatctggaaaatagagcaatatcgtagtagcctttgtttct

SEQ ID NO: 907 - DNA, 1411 bp, Nicotiana benthamiana
gatgtactccttactcccaactggccccaatttgaattcaaaatctgggaagcattcatgtgactttcatttttccaaaactctctctctctcctccctccctccactctctgtgaaaccctagtcacacactccatacgctctcgcaacctctacctctctgttaaatcagcaaacgacagcgatatcatgacggcggtcgcgcagtctgctggaagagagctcgcaagcccgcccaaggacggcatatccaacctccgtttctccaatcacagcgatcaccttttagtttcctcttgggataagacggttcgtttgtacgatgcgagtgcgaatgcgttgagaggagagttcatgcacggaggtccagtgctcgattgttgcttccacgatgattcatctggattcagtgctagtgctgataataccgttagaaggcttgtgttcaactatggaagagaggatatcttgggaaggcatgacgcaccagttcgctgcattgaatactcatatgcaactggacaagtgataactggcagctgggacaaaaccttgaaatgctgggatcctagaggtgcaagtggacaggaacgtactcttgtaggaacgtatacacaatcagagcgtgtttattctctttcccttgttgggaaccgtttagtagtagcaactgctggaagacatgtaaatgtctatgacttgcggaacatgtctcaacctgaacaacgcagggaatcttccttgaaatatcaaacgagatgtgtgcggtgttatcccaacggaacaggctatgccctaagttctgttgaaggtcgggtagcgatggaattttttgatctctccgaggccggtcagtcgaagaaatatgcatttaaatgtcatcggaaaactgaagctggaagggacatagtctaccctgtaaatgcaattgcttttcaccctatctatggtactttcgccactgggggttgtgatggttatgttaatgtctgggatggtaataacaaaaagagattgtatcagtaccctaaatatccttcaagcattgcagcattgtcatttagcagagatggtagactcttggctgtagcatcaagttatacatttgaagagggggaaaagccccatgagccggatgccataattgtccgcagcgtaaatgaagttgaagtgaagcccaagccaaaggttttgccgaatcctaccacatgaaactatttcagaagctcctcctcgatgctctctcgagtcgactagtttataatattttcgaaaactatgtacttaatatttcaatatgactgccagggctcattttcttttagctggaaattctggataacagttataaatttgtaattactctgttagcaattttacctttcagatgactccggagtctcatttcctg

SEQ ID NO: 908 - DNA, 1493 bp, Papaver somniferum
gcatccgcctttttcttccgaatttgaaaacaattccctctcagtctctttgatccactttgtcaccaccacgacaaaggtaaaccctaacttcttcgaacaccaagtaaagaaaaaacaaaaattcatgacaacagcaattcctcccatgccagggagggaacttacaaatcctcctaaagatggtgtttcaaatctaagattctctaatcacagtgataaccttcttgtttcttcatgggataagagtgttaaattgtatgatgcgaatgctaacggtttgaaaggtgagtttatgcatggaggtccggtattggattgttgctttcatgatgattcttcgggatttagtgctggaggagataatactgttcgtaggtttgtctttgagtctggcaaggaagatatattgggaaaacatgatgcacctgttcgttgcgttgaatactcctatgcagcaggacaagtcatcactgggagttgggacaaaatgctcaagtgttgggatcctagaggtgcaagcgggcaggagcgtacccttgttgggatgtatccacaacccgagcgtgtgtattcgatatcacttgttgggaaccgattagtggttgcaactgctggaagacatgtaaatgtctatgaccttcggaatatgtcccaaccggaacaacgaagggagtcttcgttgaagtatcaaactagatgtgtgcggtgttatcccaacggaacaggttttgctcttagttctgtggaaggtcgggttgcgatggagttctttgatctctctgaggctggccaggcaaagaagtatgctttcaagtgccatcgaaagtcagaggctggaagggatactgtgtatcctgtcaatgctatagcattccatcccatctatggtacatttgctacaggaggttgcgatgggtttgtaaatgtttgggatggcaacaacaagaagagactatatcagtactcaaaatatcctacaagcatagcagcactatcatttagcaaagatggccgtctactggctgttgcttccagttatacatacgaggaaggagatcaatctcatgaacccgatgccattttcgttcgcactgtaaatgaagttgaagtcaaaccaaagccgaaagtgtaccctactcctgcataatcaaaaatcaaggatgtgttctggcactaatacttctcaaatggtctcctccacatcactggtatgattattgaaattgtgagaatccgcatgtaggtttcagatgcaagcaacaagaagtttaaagaacatatttcacgtaggagatagcttagaatatgtatttttatattctcgtgtactcattttagagttgtagtgttgtggctgttgccatgggcatgtgtaatggaccatcaaatactattcttcagcacctctctgagcagttaatttaagtagtgtctggtgtaatgagtttatgaagtaaagatagaccaatgttttacataattaaattttt

SEQ ID NO: 909 - DNA, 1564 bp, Lippia dulcis
tctcacgtttgaaaacagaatcgaattcaccactttgaatttgaaatcccgatagcggcggacgcccccctccccccctccccttctcacactattcaaaaatccccaaatctcatcgacaacgttcttcgttctccgctttattctgcgttaaaaccctagtcatttcgcgcgcaacactcggtgaatcgcgttaatcatgacagctgcgccgccaccatccacggggagagagctctcgagtcctccgacggacggcgtctctaacctccgtttttcgaaccacagtgaccacctcctcgtttcctcatgggataagagtgttcgattgtatgatgcgagcgccaatgcgctaaggggagagttcatgcacggcgggcctgtgctggattgttgcttccatgatgatacctcggggtttagtgcttctgctgattgcactgttagaaggcttgtgttcaactacaacagggaggatattttggggaggcacgacgcacctgttcgttgtgttgaatactcttatgctactggccaagtgatcaccggcagttgggataaaaccttaaagtgttgggaccccagaggtgcaagtggtcaggaacgcactcttgttggaacacacactcaacctgagcgtgtgtattctttatctcttgttggcaatcggttggtggttgccactgctggaagacatgtaaatgtgtatgatttgagaaacatgtcgcaacctgaacaacgaagggaatcttcttgaaataccaaacaagatgtgttcgatgttatcctaatgggacaggttatgctcttagttctgtcgaaggtcgtgttgctatggagttttttgatctctcagaggctggtcaatccaagaaatatgcatttaaatgtcatcggaaatctgaagctggaagggacattgtctaccctgtgaatgccattgcatttcacccgatctatggtacttttgcgactggaggttgtgatggttatgtcaatatgtgggatggaaacaataagaagagattatatcagtatgcaaagtacccaacaagtattgcagctttgtcctttagcagagatggtagactgttggcggttgcatcgagctacacatacgaagagggagataaacctcatgagccggatgccatattcgtccgtagtgtgaatgaagtggaagtcaagcccaagccaaaagtagtagccaatcctgctacatgatacataatcatgcctacactcggtttgcttgtatcatttctgaacatgtttgtttcgtgagtgtagcggattattgttattataatcattttctcgttgattgctcggatgtttaggctttcggtttgaaaatttgtattgtgcgtaggatctgtatgtgaccaatgatttggaggaaatgaagcagctaatatatgatgctgctctaattaacgtttccttttcagttcatttctgtaaatgttgtgcaaagcagcactctttgtaggctaatgctgcaacagcactgagatgaagtagtgatattctgcatgtcgtattgaatagataagtgatagtt

SEQ ID NO: 910 - DNA, 1179 bp, Tabernaemontana elegans
acaatttgcctccgactgacacccgcaatgacggcgacacctcaggcgagtaccggaagggagctatcgagccctccgacggacggtatatccaacctccgcttctccaaccacagcgatcacctactcgtctcctcatgggacaagagcgttcgattgtatgatgcgagtgccaatgatttgagaggagaattcatgcatggaggtcccgtacttgactgctgcttccacgatgattcctcgggctttagcgccagtgctgacaatactgtgagaaggcttgtgttcaaccacggcagggaggatattttgggaaggcatgatgctcctgttcgttgtgttgaatactcgtatgcaactggccaagtgattactggtagctgggacaaaacgctaaagtgttgggatcctagaggtgccagtgggcaggagcgcactctagttgggacatatacccaacccgagcgtgtgtattctctctctgttgtgggcaatcgcttagtggtagcaactgctggaagacacgtcaatgtatatgatttgcgaaatatgtctcaacctgagcagcgaagggaatcctcattaaaatatcaaacgagatgtgtccgatgttatcctaatggaactggttatgctcttagttctgtggagggtcgtgtagcaatggagttttttgacctctcggaaactggtcaatccaaaaaatacgcattcaaatgtcaccggaaatctgaggctggaagggacattgtctaccctgtaaatgccattgcatttcacccaatctatggtacttttgccactgggggttgtgatggatttgtcaatgtatgggacggcaacaacaaaaagaggttgtatcagtacgcaaaatacccaacaagcattgcagccttgtcttttagtagagatgggagattgttggccgttgcatctagctacacatttgaagagggagataaatcccatgaaccagatgccatatttgtccgcagcgtaaatgaagttgaagtgaagccaaagccaaaagtgttaccctaatcctgctgcatgaaggactattggcaaacatgaaagcgcctagtccttacatagtagtaattcttttcttttttattagttaatctgttacataggagcttggacattaagaacttgtattttactggaatagtatgc

SEQ ID NO: 911 - DNA, 1303 bp, Musa acuminata
tccctccgatttccggccgctatgagcgccgccactcttccggccaccggcgggagggagctctccgacccaccctccgatggcatctccaacctccgcttctccaaccacagcgacctcctcctcgtctcgtcgtgggacaggagtcttcgtctttacgatgccggcgcggacgctctcaagggggagttcgcgcatgttggccctgtcctcgattgctgcttccatgacgattcatcgggctttagtgcctgtgccgaccatatggtcagaaggtttgtctttggttctggcaaggaggatattttaggacgccatgatgctcctgtccgttgtgttgaatactcttatgcaacaggccaagtaattactggaagttgggacaagacactgaaatgctgggatcctagaggtgcaagcggcccagaccatgcacttgttgggacatatccacaacctgaacgagtgtattctctttccttagttggtcatcgtttagtagttgctactgcaggaaggcatgtgaatgtctatgatttgcgcaatatgtctcaaccagaacaacgaagggaatcatcattaaaatatcaaactagatgtgttcgttgctatcccaatggcacaggttttgctcttagttctgtcgaaggtcgagtagctatggagtttttcgatctatcagaggctgctcaagcgaagaagtatgcattcaagtgccaccgtaaatcggaggctgggagggacactgtttatcctgtcaatgcaattgcgttccatccaatctatgggacatttgctactggaggttgtgatggttacgttaatgtttgggatggcaacaataagaaaagactttatcagtattcaaaatacccgacaagcattgctgcattatccttcagcagagatggccgtcagcttgctgtggcatctagctacacatttgaggagggtgacacacttcatgagcctgataccatctttgtccggaatgtaaatgaagtagaagtcaagccaaagcccaaggctttacctgcaccacctccataactatagttcttgcagcaaggaaattgcaccttgaatggatatttggagtgatggttctgcctgcgtcagctgctgtcctttgaatggttactaagctactatgaatacgaaaaatcttgtaaggaaaccaaaacttgtgatttctttcttttcttttcttttctttttttcttcaggcagtgttcgagagaccattttccttgatcatcttgttgtagctatctggataatgattgtcattatgttgctggtt

SEQ ID NO: 912 - DNA, 1462 bp, Brassica rapa
acttcgcttacagatttgaattcaaacagtcagataaaattcaaaattgattcttttttttctttttttttattttataaaataaagttgaaatagatcttattcgagatttgttcctttcgcaaaaatagttacttcgatttcaaaactcaaaacccctctctctctctctccccccgaaaccctagaatttgtgaacttcaacgggaggaagagtatgagtcagcctcctccgtccgccggtcgtgagctcgcgaatcctccgtccgacggcatctccaatctcagattttccaacacgagcgaccatctcctcgtttcttcatgggataagcgtgtgagattgtacgatgtgagcaccaattcgttgaaaggagagttcttacacggcggcgctgttctcgattgctgtttccacgacgattcctctggtttcagcgttggcagcgacaacaaagtcagacggattgttttcaatgttggcaaagaggatgttttggggatgcatgaaaagcctgtgcgttgtgttgagtattcttatgctgcagggcaagtgattacgggatcatgggacaaaacagttaagtgttgggatccaagaggtgcaagtggacctgagcggactcaggtggggacatacttgcaaccagagcgtgtttactctctgtctcttgttggaaaccgtctcgttgtggcaacagcaggaaggcacgtcaacatctacgatctcaggaatatgtctcagcctgagcaaagaagggagtcttcactcaaataccagacgagatgtgttcgtagttatcctaatggaacaggttatgctcttagctctgttgaaggaagagttgcgatggagttctttgatctgtcagaggctgctcaggctaagaaatatgctttcaaatgtcatcggaaatcagaggctggaagagacattgtttaccctgtgaatgccattgctttccatccaatttatggcacatttgcaacgggaggctgtgatggttttgtcaacatatgggatgggaacaacaagaagaggctgtatcagtactcaaaatatccatcaagcatcgcagcactgtcattcagccgagatggtcagctgctagctgttgcatcaagctacacatttgaagagggggaaaaatcgcacgagccagaagccatctttgtaagaaacgtcaatgaaatcgaagtgaagcccaaacccaaggcatatccaaatcctgcggcatagtaaggaagaaacagaatcatcatcctcaacacaagttggtattgtctttgctaagagtgtcccaaagattgaggaactacgtttgagctttttaatcttttcgtttgagtgtataaagtagaagtaaatacttaatacaatactttgtagttcttttggctttaaggacatattattacctaagagatattagattaatgccaaagaaatatagtaaaacaa

SEQ ID NO: 913 - DNA, 1401 bp, Castanea mollissima
ttcaaaaccaccttccctctctctgtcttccaaaaccctaaaactctcactctcactgtctttcacacacagagagtgatagacaagcaggcaatatcgccgatgacagctgtcccagcgccgacaccggggcgcgagctctcgaatccgccgtccgacggcatttccaaccttcgcttctccaaccacagcgatcatctcctcgtctcctcatgggataagagcgttcgactctatgacgcgagcgccaacgcgctccgcggtgagttcatgcacggcggtcccgtactcgactgttgcttccacgacgattcctctggtttcagtgccggcgccgataacactgttaggcggcttgttttcagctacaataaggaagatattttgggaaggcatgatgcacctgtgcgttgtattgaatactcttatgcagcagggcaactaatcacgggtagttgggacaaaactctgaagtgttgggatcctagaggagcaagtgggcaggagcgcactcttgttggaacatacccacagccggagcgtgtttactcactttctcttgttggacatcgtttagttgtagcaactgccggaagacatgtaaatgtctatgatttgagaaacatgtctcaacctgaacagcgaagggaatcctcattaaaataccaaactagatgtgtgcgctgttatcccaatggaacgggatatgcgcttagttctgttgaaggccgagtagcaatggaattttttgatccttccgagtctagtcaagccaaaaagtatgcatttaaatgtcatagaaaatcagaggctggaagggacattgtctacccagtaaatgccatagcattccaccctgtatatggtacatttgcaactggaggttgtgatggttatgtgaatgtgtgggatggaaataacaagaagaggctgtatcagtactcaaaatatccaacaagtgttgcagcgctgtcatttagcagggatggccgcctgttggcggtggcatcaagttacacatttgaagagggagataaacctcatgaaccagatgctatctacgttcgcagcgtaaatgaaatagaggtcaagcctaagccaaaagtgtaccctaatactcccgcgtaacttgcagtgtagaatctcctagttacatagtagtctggacatatttttatttttattttttagtattctgtgatgcttcagttcttcctaatgaagcttgtgaaaacttgattcagaaactgatgttgtaaggagttgagctatcttttagcttcatattcttaccaagttctgaaaagaaaaaaaaaagggtccatttgtttgtttttgtaacattctaatagatagatactggtgcacaagttggatgtgttaagatgctatgaaatccca

SEQ ID NO: 914 - DNA, 1430 bp, Quercus alba
ccgaaatcatacaaatcaaaatcccatctcactgtttttattgttactcttatattttcaaaaccaccttccctctctctctcttccaaaaccctaaaactcacactctcacacacacacagtgagtgatagacttgtgaagtaggcaatatcgccgatgacagctgtcccagcgccgacgccggggcgcgagctctcgaatccgccgtccgacggcatttccaacctccgcttctccaaccacagcgatcatctcctcgtctcctcctgggataagagcgttcgactctacgacgcgagcgccaacgcgctccgcggcgagttcatgcacggcggtcccgtactggactgttgcttccacgacgactcttctggtttcagtgccggcgccgataacactgttaggcggcttgttttcagctacaataaggaagatattttgggaaggcatgatgcacctgtgcgttgtattgaatactcttatgcagcagggcaactaatcacgggtagttgggacaaaactctgaagtgttgggatcctagaggagcaagcgggcaggagcgcactcttgttgggacatacccacagccggagcgtgtttactcgctttctcttgttggacatcgtttagttgtagcaactgctggaagacatgtaaatgtctatgatttgagaaacatgtctcaacctgaacagcgaagggaatcttcattaaaataccaaactagatgtgtgcgctgttatcccaatggaacaggatatgcgcttagttctgttgaaggccgagtagcaatggaattttttgatccttcagagtctagtcaagccaaaaagtatgcatttaaatgtcatagaaaatcagaggctggaagggacattgtctacccagtaaatgccatagcattccaccctgtatatggtacatttgcaactggaggttgtgatggttatgtgaatgtgtgggatgggaataacaagaagaggctgtatcagtactcaaaatatccgacaagtgttgcagcactgtcatttagcagggatggccgcctgttggcagtggcatcgagttacacatttgaagagggagataaacctcatgaaccagatgctatctacgttcgcagcgtgaatgaaatagaggtcaagcctaagccaaaagtgtaccctaatactcccgcataacttgctgtgtagaatctccttgttacatagtagtctggacatatttttatttttattttttagtattctgtgatgcttcagttcttcctaatgaagcttgtgaaaacttgattcagaaactgatgtcttaaggagatgagctatcttttaacttcatattcttaccaagttctgaaatcaagaaaatgccgagacttgtcggatattttgaaattacaactggcaaacaaccaaattgaaattcatt

SEQ ID NO: 915 - DNA, 1449 bp, Solanum lycopersicum
tactccctatctggcccccatttgaattcaaattctggaagcattcatctgacctttttttcatttttcaaaatctctctctctccccttctccctccactctctgtgaaaccctagtcactccatacgctcccacatcctgtacttaactcagaaatcaatcattttaagcgaacgacggcgatatcatgacggcggtgtcgcaatctgccggaagagagctcgaaaacccgcccaaggacggcatatccaacctccgcttctccaaccacagcgatcacctccttgtttcttcttgggataagacggtccgtttgtacgatgcaagtgctaatgccttgagaggggagttcatgcacggtggtgcagtgcttgattgttgcttccacgatgattcatctggattcagtgccagtgctgataataccgttagaaggcttgtgttcaactctggaagagaggatatattgggaaggcatgatgcaccagttcgctgcattgattactcatatgcaactggacaagtgataactggtagctgggacaaaaccttgaaatgctgggatcctagaggtgcaagtggacaggagcatactcttgttggaacttatacacaaccagagcgtgtgtactctctctcccttgttgggaaccggttagttgtagcaactgctggaagacatgtgaatgtctatgacctgcggaacatgaatcaacctgaacagcggagggaatcatccttgaagtatcaaactagatgtgtgcggtgttatcctaatggaacaggctatgctctaagttcagttgaaggtcgggttgcaatggaattttttgatctttctgagtccggtcaatcgaagaaatatgcatttaaatgtcatcggaaatctgaagctggaagagatatcgtgtaccctgtaaatgcaattgcatttcaccctatctatggtactttcgccactggtggttgtgatggttatgttaatgtctgggatggtaacaacaaaaagaggctgtatcagtaccctaagtatccttcaagcgttgccgcgttgtcatttagcagagatggtaaactcttggctgtagcatcaagttatacatttgaagagggagaaaagcctcatgagccggatgccatatttgtccgcagtgtaaatgaagttgaagtgaagccaaagccaaaagttttgccaaatcctacctcataaaaactagaaatcctcctccatcttctgtgtgttgaacttgttatcatatattgaaaacaaaaaatattttatctacttcatatgccagtttgaattccaggactccaattccctcgactggaaatgttaaagaacagttggaaatttgtaattatccacttagcaattgtaccttctttatgacattccgcagcctcattttctgaagatagtgcaatagcatggttgcctttttttc

SEQ ID NO: 916 - DNA, 1330 bp, Fagus grandifolia
gcccaatagcgcaatgaccgctgtcccgacgccgaccccaggccgcgagctctccaatccgccttcagacggcatttccaacctccgcttctccaaccacagcgatcacctgctcgtctcctcatgggacaagagcgtccgactgtacgacgccagcgccaacgcgctccgaggcgagttcatgcacggcggtcccgttctcgactgttgcttccacgacgattcctcagggttcagtgccggcgccgatcacaccgtccggcggcttgttttcagctctaataaggaggatattttgggaaggcatgatgcacctgtgcgttgtattgaatactcttatgcagcagggcaactatcacgggtagttgggacaaaaccctgaagtgttgggatcctagaggtgcaagtgggcaggagcgcactcttgttgggacatatccacaaccagagcgtgtttactcactctctcttgttggacatcgtttagttgtagcaactgcaggaagacatgtaaatgtctatgatttgagaaatatgtcgcaacctgaacagcgaagggaatcttcattgaaatatcaaactagatgtgtgcgctgttatcccaatgggacaggatatgctcttagttctgtcgaaggaagagtggcaatggaatttttgatctttcagagtctagtcaagccaaaaagtatgcatttaaaagtcatagaaaatcagaggctggaagggacattgtctacccagtaaatagcatagcattccacccagtctatggtacatttgcaactggtggttgtgatggttatgtgaatgtgtgggatgggaataacaagaagaggctgtatcagtactcaaaatatccgacaagcattgcagcgctttcatttagcagagatggccgcctgttggcggtggggtcgagttacacatttgaagagggagataaacctcatgaaccagatactatctacgttcgcagcgtaaatgaaattgaggtcaagccaaagccgaaagcgtaccctaatcctcctgcataacttgaaatgtagaatctcctctttgctctttgttacatagtagtctggacattattttttatttttagtgttgttctgtgatgcttcaatttctttctaatgaagcttttgaaactcgattcagcaactgatgtccaagtaaggagatgattcctctttagcttcatatccttgccaagttctgaaatagaaaatctgggctatttatttactcttgtaacattcataatagatagccaatggtgcacaagttggatatgtgagatatatgaaatccataccgaattaccgat

SEQ ID NO: 917 - DNA, 1330 bp, Sarracenia psittacina
cattttcaaaacacactccctccctctctttctcccccccttccgttcctctcccactacctgaaaccctaatcaccaccgtatatctcgttgttgcctttcccaaaacgatattccacaccgaaaaagacaaaatcatggcggctgtgccacaggtcgccgggcgggagctctcgaagccgccgtccgacggtatatcgaatctccgcttctccaaccacagcgatcacctcctcgtttcgtcttgggacaagagtgttcgattgtacgacgcgagtgccaatgtattgagaggagagttcatgcacggaggtcctgtcttggattgttgcttccacgacgattcatcggggttcagtgcttgtgtagatagtagcgtgaggaggcttgttttcggcttaggcaaggaggatattttgggaaggcatgatgcacctgtgcgctgtattgaatattcgtatgcaacagggcaagtgatcactggtagttgggacaaaacactaaaatgttgggatcctagaggtgcaagtgggcaggagcgcactcttgttgggacatacacacagcctgagcgtgtctattctttgtctctttttggcaatcgtttagttgcagcaactgcaggaaggcatgttaatgtttatgatttacggaatatgtctcaacctgagcagcgaagagagtcttcattgaaataccaaaccagatgcgtacggtgttatcccaatggacaggttatgctcttagttctgtggaaggtcgggttgcaatggaattttttgatctttctgagtctggtcaatccaagaaatacgctttcaagtgtcatcgaaagtcagaagctggaagggacattgtttaccctgtaaatgccattgcatttcaccccatctatggtacatttgcaactggaggatgtgatggttatgtgaatgtctgggatggcaacaataagaaaaggttatatcagtactcaaaatacccaacaagcattgcggccttatcattcagcagagatggtcgattgttggccgtggcatccagttatacatttgaagagggagagaaacttcatgaaccagatgctatctttgttcgaagcgtaaatgaagttgaagtgaagccaaagccaaaagtgtaccccaatcctacctcataagttctaaattgcagatggctctcttccttcttcttctatagtacttttggacgtgtttgtgtttactattaaactgcaaagcttcattggaaaaatgaagctttcccaaacccaaaaaatgcatacttgtcaccggttcaaacttagatgcgctcattttgttagtagctt

SEQ ID NO: 918 - DNA, 1419 bp, Phaseolus coccineus
ttttcaaatttcaaccaatcccagacatggcatctgcggttcccgccgcgacggggcgagagttgtcgaatcctccatcggacggcataaccaatctccgattctcaaaccacagcgataatctcttggtctcctcatgggacaagagtgtgcgcctgtatgatgccagcgccaatgtcttgagaggagagttcatgcacgctggtcccgttctcgattgctgcttccacgacgattcctccggtttcagtgcctccgccgacaacactgttagacggcttttcttcagctccaataaagaggatattttggggaggcacgatgcacctgttcgttgtgttgagtattcgtatgctgcaggccaattgatcacaggtagttgggacaaaaccctgaaatgctgggaccctagaggcgccagtgggcaggagcgcacactagttgggacatatccgcaacctgagcgtgtgtactctctctcactggttggacatcgcctggttgtagcaacagctggaagacatgttaatatctatgatttgagaaacatgtctcaacctgagcaaaagagagaatcttcattaaaatatcaaaccagatgtgttcgctgttaccctaatggaacaggatatgcacttagttctgttgagggccgggttgcaatggaattctttgacctctcagaagctagccaagcaaaaaaatatgctttcaagtgtcacagaaaatcggaagctggaagggacatagtctatcctgtaaatgcaattgcattccaccccatatatggcacatttgccacgggaggttgtgatgggtatgttaacgtatgggacggaaacaataagaagaggctataccagtactcaaaatatccaactagcgttgccgcactctcgtttagcagagatggacgcttgttggctgttgcctcaagttacacattcgaagaaggacctaaaagcaacgaaccagatgctattttcgttcgtagtgtaaacgagattgaggtgaagccaaagcccaaagtctatcccaatcctccagcgtgattcctgatggccattttgaaaagaagaatttcttcgggttttttttttcatttctactgttgcacttcttccaagtaaacaccaaaaactaaatgtaaaatgttgtgaaacgctagcttattgttgggtacaggtcactgtcaatatgctttcctattgagatgtctttattcccgttaaaagtaaatggaaattgataaacacccttaagtcggctcaggtgcaaaatatgaatttgagtgtgcaggtttgttctctaacaatggactttgctacttttcatttttttattccctccttttttcttggtatatctactgcagtctttcttgaatgataaaaataaaataaaatgaccctgactagt

SEQ ID NO: 919 - DNA, 1505 bp, Lactuca sativa
cgagtgcccgactgaattctggaactcaaaccgaaaaatattccccaaaatttgaatttaaaaccctcaagattcgaatctaacaaaaaatttgaaactttagtttaaaatcccaatccctcctctttctcaacacataccagagctccatctgaaccctagataattaactccgatcagcaaattgaaatggcagtggcgccaccggtcaccggcaaggaactaataaatcctccgtctgacggtatctccaacctccgattctctcatcactccgatcacctacttgtgtcttcttgggacaaaactgttcgattatatgatgcaagtgagaacgtattgagaggagagtttacacatggaggtgcagttcttgattgctgctttcatgatgataattctggtttcagtgcaagtgctgataatactgtcaggagacttgttttcaacaatgagagggaagatgttcttggacgccatgatgcccctgttcgatgcattgaatactcttatgcaacagggcaagtgattacaggtagttgggataaaaccctgaaatgttgggatccaagaggtgctactagtgcacaagagcgtgctctagtgggaacatatgctcaacctgaacgtgtctattctttatctcttgttggaaatcgtgtagttgttgcaactgctggaagacatgttaatgtttatgatttgaggaatatgtctcaacctgaacaacaaagggaatcttcattgaaatatcaaacaagatgtgtccgatgttatcccaatggaacaggttatgctcttagctctgtagaaggtcgagttgcaatggagttttttgacctttcgccagctggccaatcaaaaaaatatgcattcaaatgtcacagaaaatcagaagctggaagagacattgtttaccctgtaaacgccattgcatttcaccccgtctatgggacatttgcaacaggaggttgtgatggttttgtcaatgtatgggatggaaacaacaaaaagaggctctatcagtattcaaagtaccctacaagcattgcggctttatcatttagcagagatggtcgactattggctgttgcatcaagttatacatttgaagagggggagaaaccacatgaaccggatgctatatttgttcgtagtgtgaatgaagttgaagtgaagcctaaacctaagcaatacccaaatcctgccacgtaagtggaaaaaaacattacaaaaaggttggtttgttaaatactaggtttaaatatgtttttagttactatctactaaggttgtttccttgtttgaatgttaactagtcatcctattgagcaaattatatttgcaaaatgatggtgaagtgcatttataatataaagctattaactatggttgatgtttgtgtgaaattgcttatgtaagtttgggattgtgtatgatgctatgcatctatggaagaattagaatttttttaaagtattgaattgagagatggaataaaattt

SEQ ID NO: 920 - DNA, 1509 bp, Phaseolus coccineus
ggttttgttttttgaaatttgattaggtcacccgcttctcgctgcgttggtctattcaattttgaatcttccccttcccacccccaaaacttttcaaatttcaaccaatcccagacatggcatctgcggttcccgccgcgacggggcgagagttgtcgaatcctccatcggacggaataaccaatctccgattctcaaatcacagcgataatctcttggtttcctcatgggacaagagtgtgcgcctgtatgatgccagcgccaatgtgttgagaggagagtttatgcacgctggccccgttctcgattgctgcttccacgacgattcctccggtttcagtgcctccgccgacaacactgttagacggcttttcttcagctccaataaagaggatattttggggaggcacgatgcacctgttcgttgtgttgagtattcgtatgctgcaggccaattgatcacaggtagttgggacaaaaccctgaaatgctgggaccctagaggcgccagtgggcaggagcgcacactagttgggacatatccgcaacctgagcgtgtgtactctctctcactggttggacatcgcctggttgtagcaacagctggaagacatgttaatatctatgatttgagaaacatgtctcaacctgagcaaaagagagaatcttcattaaaatatcaaaccagatgtgttcgctgttaccctaatggaacaggatatgcacttagttctgttgagggccgggttgcaatggaattctttgacctctcagaagctagccaagcaaaaaaatatgctttcaagtgtcacagaaaatcggaagctggaagggacatagtctatcctgtaaatgcaattgcattccaccccatatatggcacatttgccacgggaggttgtgatgggtatgttaacgtatgggacggaaacaataagaagaggctataccagtactcaaaatatccaactagcgttgccgcactctcgtttagcagagatggacgcttgttggctgttgcctcaagttacacattcgaagaaggacctaaaagcaacgaaccagatgctattttcgttcgtagtgtaaacgagattgaggtgaagccaaagcccaaagtctatcccaatcctccagcgtgattcctgatggccattttgaaaagaagaatttcttcgggttttttttttcatttctactgttgcacttcttccaagtaaacaccaaaaactaaatgtaaaatgttgtgaaacgctagcttattgttgggtacaggtcactgtcaatatgctttcctattgagatgtctttattcccgttaaaagtaaatggaaattgataaacacccttaagtcggctcaggtgcaaaatatgaatttgagtgtgcaggtttgttctctaacaatggactttgctacttttcatttttttattccctccttttttcttggtatatctactgcagtctttcttgaatgataaaaataaaataaaatgaccctgactagt

SEQ ID NO: 921 - DNA, 1257 bp, Vigna unguiculata
ggaggtcacccgctcccagtgttttagtaacttacttggctgcactcttgtatccaattttgaatcttcccttcccaccccaaacttttcaaatttcaacaaatcccagacatggcttctgcggttcccgccgcgacggggcgagagttgtcgaatcctccatcggacggaataaccaatctccgattctcaaatcacagcgaccatctcttggtctcctcatgggacaagagtgtgcggctgtatgatgcgagcgccaatgtgttgagaggagagttcatgcacgctggtcctgtgctcgattgttgcttccacgacgattcctccggtttcagtgccgcagccgacaacactgttagacggcttgtcttcagctccaataaagaggatattctggggaggcatgatgcccctgttcgttgtgttgagtactcgtatgctgcaggccaactgatcactggtagttgggacaaaacgctgaaatgctgggaccctagaggcgccagtggacaggagcgcacactagttgggacatatccacaacctgagcgtgtgtactctctctcactggttggacatcgtctggttgtagcaacggctggaagacatgtcaatatctatgatttgaggaacatgtctcaacctgagcaaaagagagaatcttcattgaaatatcaaaccagatgtgttcgctgttatcctaatggaacaggatatgcacttagttctgttgagggccgggttgcaatggaattctttgacctctcagaggctagccaagcgaaaaaatatgctttcaagtgtcacagaaaatcggaagctggaagggacatagtctatcctgtaaatgcaattgcattccaccccatatatggcacatttgccacgggaggttgtgatgggtatgttaacgtatgggacggaaacaataagaagaggctataccagtactctaaatatccaactagcgttgccgcactttcgtttagcagagatggacgcctgttagctgttgcatcaagttacacattcgaagaaggacctaaaagcaacgaatcagatgctattttcgttcgtagtgtaaacgagattgaggtgaagccgaagcccaaagtctatcccaatcctccagcgtgattgattcctgagggccactgttttatttttttcttcatttctactgttgcacttcctcttagtgaacaccaaaaactaaatgtaaaatcgctagcttattgttgggtacgcatcactgtc

SEQ ID NO: 922 - DNA, 1258 bp, Vigna unguiculata
ggaggtcacccgctcccagtgttttagtaacttacttggctgcactcttgtatccaattttgaatcttcccttcccaccccaaacttttcaaatttcaacaaatcccagacatggcttctgcggttcccgccgcgacggggcgagagttgtcgaatcctccatcggacggaataaccaatctccgattctcaaatcacagcgaccatctcttggtctcctcatgggacaagagtgtgcggctgtatgatgcgagcgccaatgtgttgagaggagagttcatgcacgctggtcctgtgctcgattgttgcttccacgacgattcctccggtttcagtgccgcagccgacaacactgttagacggcttgtcttcagctccaataaagaggatattctggggaggcatgatgcccctgttcgttgtgttgagtactcgtatgctgcaggccaactgatcactggtagttgggacaaaacgctgaaatgctgggaccctagaggcgccagtggacaggagcgcacactagttgggacatatccacaacctgagcgtgtgtactctctctcactggttggacatcgtctggttgtagcaacggctggaagacatgtcaatatctatgatttgaggaacatgtctcaacctgagcaaaagagagaatcttcattgaaatatcaaaccagatgtgttcgctgttatcctaatggaacaggatatgcacttagttctgttgagggccgggttgcaatggaattctttgacctctcagaggctagccaagcgaaaaaatatgctttcaagtgtcacagaaaatcggaagctggaagggacatagtctatcctgtaaatgcaattgcattccaccccatatatggcacatttgccacgggaggttgtgatgggtatgttaacgtatgggacggaaacaataagaagaggctataccagtactctaaatatccaactagcgttgccgcactttcgtttagcagagatggacgcctgttagctgttgcatcaagttacacattcgaagaaggacctaaaagcaacgaatcagatgctattttcgttcgtagtgtaaacgagattgaggtgaagccgaagcccaaagtctatcccaatcctccagcgtgattgattcctgagggccactgttttatttttttcttcatttctactgttgcacttcctcttagtgaacaccaaaaactaaatgtaaaatcgctagcttattgttgggtacgcatcactgtca

SEQ ID NO: 923 - DNA, 1329 bp, Lactuca sativa
aactttagtttaaaatcccaatccctcctctttctcacacataccagagctccatctgaaccctagataattaactccgatcagcaaattgaaatggcagtggcgccaccggtcaccggcaaggaactaataaatcctccgtctgacggtatctccaacctccgattctctcatcactccgatcacctacttgtgtcttcttgggacaaaactgttcgattatatgatgcaagtgagaacgtattgagaggagagtttacacatggaggtgcagttcttgattgctgctttcatgatgataattctggtttcagtgcaagtgctgataatactgtcaggagacttgttttcaacaatgagagggaagatgttcttggacgccatgatgcccctgttcgatgcattgaatactcttatgcaacagggcaagtgattacaggtagttgggataaaaccctgaaatgttgggatccaagaggtgctactagtgcacaagagcgtgctctagtgggaacatatgctcaacctgaacgtgtctattctttatctcttgttggaaatcgtgtagttgttgcaactgctggaagacatgttaatgtttatgatttgaggaatatgtctcaacctgaacaacaaagggaatcttcattgaaatatcaaacaagatgtgtccgatgttatcccaatggaacaggttatgctcttagctctgtagaaggtcgagttgcaatggagttttttgacctttcgccagctggccaatcaaaaaaatatgcattcaaatgtcacagaaaatcagaagctggaagagacattgtttaccctgtaaacgccattgcatttcaccccgtctatgggacatttgcaacaggaggttgtgatggttttgtcaatgtatgggatggaaacaacaaaaagaggctctatcagtattcaaagtaccctacaagcattgcggctttatcatttagcagagatggtcgactattggctgttgcatcaagttatacatttgaagagggggagaaaccacatgaaccggatgctatatttgttcgtagtgtgaatgaagttgaagtgaagcctaaacctaagcaatacccaaatcctgccacgtaagtggaaaaaaaaacattacaaaaaggttggtttgttaaatactaggtttaaatatgtttttagttaccatgtactaaggttgtttccttgtttgaatgttaactagtcatcctattgagcaaaatatatttgcaaaatgatggtgaagtgcatttataatataaagctattacctaacagagacgacaaacaagaaaaaaattaaataaa

SEQ ID NO: 924 - DNA, 1817 bp, Populus trichocarpa
tgagttgtacagcgttgtataagctgcgtactgatctgtagttatctcgaagttataaaatggaatcaaactccgaaacaaaacaaaagaagcggaaaaacatggaagattgaaaaccgtgacgatcactattgatcaatccatctgtaagtagatcaccgttgcctgccccaatcttattttgaatttaaaaattcaaatccccctctctcctcctcaaaataatccaaaaaaaaaaaaacaacgggtgaaacttaaggtttacgctcctcgcattttcaaatctccttccccctttactctctctcaaaaccctaacactcagaacacccgctttctcacgctcttttgaatatccctccgtacaatcacgcgatgacagctgtcatcccgccaccgttctccggccgcgaactctcgaatccaccaacagacggtatctcgaaccttcgattctccaatcacagcgatctcctactcgtctcctcgtgggacaagactgtgagattatacgacgccagtgctaatgctttgagaggagagtttttgcacggtggtgccgtgcttgattgctgcttccacgacgattcctctgggttcagtgccagcggggacaataccgtgcgacggttggtttttaaccatggaaaggaggatattctgggaaggcacgatgcacctgttcgctgcatcgagtactcttatgcagcagggcaagtaatcactggtagctgggacaaaacactgaagtgctgggatcccagaggagctagtgggcaagagcgcactcttgttggcacatatccacaacctgagcgtgtttactccctgtctcttgttggaaatcgtttagttgtagctactgcaggaagacatgttaatgtctatgatctgcgaaatatgtctctacctgagcaaaggagagaatcctctctgaaatatcaaactcgatgtgtgcggtgctatcccaatggcacaggatatgctctcagttctgttgaaggacgagttgcaatggaattttttgatccttcagaggccagtcaagcaaaaaaatatgctttcaagtgtcatcgaaaatctgaggctggaagggacattgtctatcctgtaaatgccattgcttttcatcctgtctatggtacatttgcaactggaggttgtgatggttttgtgaacgtatgggatgggaacaacaaaaagagactatatcagtactcaaagtatccatcgagtgtcgccgcactttcatttagcagagatggtcgtctgttggctgtggcatcaagttacacttatgaagagggagataaaccccatgagccagatgctatctttgtacgaagtgtaaatgaaatagaagtgaagccaaagccgaaagcttaccccaaccccccagcataagtgagccttttgaaaaccactggtcactagaatcttggatgtgcaatatctcatggttttctaggcgtttttgtttcctatgaagctttcaaatcttgatgtgtgctaatgcttgaatcaaggtggatcacctttcagtgaccctgtagtttcatttctttttaagtgatcgtgtaggtctgtgcttagaactttggattctgtaattattcatctatctagtctcctagatataacaattgaatgtgaccatgcaacgcattcttatcattatgcaagagtagcagccaaggaacaagttctgtatgattatgttggatgtaatgtctagacagctcagtttcaatgaaatgataatccgaaggtattaccggtagttaagtgactgtttattttttttgttttaaaaatat

SEQ ID NO: 925 - DNA, 1138 bp, Mimulus guttatus
gatagcggcggacgccaccactcctcctcccgtactccgcccccttgtcaaaaaatctctaaatcttcagtttttacgcactacgctcagtgaattaagtgaatcatgtcggcggcgcctccacaaccaccggggagagagctgtcgaaccctccgacggacggcatttccaacctccgtttctccaatcacagcgaccaactcctcgtttcatcctgggacaagagtgttcgattgtacgatgcgagcgcaaatgcgcttatgggtgagttcatgcacggagcagccgtgctggattgttgcttccacgatgattcctcgggatttagtgcttgtgctgatcacactgttagaaggcttgtgtttaactacaacagagaggatattctgggtaggcacgatgcacccgttcgttgtgttgaatactcgtatgcaactggacaagtgatcactggtagttgggacaaaaccttgaagtgttgggacccacgaggtacaaacggccaggaacgctgtcttgtcggaacttacactcaacctgagaggatatattcaatgtcacttgttggaaaccgtttggtggttgctactgctggaagacatgtgaacgtgtatgatcttcgaaacatgtctcaacctgagcaaaggagggaatcttctctgaaataccaaactcggtgtgtcagatgttatcctaatgggacaggctatgctcttagttctgttgaaggaagggttgcaatggagttttttgatctctccgaggctgggcaaaccaaaaagtatgcattcaaatgtcatcggaaatcggaagcaggaacggatattgtccaccctgtgaatgcaattgcctttcaccctatctacggcacttttgcaacaggaggttgtgatggttatgttaacatgtgggacggaaataataagaagcgattgtatcagtattcgaagtacccaacaagcattgcagctctgtccttcagcagagacggtagacttttggccgttgcttcgagttatacgtacgaagagggagataaaccgcacgagccagatgccatatttgtgcgtagtgtgaacgaagtagaagttaagccaaagccaaaagtgcttcccagtcctgcaacatgagcaagac

SEQ ID NO: 926 - DNA, 1183 bp, Mimulus guttatus
gagagcggagtcataagtttggtgcctttgaatttgaattcccgatagcggcggacgccaccactcctcctcccgtactccgcccccttgtcaaaaaatctctaaatcttcagtttttacgcactacgctcagtgaattaagtgaatcatgtcggcggcgcctccacaaccaccggggagagagctgtcgaaccctccgacggacggcatttccaacctccgtttctccaatcacagcgaccaactcctcgtttcatcctgggacaagagtgttcgattgtacgatgcgagcgcaaatgcgcttatgggtgagttcatgcacggagcagccgtgctggattgttgcttccacgatgattcctcgggatttagtgcttgtgctgatcacactgttagaaggcttgtgtttaactacaacagagaggatattctgggtaggcacgatgcacccgttcgttgtgttgaatactcgtatgcaactggacaagtgatcactggtagttgggacaaaaccttgaagtgttgggacccacgaggtacaaacggccaggaacgctgtcttgtcggaacttacactcaacctgagaggatatattcaatgtcacttgttggaaaccgtttggtggttgctactgctggaagacatgtgaacgtgtatgatcttcgaaacatgtctcaacctgagcaaaggagggaatcttctctgaaataccaaactcggtgtgtcagatgttatcctaatgggacaggctatgctcttagttctgttgaaggaagggttgcaatggagttttttgatctctccgaggctgggcaaaccaaaaagtatgcattcaaatgtcatcggaaatcggaagcaggaacggatattgtccaccctgtgaatgcaattgcctttcaccctatctacggcacttttgcaacaggaggttgtgatggttatgttaacatgtgggacggaaataataagaagcgattgtatcagtattcgaagtacccaacaagcattgcagctctgtccttcagcagagacggtagacttttggccgttgcttcgagttatacgtacgaagagggagataaaccgcacgagccagatgccatatttgtgcgtagtgtgaacgaagtagaagttaagccaaagccaaaagtgcttcccagtcctgcaacatgagcaagactt

SEQ ID NO: 927 - DNA, 1676 bp, Populus trichocarpa
gaaaaacatggaagattgaaaaccgtgacgatcactattgatcaatccatctgtaagtagatcaccgttgcctgccccaatcttattttgaatttaaaaattcaaatccccctctctcctcctcaaaataatccaaaaaaaaaaaaacaacgggtgaaacttaaggtttacgctcctcgcattttcaaatctccttccccctttactctctctcaaaaccctaacactcagaacacccgctttctcacgctcttttgaatatccctccgtacaatcacgcgatgacagctgtcatcccgccaccgttctccggccgcgaactctcgaatccaccaacagacggtatctcgaaccttcgattctccaatcacagcgatctcctactcgtctcctcgtgggacaagactgtgagattatacgacgccagtgctaatgctttgagaggagagtttttgcacggtggtgccgtgcttgattgctgcttccacgacgattcctctgggttcagtgccagcggggacaataccgtgcgacggttggtttttaaccatggaaaggaggatattctgggaaggcacgatgcacctgttcgctgcatcgagtactcttatgcagcagggcaagtaatcactggtagctgggacaaaacactgaagtgctgggatcccagaggagctagtgggcaagagcgcactcttgttggcacatatccacaacctgagcgtgtttactccctgtctcttgttggaaatcgtttagttgtagctactgcaggaagacatgttaatgtctatgatctgcgaaatatgtctctacctgagcaaaggagagaatcctctctgaaatatcaaactcgatgtgtgcggtgctatcccaatggcacaggatatgctctcagttctgttgaaggacgagttgcaatggaattttttgatccttcagaggccagtcaagcaaaaaaatatgctttcaagtgtcatcgaaaatctgaggctggaagggacattgtctatcctgtaaatgccattgcttttcatcctgtctatggtacatttgcaactggaggttgtgatggttttgtgaacgtatgggatgggaacaacaaaaagagactatatcagtactcaaagtatccatcgagtgtcgccgcactttcatttagcagagatggtcgtctgttggctgtggcatcaagttacacttatgaagagggagataaaccccatgagccagatgctatctttgtacgaagtgtaaatgaaatagaagtgaagccaaagccgaaagcttaccccaaccccccagcataagtgagccttttgaaaaccactggtcactagaatcttggatgtgcactatctcatggttttctaggcgtttttgtttcctatgaagctttcaaatcttgatgtgtgctaatgcttgaatcaagcctgtagtttcatttctttttaagtgatcgtgtaggtctgtgcttagaactttggattctgtaattattcatctatctagtctcctagatataacaattgaatgcgaccatgcaacgcattcttatcattatgcaagagtagcagccaaggaacaagttttgtatgattatgttggatgtaatgtctagacagctcagtttcaatgaaatgataatccgaaggtattaccggtagttaagtgac

SEQ ID NO: 928 - DNA, 1074 bp, Populus trichocarpa
taaaatcacgcgatgacagctgtcatcccgccacaattctccggccgcgaactctcgaatcccccaaccgacgggatctcgaacctccgattctccaatcacagcgaccacctgctcgtctcctcatgggacaagactgtgagattatacgacgcgggtactaatgttttgcgaggagagtttatgcacggtggtgccgtgcttgattgctgcttccacgacgattcttccggtttcagtgccagcgccgacaacaccgtgcgacggttggtttttaactacgaaaaggaggacattttgggaaggcatgatgcgcatgttcgttgtgtcgagtactcttatgctgcagggcaagtaatcactggtagctgggacaaaacacttaagtgttgggatcctagaggagctagtgggcaagagcgcaccctcatcggcacatatctgcaacctgagcgtgtttactctctatctcttgttggaaatcgtttagtagtagctactgcaggaagacacgtcaatgtctatgatctacgaaatatgtctcaacctgagcaaaggagagaatcatctttgaaatatcaaactcgatgtgtgcgttgctaccccaatggcacaggatatgcactcagttctgttgaagggcgagtagcaatggagttttttgattcttcagaggccagtcaggcaaaaaaatatgcattcaagtgtcatcgaaagtcagaggctggaagagacattgtctatcccgtaaatgctattgctttccatcctgtctatggtacatttgcaactggaggttgtgatggtttcatcaacatatgggatgggaacaacaaaaagagactgtatcagtactcaaagtatccatcaagtattgcagcactttcatttagcagagatggcagtctattggctgtggcatcaagttacacatatgaagagggagataaaccgcatgagccagatgctatctttgtacgaagtgtgaatgaaatagaagtcaagccaaaaccaaaaccataccccaaccccccagcataacttagcctggtatcttggatatgcagtgtctta

SEQ ID NO: 929 - DNA, 1563 bp, Populus trichocarpa
tccccctcaaaaccctaacaatcaaaacaccggcttcctcgcgcttttttgaatctccgtcagtaaaatcacgcgatgacagctgtcatcccgccacaattctccggccgcgaactctcgaatcccccaaccgacgggatctcgaacctccgattctccaatcacagcgaccacctgctcgtctcctcatgggacaagactgtgagattatacgacgcgggtactaatgttttgcgaggagagtttatgcacggtggtgccgtgcttgattgctgcttccacgacgattcttccggtttcagtgccagcgccgacaacaccgtgcgacggttggtttttaactacgaaaaggaggacattttgggaaggcatgatgcgcatgttcgttgtgtcgagtactcttatgctgcagggcaagtaatcactggtagctgggacaaaacacttaagtgttgggatcctagaggagctagtgggcaagagcgcaccctcatcggcacatatctgcaacctgagcgtgtttactctctatctcttgttggaaatcgtttagtagtagctactgcaggaagacacgtcaatgtctatgatctacgaaatatgtctcaacctgagcaaaggagagaatcatctttgaaatatcaaactcgatgtgtgcgttgctaccccaatggcacaggatatgcactcagttctgttgaagggcgagtagcaatggagttttttgattcttcagaggccagtcaggcaaaaaaatatgcattcaagtgtcatcgaaagtcagaggctggaagagacattgtctatcccgtaaatgctattgctttccatcctgtctatggtacatttgcaactggaggttgtgatggtttcatcaacatatgggatgggaacaacaaaaagagactgtatcagtactcaaagtatccatcaagtattgcagcactttcatttagcagagatggcagtctattggctgtggcatcaagttacacatatgaagagggagataaaccgcatgagccagatgctatctttgtacgaagtgtgaatgaaatagaagtcaagccaaaaccaaaaccataccccaaccccccagcataacttagcctggtatcttggatatgcagtgtcttatggttttctaggctttattctttcctatgaagctctccaaacttgatgtgaactaatccttgaatcaagttggattgtccctgttgtctcatattattttaagtgatcatataggtttgtgctaagaactttggattctgtaagtattcgtctatctagtctcctagatatacaactgaatgtgaccgagcaactctttcttatcattatgcaagacttgcagctaagacgagtttaggatgagtttttttttttttttttgcaaggtctagaaagctctgtttaaatgaaatcagtgacaatctgataggaccaccggcacaaacactttaaatggaggctcgattgaccaggggaacaatctgtaaagagaactggataaaatttaaatgggtttttgctttctaatgttcatatggccttgtt

SEQ ID NO: 930 - DNA, 1443 bp, Solanum tuberosum
tctatctggcccccatttgaattcaaattctggaagcattcgtctaaccttttttcatttttcaaaatctctctctctccttctccctccactctctgtgaaaccctagtcactctatacgctcccatatcctctacttaacgctgaaatcaaccattttaagcgaacgacggcgatatcatgacggcggtgtcgcaatctgccggaagagagctcgaaaacccccccaaggacggcatatccaacctccgcttctccaaccacagtgatcacctcctagtttcttcttgggataagacggtccgtttgtacgatgcaagtgctaatgccttgagaggagagttcatgcacggaggtgcagtgcttgattgttgcttccacgatgattcatctggattcagtgccagtgctgataataccgttagaaggcttgtgttcaactctggaagagaggatatcttgggaaggcatgatgcacctgttcgctgcattgattactcatatgcaactggacaagtgataactggtagctgggacaaaaccttgaaatgctgggatcctagaggtgcaagtggacaggaacatactcttgttggaacttatacacaaccagagcgtgtttactctctctctcttgttgggaaccggttagttgtagcaactgctggaagacatgtgaatgtctatgacttgcggaacatgaatcaacctgaacagcggagggaatcatccttgaagtatcaaactagatgtgtgcggtgttatcccaatggaacaggctatgctctaagttcagttgaaggtcgggttgcaatggaattttttgatctttctgagtccggtcaatcgaagaaatatgcatttaaatgtcatcgtaaatctgaagctggaagagatatcgtgtaccctgtaaatgcgattgcatttcaccctatctatggtactttcgccactggcggttgtgatggttatgttaatgtctgggatggtaacaacaaaaagaggttgtatcagtaccctaagtatccttcaagtgttgccgcgttgtcatttagcagagatggtaaactcttggctgtagcatcaagttatacatttgaagagggagaaaagcctcatgagccggatgccatatatgtccgcagtgtaaatgaagttgaagtgaagccaaagccaaaagttttgccaaatcctacctcataaaaactagaaatcctcctccatcctttctatgtgttgaacttgttatcatatattgaaaacaaaaaaaagactttaactacttcatatgccagtttgattccaggactccattctcttgactggaaattttaaaaaacagttgaaaatttgtaattattcacttagcaattgtaccttttctatgacattccgcagtctcactctctaaagatagagcaatagcaaggttgcctttgtttc

SEQ ID NO: 931 - DNA, 1412 bp, Solanum phureja
tctatctggcccccatttgaattcaaattctggaagcattcgtctaaaccttttttcatttttcaaaatctctctctctttctccctccactctctgtgaaaccctagtcactctatacgctcccatatcctctacttaacgctgaaatcaaccattttaagcgaacgacggcgatatcatgacggcggtgtcgcaatctgccggaagagagctcgaaaacccccccaaggacggcatatccaacctccgcttctccaaccacagtgatcacctcctagtttcttcttgggataagacggtccgtttgtacgatgcaagtgctaatgccttgagaggagagttcatgcacggaggtgcagtgcttgattgttgcttccacgatgattcatctggattcagtgccagtgctgataataccgttagaaggcttgtgttcaactctggaagagaagatatcttgggaaggcatgatgcacctgttcgctgcattgattactcatatgcaactggacaagtgataactggtagctgggacaaaaccttgaaatgctgggatcctagaggtgcaagtggacaggaacatactcttgttggaacttatacacaaccagagcgtgtttactctctctctcttgttgggaaccggttagttgtagcaactgctggaagacatgtgaatgtctatgacttgcggaacatgaatcaacctgaacagcggagggaatcatccttgaagtatcaaactagatgtgtgcggtgttatcccaatggaacaggctatgctctaagttcagttgaaggtcgggttgcaatggaattttttgatctttctgagtccggtcaatcgaagaaatatgcatttaaatgtcatcggaaatctgaagctggaagagatatcgtgtacccagtaaatgcgattgcatttcaccctatctatggtactttcgccactggcggttgtgatggttatgttaatgtctgggatggtaacaacaaaaagaggttgtatcagtaccctaagtatccttcaagtgttgccgcattgtcatttagcagagatggtaaactcttggctgtagcatcaagttatacatttgaagagggagaaaagcctcatgaaccggatgccatatatgtccgcagtgtaaatgaagttgaagtgaagccaaagccaaaagttttgccaaatcctacctcataaaaactagaaatcctcctccatcctttctctgtgttgaacttgttatcatatattgaaaacgaaaaaaagactttatctacttcatatgccagtttgattccaggactccattctcttgactggaaattttaaaaaacagttgaaaatttgtaattattcacttagcaattgtaccttttctatgacattccgcagtctcattctctaaag

SEQ ID NO: 932 - DNA, 1462 bp, Fragaria vesca
gggatcatcattttgattccaaaaccttcaaccccgtctttttcaaaaccaccttccctctatctctctctctcacttcttcaaatttcaaaaaaccctaaccaccgtcgctgccgtcagccagtcccgcgatgacagctgtccctccgccgtcctccggccaagagctctccaacccgcccaccgacggcgtctccaacctccgcttctccaaccacagcgatcacctgctcgtctcctcttgggataggaccgtccgattgtacgacgccaccgccaatgtgctccgcggcgagttcagtcacggcagtcccgtcctcgattgctgcttccacgacgactcctccggcttcagcgccagcgccgacaacaccgtccgccgattcgtcttcaactcgaacaaggaagatataataggaaagcacgatgcgccggttcgctgcgttgagtactcgtatgccgcagggcaactgatcaccggtagttgggataagacactcaagtgttgggatcctagaggtgcaaatggacaagagcgtactcttattgggacttatcaacaaccggagcgtgtttattcgctttctctggtcggaaatcgtttagtggttgcaactgctggaagacatgtgaatgtctacgatttgagaaacatgtcacaacctgagcaacgaagggaatcttcattgaagtatcaaactcgatgcgtgcgctgctatcctaatggaacaggttatgctcttagttctgttgaaggacgggttgcaatggaattctttgatctctcagaggccagtcaaaccaaaaaatatgcattcaagtgtcatagaaaatcggaggccggaagagacattgtatatccagtaaatgcaattgcatttcaccccatatatggtacgtttgctaccggaggttgtgatggttatgtgaatgtatgggatgggaacaacaaaaagcggctatatcagtactccaagtatccaacaagcattgcagctctttcttttagcagagacggccgcctgttggctgtggcttcgagttacacttttgaggagggagaaaaacctcatgagccagatgcaatctttgttcgcaatgtcaatgagatagaggtcaagccaaagccaaaagtctaccctaatccgccggcataattgaagttgttgcagtaattgaagaagctgaaattgtagaattgtgcgcttcgttttagttactgataatgtatgaggtttgtttggcgctgtagggttcttatcatgtaatgctgaagtgccgatggtatactgagactttgccatctgcatacaaaaactcctcacactgttagaacttagaaactatgatacctatgtatcgtgatttatatgttttcatctacatagcaaatggcttggaatctcttccaagcaattgtttctcaaaccagcagagtttagtgacttggtgttgattctga

SEQ ID NO: 933 - DNA, 1338 bp, Vaccinium corymbosum
tcaccaccgcacctccccctaaccccactctgaaccctaaacagccatggcggctgtgccacctgtcgccggtcgagagctatccaaccctccctccgacggcataacgaatctccgcttctccaaccacagcgatcacctcctcgtttcttcttgggacaagagtgtgcgattgtacgacgcgagtgccgatgttttgagaggagagttcactcacggaggtcctgtgttggattgttgcttccatgacgattcttccgggttcagtgctagtgcggataatactgtcaggaggcttgttttcagcttaggcaaagaggatattctgggaaagcatgatgcacctgtgcgctgtattgaatattcttatgcaacaggtcaagtgatcactggtagttgggacaaaacgctgaaatgttgggatcctagaggagcaagtgggcaagagcgcacccttgttgggacatacacacaacctgagcgtgtctactctctgtctcttttttgccaaccgtttagtcgtagcaactgcaggaaggcatgttaatgtgtatgatttacggaacatgtctcaacctgagcagcgaagagagtcttcattgaaataccaaaccagatgtgtgcgctgttatcccaatggaacaggttatgctcttagttctgtggaaggtcgggttgcaatggaattttttgatctttctgaggctggtcagtccaaaaaagtacgcattcaagtgtcatcgaaagtctgaagccggaagggacattgtctacccagtaaatgctattgcatttcacccgatctatggtacattcgcaaccgggggttgtgatggttatgtcaacgtgtgggatggaaaccataaaaagaggttgtaccagtactcaaagtacccaactagcgttgctgccttgtccttcagcagagatggccgactgttggctgtggcatccagttatacctttgaagagggaaagaaacctcacgaaccagatgcaatatttgtccgaagtgtaaatgaagttgaagtgaagccaaagccaaaagcctaccccaatcctgccacataaatggttactgcagataatgtagtcggtagtactaggtttggacatgtttgtgtttatcatcgaaaattccaagcttcatttttctaatgaagctttcctaaatccgaaacatgtagaccgatcactagtacaaaagtagatgttcatttttccaagatctatgtgtattatagcgtcggtacttatttcttgaacagacccttgttttcataggatccggtggattcgttggtttcctgcatgtttaaaaattagcctcgtttgttt

SEQ ID NO: 934 - DNA, 1455 bp, Beta vulgaris
accctcctgcctctctaaacccctccactttctctctcctccccgctcgccggagatcccaaatgtcggcggtggcgcctccagtagtggggcgcgagctgttaaatccacccaccgacggagtcacgaaccttcgtttctccaaccacagtgatcatcttctcgtttcttcttgggataagacggttcgattgtacgatgcaagtgcgaatgtgcttcgtggagagttcaagcatggcggccctgtgcttgattgttgcttccatgacgactcctctggttttagtgccagtggtgattctactgttaggcggctggttttcaactctggaaaagaggatatcttggggaaacacgaagcgcatgtacgttgtgtggagtactcttatacaacagggcaagtaatatctggtagttgggataaaacactaaagtgttgggatcctagaggagcaagtgggcaggagcgtactcttgttgggacatatgctcaaccagaacgtgtttattctatgtctcttgttggtcacagagtagtagtagctactgcaggcagacatgtgaatgtctatgatttgagaaatatgtctcaacctgaacaaaggagggagtcttcattaaaatatcagactagatgtgtgcggtgttaccccaatggaacaggttatgctctgagctcggtggaaggtcgcgtagcaatggaatttttcgatctctctgaagctggtcaatcaaagaaatatgctttcaaatgccaccggaagtcagaggctggaagagatattgtttaccctgtaaatgccattgcctttcatccaatctacggaacatttgcaactggaggttgtgatggcattgtgaatgtgtgggatgggaacaacaagaagaggctttatcagtatgttaagtacccgacaagcatctctgcactgtcgtttagtaaagatggacgactcctggctgttgcatcaagttatacttatgaggagggcgaaaagcctcatgaacctgacgcgatattcattcgaagtgtgaatgaagttgaagtgaaaccaaagcctaaagtatatgctaatcctcctgcctgaatcagttaaaacagctttgcttggtctagtttagtgtttgatcctctaggtatagtatagctctacactggtttgcttcttgatgcccaagaagcgcatgtgaacaagatgtaaaaactgattgcagattctattgctagttgtttcattcctgttttcagaactgcattgcatgctatgattatgatgttgcatctctcctactcaatgtggctcccttagttattatgaaccgagtctcttgcttctcactcattttttaagaaccaattttgcctacaatgaagagcttttgaatgagctacgtaattttcctgtaaaactgtgaagagctttaggcaatttgaaaaaatcctctcgaccctaa

SEQ ID NO: 935 - DNA, 1406 bp, Glycine max
ggggggcgggggttgtgttttgaaaattgattaggtcacgcgcccttggggcatctatccatttttgaaccttcccttcccacccctcaactttcaaatttcaacaaaatcgcagacatggcatctgcagtgcccgcgacggggcgagagttgtcgaatcctccatcggacggcatcaccaatcttcgattctccaatcacagcgatcatctgttggtgtcctcatgggacaagagtgtccggttgtatgatgcgagtgcaaatgtgttgagaggagagtttatgcacgctggtcccgtcctcgattgttgcttccacgatgattcctccggcttcagtgtcgccgccgacaacactgttagaaggcttgtcttcagctctaacaaagaggatattctaggaaggcatgatgcacctgttcgttgtgttgagtactcatatgctgcagggcaattgatcactggtagttgggacaaaaccctgaaatgttgggaccctagaggtgcaagtggccaagagcgcacacttgttggaacatatccacagcctgagcgtgtgtactctctctcactggttggacatcgtctggttgtagcaacagctggaagacatgttaatatctatgatttgagaaacatgtctcaacctgaacaaagaagagaatcttctttaaaatatcaaaccagatgtgtgcgctgttaccctaatggaacaggatatgcacttagttctgttgagggccgggttgcaatggaattctttgacctctcagaggctagccaagcaaaaaaatatgctttcaagtgtcacaggaaatcagaagcaggaagggacattgtctatcctgtaaatgcaattgcattccaccccatatatggtacatttgccacgggaggttgtgacgggtatgttaacgtatgggacggaaacaataagaagaggctataccagtattcaaaatatccaactagcgttgcagctctttcgtttagcagagatggacgcctgttggctgttgcatcaagttacacattcgaagagggacctaaaagccaagaacaagatgctatcttcgttcgtagtgtaaatgagattgaggtcaagccgaaacccaaagtctatcccaaccctccagcatgactcctgatggccattttgaaaataggaatttcttcgtttattcatttctactgttgcactttctctttgtgaactccaaaaactacttgtaaaatgttgtgaagcgctaggtaaattgttggatacaggttgctgtcggaaatgactttcctattgtgtctttattcccgtcaaaagtaaactgaaattggtagacattatcagctcaggtgcaaaatatgaattgagtgtgctggtttctaacaatgcactttgattattttttt

SEQ ID NO: 936 - DNA, 1414 bp, Glycine max
agaaggggggcgggggttgtgttttgaaaattgattaggtcacgcgcccttggggcatctatccatttttgaaccttcccttcccacccctcaactttcaaatttcaacaaaatcgcagacatggcatctgcagtgcccgcgacggggcgagagttgtcgaatcctccatcggacggcatcaccaatcttcgattctccaatcacagcgatcatctgttggtgtcctcatgggacaagagtgtccggttgtatgatgcgagtgcaaatgtgttgagaggagagtttatgcacgctggtcccgtcctcgattgttgcttccacgatgattcctccggcttcagtgtcgccgccgacaacactgttagaaggcttgtcttcagctctaacaaagaggatattctaggaaggcatgatgcacctgttcgttgtgttgagtactcatatgctgcagggcaattgatcactggtagttgggacaaaaccctgaaatgttgggaccctagaggtgcaagtggccaagagcgcacacttgttggaacatatccacagcctgagcgtgtgtactctctctcactggttggacatcgtctggttgtagcaacagctggaagacatgttaatatctatgatttgagaaacatgtctcaacctgaacaaagaagagaatcttctttaaaatatcaaaccagatgtgtgcgctgttaccctaatggaacaggatatgcacttagttctgttgagggccgggttgcaatggaattctttgacctctcagaggctagccaagcaaaaaaatatgctttcaagtgtcacaggaaatcagaagcaggaagggacattgtctatcctgtaaatgcaattgcattccaccccatatatggtacatttgccacgggaggttgtgacgggtatgttaacgtatgggacggaaacaataagaagaggctataccagtattcaaaatatccaactagcgttgcagctctttcgtttagcagagatggacgcctgttggctgttgcatcaagttacacattcgaagagggacctaaaagccaagaacaagatgctatcttcgttcgtagtgtaaatgagattgaggtcaagccgaaacccaaagtctatcccaaccctccagcatgactcctgatggccattttgaaaataggaatttcttcgtttattcatttctactgttgcactttctctttgtgaactccaaaaactacttgtaaaatgttgtgaagcgctaggtaaattgttggatacaggttgctgtcggaaatgactttcctattgtgtctttattcccgtcaaaagtaaactgaaattggtagacattatcagctcaggtgcaaaatatgaattgagtgtgctggtttctaacaatgcactttgattatttttttcatt

SEQ ID NO: 937 - DNA, 1298 bp, Vigna unguiculata
ccccttcaactttcaaatttcaacaaattgcagacatggcttctgcggtggccgccgcggcggggctagagttgtcgaatcctccatcggacggaataaccaatctccgattttcaaatcacagcgataatctcttggtctcctcatgggacaagagtgtgagattgtatgatgcgagcgccaatgtgttgagaggagagttcaggcacgctggccccgttctcgattgttgcttccacgacgattcctccggtttcagtgtcgccgccgacaacactgttagacggcttttcttcagctctaataaagaggatatcctaggaaagcatgatgcgcctgttcgttgtgttgagtactcatatgctgcagggcaattgatcactggtagttgggacaaaaccctgaaatgctgggaccctagaggtgcgagtggccaagagcgcacactcgttgggacatatccacagcctgagcgtgtttactctctctctctggttggaaatcgcctggttgtagcaacagctggaagacatgttaatatctatgatttgaggaacatgtctcaacctgaacagaaaagagaatcttcattgaaatatcaaaccagatgtgtgcgctgttacccaaatggaacaggatatgcacttagttcagtggaagggcgtgtatcgatggaattcttcgacctctcagaagctatccaggcaaaaaaatatgctttcaagtgtcacagaaaatccgaggccggaagggacattgtctatcccgtaaatgcaatggcataccaccccatatatggaacgtttgccacaggtggttgtgacgggtatgttaacgtgtgggacggaaacaataagaaaaggctataccagtacatgaaatatcctaccagcattgctgcactgtcgtttagcagagatggacgcctgttggctgttgcatcaagttacacattcgaagaaggacctaaaagcaacgaatcagatgctatcttcgttcgtagtgtaaacgagattgaggtgaagccgaagcccaaagtctatcccaatgctccagcgtaattcctgatggccgtttcagaaacagggtttttttttatattatttctactgttgtaaacgccaaaaacaagtaaactgatagtttctgattttctagattttcttcaaattgtgcacttcgtgcaagtaggtatattgtatattgtaaagtatggtgcctcactcattttcaaatcatcactggaaagctttgtcccgatcatgtgacgttgcttagtcaatgacaaaattcaagtc

SEQ ID NO: 938 - DNA, 1322 bp, Vigna unguiculata
  misc_feature (22)..(22): n is a, c, g, or t
tctttaattcactttcacttcnaccccttcaactttcaaatttcaacaaattgcagacatggcttctgcggtggccgccgcggcggggctagagttgtcgaatcctccatcggacggaataaccaatctccgattttcaaatcacagcgataatctcttggtctcctcatgggacaagagtgtgagattgtatgatgcgagcgccaatgtgttgagaggagagttcaggcacgctggccccgttctcgattgttgcttccacgacgattcctccggtttcagtgtcgccgccgacaacactgttagacggcttttcttcagctctaataaagaggatatcctaggaaagcatgatgcgcctgttcgttgtgttgagtactcatatgctgcagggcaattgatcactggtagttgggacaaaaccctgaaatgctgggaccctagaggtgcgagtggccaagagcgcacactcgttgggacatatccacagcctgagcgtgtttactctctctctctggttggaaatcgcctggttgtagcaacagctggaagacatgttaatatctatgatttgaggaacatgtctcaacctgaacagaaaagagaatcttcattgaaatatcaaaccagatgtgtgcgctgttacccaaatggaacaggatatgcacttagttcagtggaagggcgtgtatcgatggaattcttcgacctctcagaagctatccaggcaaaaaaatatgctttcaagtgtcacagaaaatccgaggccggaagggacattgtctatcccgtaaatgcaatggcataccaccccatatatggaacgtttgccacaggtggttgtgacgggtatgttaacgtgtgggacggaaacaataagaaaaggctataccagtacatgaaatatcctaccagcattgctgcactgtcgtttagcagagatggacgcctgttggctgttgcatcaagttacacattcgaagaaggacctaaaagcaacgaatcagatgctatcttcgttcgtagtgtaaacgagattgaggtgaagccgaagcccaaagtctatcccaatgctccagcgtaattcctgatggccgtttcagaaacagggtttttttttatattatttctactgttgtaaacgccaaaaacaagtaaactgatagtttctgattttctagattttcttcaaattgtgcacttcgtgcaagtaggtatattgtatattgtaaagtatggtgcctcactcattttcaaatcatcactggaaagctttgtcccgatcatgtgacgttgcttagtcaatgacaaaattcaagtca

SEQ ID NO: 939 - DNA, 1418 bp, Medicago truncatula
agaaattgttgtgttttggaaaccctagattagatagataggtagtgagttgaacaatggcaacaacaacaacaacaacagtggtatcctccggtcgagaattaacaaaccctccgtcagacggaatctcaaacattcgattctcaaaccacagtgatcatcttcttgtctcctcttgggacaaaactgttcgtctttatgatgcaaccgcagattttcttagaggtgagttccttcacggcggacctgttcttgactgttgctttcatgatgactcttctggtttcagtgcctccgccgataacactgtcagacgcctcattttcgctaccggtaaagaggatattttgggaaagcatgatgctcctgttcgttgtgttgagtactcttacgccgcagggcaattgatcactggaagttgggacaaaaccataaaatgttgggaccctagaggtgcaagtggacaagagcgcactctagttgggacgtatgcacagcctgaacgtgtttactctctatctcttgttggacatcggcttgtagtagcaacagctggaagacacgttaatgtttatgacatgaggaacatgtcttgtcctgaacaacgaagggaatcttcattgaaatatcaaaccagatgtgtacgctgctacccaaatggaacaggatatgctcttagttctgttgaagggcgggttgcaatggaattctttgacctatctgaggctagccaggcaaagaaatacgctttcaagtgtcatagaaaatctgaagctggaagggatatcgtctatcctgtgaatgccatggcattccaccccatatatggtacatttgccacaggaggttgtgacggttttgttaacgtctgggacggaaacaacaaaaagaggctataccagtattcaaaatatcctagtagcgttgctgcactctcgtttagcagagatggacgcctcctagctgttgcatcaagttacacttttgaagagggacctaaaccccatgaccaagatgctatctacgttcgcagtgtgaacgagattgaagtcaagccaaaacccaaagcccttcccaatcctacagcgtgattcactggttcttgatagtaattttgaaaaatagaattttcttttattatattttactgtgtactttgttcacatctttggtgtgaacatctcaaggtagactaatattgtgaagcaccagcaaatttctagatacgtggtagttaacattttggcatttctattttatgcgtctgagtttaacttcactgtaaatatttgttgttgctatgttgtaaagacccagggtgtgtgactactatttctattgacatgcttctcgaaaaaaaaaagtcttagggactactccgttctattttaagcatcaaattagcaggagaaaaaaag

SEQ ID NO: 940 - DNA, 1358 bp, Eutrema parvulum
ttgaaacagatattctaccttcgttcctgtaatttgatttcaaaactcaaaacctactctctctctctctttgtatctccagcaaccctagcttttgtgatcttcaacgggaatatgactctgcctccgtccgctggtcgtgagctctcgaacccaccgtccgacggtatttcgaatctcagattttccaatacaagtgatcatcttctcgtttcttcatgggataagcgtgtgagattgtatgatgtgagcaccaattcgttgagaggagagttcttacacggcggcgcagtactcgattgctgtttccacgatgattcctctggtttcagtgtcggcggcgacaacaaagtcagacggattgttttcaatgttggcaaagaggacattttggggatgcatgataaaccagtgcgatgtgtggagtattcttatgctgcagggcaagtgatcactggatcttgggataaaacagttaaatgttgggatccaagaggtgcaagtgggccggaacgcacccaggtgggaacatacttgcaaccagaacgtgtttactctctgtctcttgttggaaaccgtctggttgtggcaacagcaggaaggcatgtaaacatctatgatctcaggaatatgtcccagcctgagcaaagaagggagtcttcactgaaatatcagacgagatgtgttcgtagttatcctaatggaacaggatatgctcttagctctgttgaaggaagggttgcaatggagtttttcgatctatcagaggctgctcaggctaagaaatatgctttcaaatgtcatcggaaatcagaggctggaagagacattgtttaccctgtaaatgccattgccttccatccaatttatggtacctttgcaaccggaggttgtgatggttttgtcaacatttgggatgggaacaacaagaagaggctgtatcagtactcaaagtatccttcaagtatcgcagcactgtcattcagtcgagatggtcagctactagctgttgcttcaagttacacatttgaagagggggagaaatcgcacgaaccggaagccatctttataagaaacgttaatgaaatcgaagtgaaacccaaacccaaagcacatccaaatcctgcagcttagtaaggacggaacagaagcaacctcatcacaagttggtttttgtctatgctaagtgtgtcccaaaagattgtgaatcaatcaaaagtatgtctgagcttctagtcttttttttttttggttgtataaagtagaagttaatacaatgctttgtagctcttttggctttgagaatatattattagtacctaagagattagattaaggggtaagaaatagtaaaatac

SEQ ID NO: 941 - DNA, 1416 bp, Euonymus alatus
ggaagtttccctctctccgaaaccctataacaattaacaagctattgcgctctctttcttctctctctctctactgtcacacggacgaatacttcctctctccgtgatctactacgatgacagctgctgcgccgccgctaggagccggcagggagctctcgaacccaccgactgatggaatctcgaacctccggttctcaaaccacagcgatcacctcctcgtctcctcctgggataagagtgtgagattgtatgacgcgagcgcaaatgtattgcggggagagttcttgcacggtgggccagtccttgactgctgcttccatgatgattcatctggcttcagtgctagctccgacaatactgtcagaagacttgttttcaaccatggcaaggaggatatattgggaaggcacaatgcacccgttcgctgtgtcgagtactcttacgccacagggcaagtgatcacaggcagttgggacaaaacgctgaagtgttgggatcccaggggtgcaagtggacaagagcgtacttttgttgggacatacccacaacctgagcgtgtttactctctctctcttgtaggacaccgtttagtggttgcaactgcaggaagacatgtaaatgtttatgatttgagaaacatgtctcagccagagcaacggagggaatcttcgttgaagtatcaaactcgaagtgtctgctgttatcctaacggtacaggatatgctctagttctgttgaaggtcgtgtggcaatggagtatttgatctttctgagccaactcaaagcaaaaaatatgcattcaagtgtcatcgaagatcagaggctggaagagacattgtttatccagtaaatgccattgcatttcaccccatctacggtacatttgcaacaggcggttgtgatggtttcgttaatgtgtgggatggaaacaacaagaagagactgtatcagtactctaagtacccgacaagcattgcagccctatcatttagtaaagatggtcgtctcttggctgtggcatcgagctacacatttgaagagggagacaaaccccatgaaccggattctatcttcgttcggagtgtgaatgaaatagaagtaaagccaaaaccaaaagtttatcccaatcctcctgcatgaatgtagttacgagatctggtttttgtctatagtcttttggacctgtaatatttatgactcggcagagcttcatgtctcttcaatgaagcgaattggaggctaaaagtatgaattggatgttagatatatgttcttgttttacttacccagttagctttttatctttgcaaaacagaagttatacttgtagcataataatggctcaatttgggataagacttggattatcttgatgattatgattatagtaaggctccttgtgggatttttcat

SEQ ID NO: 942 - DNA, 1336 bp, Eutrema halophilum
aatttgaaattcaaacgctcattttctgcaaatctactgacttctccctctctctctctccagcataaaccctaaaattcgatttgtgttcttcaggatgagtttggtaccgaccgttggtcgtgagctctcaaatccgccgtccgatgggatttcgaacctccggttttctaatagcagcgatcatctacttgtgtcctcatgggataagagtgtaagattgtatgatgcgaacgccgattcgatgagaggggagttcaagcatggcgggccggttctcgattgctgctttcatgacgattcttctggattcagtgtctgtggcgataataaagttagacgaatcgacttcaatgctggcaaagaggacattctcggaacgcatgataaaccagttcgatgtgttgagtattcttatgctgcagggcaagtgatcactggaagttgggataaaacaattaaatgctgggacccaagagctgcaagtgggcctgagcgcacacagattggaacatatcagcaacctgagcgtgtgaactctatttctcttgttgggaatcgtttggtagtggcaacagcaggaaggcatgtcaacatttatgatctcaggaatatgtcccagcctgagcaaagaagggagtcctcacttaagtaccagaccagatgtgtgcgttgttatcccaatggaacaggatacgcacttagctctgtggaagggagggtgtcaatggagttttttgatctatcagaggctgctcaagctaaaaaatatgctttcaaatgtcaccggaaatccgaggatggaagggacatcgtctaccctgtgaatgcgattgccttccatccgatttatggcacttttgctaccggaggttgtgatggttttgtcaacatatgggatggtaacaacaagaagaggctatatcagtactctaagtatccaacgagtattgcggcgctgtcattcagccgagatggtggactactggctgttgcttctagttacacatttgaagagggagacaaaccgcatgaaccagacgccatctttgtccgaaatgttaatgaaatcgaagtgaaaccgaaacctaaagcatacccaaatcctcctgtatagtcaggtcaggaactatagaatcagcagagttaactcgacttggtgttgtattggttgctacgtttgttgcgcaaagaagattattgtagcattctatgttttgagttttaaaaacttattttggctgtaaagtgaagtgtgaagaagaatacaatggctttagaagattatgttcctttggttttgagtaaagtccatttactcgctgatagtagaaaa

SEQ ID NO: 943 - DNA, 1281 bp, Eutrema parvulum
ctctctctctctctctctctctctccagcttaaaccctagaattcgattttgtgctcttaaagatgagtttggtacctgccgttggtcgcgagctctcgaatccgccgtccgacgggatttctaatcttcggttttccaatagcagcgatcatctactagtatcttcatgggataagagtgtaagattgtatgatgcgaccgccgattccatgagaggcgagttcaagcatggaggagcggtgctcgattgctgtttccatgacgagtcttctggattcagtgtctgttccgatcataaagttagacgaattgacttcaatgcgggcaaagaggacactctgggaacgcatgataaagcagtgcgttgtgttgagtattcttatgctgcagggcaagtgattactggaagttgggataaaacaattaaatgttgggacccaagagctgcaagtggtccggagcgtacagagattggaacatatcagcaacctgagcgtgtcaactccctttctctcgttggaaatcgtttggtagtggcaacagcaggaaggcatgtcaacatttatgatctcagaaatatgtcccagcctgagcaaaagagggagtcctcacttaagtaccagacaagatgtgtgcgttgctatcccaatggaacaggatatgcgcttagctctgttgaaggaagggtgtcaatggagtttttcgatctatcagaggctgctcaagctaaaaaatatgcttttaaatgtcaccggaaatcagaggatggaagggacattgtctatcctgtaaatgcgattgcctttcatccgatttatggcacttttgctaccggaggttgtgatggtttcgtcaacatttgggatggcaacaacaagaagaggctatatcagtactctaagtatccaacgagtattgcagctctgtctttcagccgagatggtggactactggctgttgcttctagctacacgtttgaagagggagacaaaccgcatgaaccagacgcaatctttgttcgaaatgttaatgaaatagaagtgaagccgaaacctaaagcatacccaaatcctcaggtatagtcaggaactatgaaatgagcagcgttattttgacttggtgttgtatcggttactacgttggtaactcgaacaagattatagcattttatgttttgagttcaaaaaacttatttggctgtaaagtgaagtaagcagtggctttagaatctgagattgttgtgctcctgtggttctgagtaaagtccatttaccctggtg

SEQ ID NO: 944 - DNA, 1446 bp, Gossypium hirsutum
gggacttggccgatccgaataaaaacatttctaaatttcaaatcttcttccctctctttatatcgctcacccagtgaagaaacattcatcgtctctcccaaaaccctaagctctctccgatctccgttagttcatttcatctctctagcagccaatcgagcgatgacatctgtccacccgccaccggtaccaggtcgcgagctctctaaccctccgacggacgggatctcgaaccttcggttctctaatcacagcgataatctactcgtctcttcatgggataagactgtgagattgtacgatgcaagcgcgaacgttttgcgaggagagttcatgcacggtgggccggtacttgattgttgcttccatgatgattcatctgggttcagtgctagcgctgacaataaagttaggaggataatgttcagccatggaaaggaggaaatattaggtagacatgatgctcctgtacgttgtatagagtattcttatgcagcaggacaagtgatcacaggcagttgggacaagacattgaaatgttgggatccaagaggtgcaagtgggcaggagcgtactcttgtcggcacatacccacaacctgaacgtgtttactcgctatctcttgttggaaatcgtttagtcgtggcaactgctggaagacatgtaaatgtatatgacttgcgaaacatgtctcaacctgaacagcgaagggaatcttcattgaagtatcaaactagatgtgtgagatgttatccaaatggaacagggtatgctcttagttcggttgaagggcgagtggcaatggagttctttgatctctcagaggccagtcaagccaaaaagtatgccttcaagtgccatcgaaaatctgaggctggacgggacattgtatatccagtaaatgccattgcattccatcctgtatatggtacatttgcaactggaggttgtgatggttttgttaatgtgtgggatggaaacaataagaagaggctgtatcagtattcaaagtacccaacaagcgttgccgctctttcattcagcagagatgggcgactattggccgttgcttcgagttacacattcgaagagggagataaagcacatgaaccagatgcaatctttgtacgtagcgtaaatgaaattgaagtcaagccaaaaccaaaggtatatcctaatcctccagcgtagctgattaagcatatttttatcttctatgtggtaattctagatgtttgagatgttaattgctttgtaaggcttgagtgaatggtctgaaccatgaaactaaactttttttaattcataggctagagagttttttttttctcacatcctctgtgaatttgttacaactagactctaatacccctttttcccactttctgttgaaaagtgtttacattgttttcaaatgttaacagtacttagaatctgttaaaaaag

SEQ ID NO: 945 - DNA, 1499 bp, Cycas rumphii
  misc_feature (446)..(446): n is a, c, g, or t
  misc_feature (732)..(732): n is a, c, g, or t
gcttaaatgcatatttcttgtttgctcggatctacaaggtcgtgtactgcagctccagacgaccttcggattcccctctgtcgccagcctttgtctccaatactgtatgttcgggcgtagtcgagtttgactgtggagccatagacgacgtctcgggattgtttctccgcgggtttggcattcattcgctgcagaatctcatagacaatcggtcctcctccaagaggatagccgggggatagtttggaccgtggggagggttttcaagggcacactgcagatttggccgtaagattttagggattgtcttagggtggaagggatgataggcgcagcaccagccgtcggcgccggctcaggtcgggagctgtcgaatcccccaaccgatggcatctccaatttgcgattttccaaccacagcgatcatcttcttgtgtcttcttggnactccaaagttcggttatatgatgcaagtgcaaatatactaaaagggcaattctcacatgggggtgctgtcttggattgctgctttcatgatgatgcctctggatttagtgggagtgctgactgcaccgtgaggaggtacgatttcagcacaggaaaggaagatatcttggggaggcatgaggctcctattcgttgtgttgagtattcgtatgcagcaggacaagtgattactgggagttgggacaagacattgaaatgctgggatcccagaggtgcaagtggacnggagagaacgcttgtggggacatatcctcaacctgagcgtgtgtattctatgtcactagttggtcaccggttggtggtagccacagctggcaggcgtgtaaatgtatatgatctgcgaaacatgtcacaacctgaacagcgaagggagtcctctttgaagtaccagaccagatgtgtccgctgttatccaaatggcacaggtttcgctctcagctctgtggagggccgtgttgctatggagttctttgatttatctgaggctggtcaagctaaaaaatatgcttttaaatgccatcgcaagtcagaagctggcagagatacagtgtatccagtgaatgctattgcattccatccaatctatggtacttttgcaacaggaggctgtgatggatatataaatgtgtgggatggcaacaacaagaagagattgtaccagttttcaaaatatcctaccagcattgcagctttatctttcagtagagatggtcgattgttggccgtggcgtcaagctatacatttgaggagggcgataaaccgcatgaaccagatgctattttcgtgcggagtattaacgaagcagaagtgaaaccaaagcccaaagcttatgttcctgctccttgaaagaacactcaatcttcatcacagatgaaaatgcatgttggaattggaattatttcctgatgttccagatggaatctctgcggattatttcaaattttaactagttagtttgccaaccgcggaatatgttttctcattgtggtgc

SEQ ID NO: 946 - DNA, 1379 bp, Cajanus cajan
ggtgagagtttggaagatataatccgtgattctgaattaaagtattaaacgccttttgtccgttgagttgaaatatttgaatatagggtttagggtttcacgtcaatggcatccgcgacggggcgagagttgtcgaatcctccgtcggacggcatcagcaacctgcggttctcgaatcacagcgatcacttacttgtgtcctcatgggacaagagcgtgcgtttgtacgatgccagcgccaatgtgttgagaggagagttcatgcactctggtcctgtcctcgattgctgcttccacgacgattcctccggcttcagtgccgccgccgacaacactgttagaaggctgttgttcagctccaataaagaggatattcttggaaggcatgatgcggctgtgagatgtattgagtactcatatgctgcaggtcaattgatcactggtagttgggacaaaaccctcaaatgttgggaccctagaggcgcaagtgcccaagaccgcacactcgttggaacatatccccagcctgagcgtgtttactccctctctctcgttggacaccgtctcgttgtagcaacagctggaagacatgttaacatctatgatttgaggaacatgtctcaacctgagcagagaagagaatcttcattgaaatatcaaaccagatctgtgcgctgttacccaaatggaactggatatgcacttagttctgttgaaggccgggttgccatggaattctttgacctctcagaggctagccaggcaaaaaaatatgcttttaagtgtcacagaaaatcagaggctggaagggacatcgtctatcctgtgaatgcaattgcattccaccccatatatggaacgtttgccacaggaggctgcgacgggtatgttaacgtgtgggacggaaacaataagaagaggctataccagtactccaaatatcctactagcattgcagcactttcgtttagtagagatggacgcctcttggctgttgcatcgagttacacattcgaagaagggcctaaagcccacgaacaagatgctatcttcgctcgcagtgtaaacgagattgaggtcaagccgaagcccaaagtctatgccaatcctccagcgtgattcctggtagccatttcgaaaatagggatttcttcaatttttcttggaagatttttcacttcacttcccctcttgtgaatgtcaaaaacatgtaaattacttatgtgaagcactagcttatttctagatacaagttgcggtcagaacagaaatagcctttgttcgtccagattttcttcaaattgtgcacttcgtacaagtatatctattgtaaagtataaattgaaattgataagccaaggacaatcttaagcgttgtg

SEQ ID NO: 947 - DNA, 1453 bp, Glycine max
ggggggtgggggtttgtgttttgaaaattgattaggtcacgcgcttcttccggaattagtcggtgtaatttacatttatccattttttgaaccttcccttcccaccccagaactttcaaatttcaacaaaatcgcagacatggcttctgcggtgcccgcgacggggcgagagttgtcgaatcctccattggacggcatcaccaatcttcgattctccaatcacagcgatcatctccttgtgtcctcatgggacaagagcgtgaggttgtatgatgccagtgccaatgtcttgagaggagagtttatgcacgctggtcccgtcctcgattgctgcttccacgatgattcctccggcttcagtgtcgccgccgacaacactgttagacggcttgtcttcagctctaacaaagaggatattctgggaaggcatgatgcccctgttcgttgtgttgagtactcatatgccgcagggcaattgatcactggtagttgggacaagaccctgaaatgttgggaccctagaggtgcaagtggccaagagcgcacacttgttgggacatatccacaagccgagcgtgtctactctctctcactggttggacatcgtctggttgtagcaacagctggaagacatgttaatatctatgatttgagaaacatgtctcaacctgaacaaagaagagaatcttctttaaaatatcaaaccagatgtgtgcactgttaccctaatggaacaggatatgcacttagttctgttgagggccgggttgcaatggaattctttgacctctcagaggctagccaagcaaaaaaatatgctttcaagtgtcacaggaaatcagaagctggaagggacattgtctatcctgtaaatgcaattgcattccaccccatatatggtacatttgccacgggaggttgtgacgggtatgttaacgtatgggacggaaacaataagaagaggctataccagtactcaaaatatccaactagcgttgcagcactttcgtttagcagagatggacgcctgttggctgttgcatcaagttacacattcgaagatggacctaaaagccaagaacaagatgctatctttgttcgtagtgtaaacgagattgaggtcaagccgaaacccaaagtctatcccaatccaccagtttgattcctgatggccattttgaaaataggaatttcttcgtttgttcttttctactgttgcacttgctctttgtgaacaccaaaaactacttgtaaaatgttgtgagcgctaggtaaattgttggatacaggtatctgtcagaaatggctctcctattgttttgtctttattctcgtcaaaagtaaactaaaattgatagacatcctttaagtttagtcggctcaggtgcaaaatatgaattgtgagtgtgcaggattttttttctaacaatgcactttgcttttcttttctttt

SEQ ID NO: 948 - DNA, 1741 bp, Glycine max
ctttgtttcattctgtatttggagctacttctcaaacccaaataatcacattaagtaagtaaaagaggttgaaactatccttgaaagtttttctgaagagatagaaaatcatatgacatggaaaagatctggatcgaaatgcttaacaaaacatgtgttaaatgattgatttatttaaatagttaaaggaaataattaatatatcttgaatatgagaaaaagaaaggggggtgggggtttgtgttttgaaaattgattaggtcacgcgcttcttccggaattagtcggtgtaatttacatttatccattttttgaaccttcccttcccaccccagaactttcaaatttcaacaaaatcgcagacatggcttctgcggtgcccgcgacggggcgagagttgtcgaatcctccattggacggcatcaccaatcttcgattctccaatcacagcgatcatctccttgtgtcctcatgggacaagagcgtgaggttgtatgatgccagtgccaatgtcttgagaggagagtttatgcacgctggtcccgtcctcgattgctgcttccacgatgattcctccggcttcagtgtcgccgccgacaacactgttagacggcttgtcttcagctctaacaaagaggatattctgggaaggcatgatgcccctgttcgttgtgttgagtactcatatgccgcagggcaattgatcactggtagttgggacaagaccctgaaatgttgggaccctagaggtgcaagtggccaagagcgcacacttgttgggacatatccacaagccgagcgtgtctactctctctcactggttggacatcgtctggttgtagcaacagctggaagacatgttaatatctatgatttgagaaacatgtctcaacctgaacaaagaagagaatcttctttaaaatatcaaaccagatgtgtgcactgttaccctaatggaacaggatatgcacttagttctgttgagggccgggttgcaatggaattctttgacctctcagaggctagccaagcaaaaaaatatgctttcaagtgtcacaggaaatcagaagctggaagggacattgtctatcctgtaaatgcaattgcattccaccccatatatggtacatttgccacgggaggttgtgacgggtatgttaacgtatgggacggaaacaataagaagaggctataccagtactcaaaatatccaactagcgttgcagcactttcgtttagcagagatggacgcctgttggctgttgcatcaagttacacattcgaagatggacctaaaagccaagaacaagatgctatctttgttcgtagtgtaaacgagattgaggtcaagccgaaacccaaagtctatcccaatccaccagtttgattcctgatggccattttgaaaataggaatttcttcgtttgttcttttctactgttgcacttgctctttgtgaacaccaaaaactacttgtaaaatgttgtgagcgctaggtaaattgttggatacaggtatctgtcagaaatggctctcctattgttttgtctttattctcgtcaaaagtaaactaaaattgatagacatcctttaagtttagtcggctcaggtgcaaaatatgaattgtgagtgtgcaggattttttttctaacaatgcactttgcttttcttttctttttttcatttgtttttacctctcctttttccttggaagacctattacagtctctcgttcaattaa

SEQ ID NO: 949 - DNA, 1422 bp, Catharanthus roseus
ctcattcctgcatttgaatttaaattctcggataccattcggctccgagactgaagagctacgtttttcaaatacccttcccccccattctcttctccctccttcgaacgcctctcctagcatttcacagttcaatacacagtctggaaccctagcttttgctcatatccacagattctgcctccaatttcacaccagctatgacggcggcacctctggcgaaccccggaagggagctgtcgagtcctccgactgacggaatatccaaccttaggttctccaaccacagcgatcacctactcgtctcctcttgggataagagcgttcgattgtacgatgcgagtgcaaatgatttgagaggagagttcatgcatggaggtgccgtgcttgactgctgcttccatgatgattcatcgggctttagtgccagtgcagacaatactgtgagaaggcttgtgttcaactacggacgggaggatattttgggaaggcatgatgctcctgttcgttgcattgaatactcatatgcaaccggacaagttattactggtagctgggacaaatatttaaagtgttgggatcctagaggtgcaagtgggcaggagcggactctagttgggtcatatgcgcaacctgaacgtgtttattctctctctgttgttggcaatcgcttggtagtagcaactgcaggaagacatgtcaatgtctatgatttgaggaatatgtctcaacccgagcagcgaagagaatcctcattaaaatatcaaacaagatgtgttcgctgttatcccaatggaacaggttatgctcttagttctgtggagggtcgggtcgcgatggagttctttgacctctctgaggctggtcaatccaaaaaatatgcatttaaatgtcatcggaaatctgaggctggaagggacattgtctacccagtaaatgccattgcatttcaccctatctatggtacatttgctactgggggttctgatggatttgtcaatgtgtgggatggcaacaacaaaaagaggttatatcagtacacaaaatacccgacgagtgttgccgctttgtcattcagtagagatgggagattgttggccgttgcatctagctatacatttgaagagggagataaagcccatgaaccggacgctatatttgtccgcagtgtaaatgaagtcgaagttaagccaaagcctaaggtgttacccaatcctactgcgtgaagggttttttagatctgcctgcctcttcgtagaatagtagctttgaaatttcttttttttattattttggagaaacaataacttgactatatgaacttttaagtgttctattcaaaaagaacgcagccttagcgtaagttgaatgcaaatattagtttcgcggagctttgcaatgtataacacggattattttgca

SEQ ID NO: 950 - DNA, 1371 bp, Linum usitatissimum
cgtacccgacatatgccgggaaattggccatacgccgggggaaataagtaaaacatcttcacttcctcaacccttattttcactctcacctcatcatctatggcagccgccgtacttccgccgggatcgggccgcgagctctctaatccccctaccgaggggatctccaatcttcggttctctaacctcagtgaccacctcctcgtctcctcctgggacaagagcgtgaggctgtacgacgccagtgcgaattcgttgctgggagagttcttgcacggtggagctgtgttggactgctgcttccacgatgaatcctctggatttagtgctagcgcggacaatcttgttcgaagactcgtttttaatcacgggaaagaagatattttgaggaagcatgatgcacctgttcgttgtatagagtattcttatgcggcaggacaagtaattactggtagctgggacagaacagtgaagtgctgggatcctaggggagcaagcggacaagatcacactcttgttggtacatatccacaacctgaaagggtctattctctatctcttgttggaaatcgtgtagtggttgccacagcaggaagacatgtcaatgtctatgatttgagaaatatgtctcaaccggaacagcaaagagaatcgtcgttaaaatatcaaacaagatgtgtccgctgctaccccaatggcgcaggttatgctcttagttctgtagaaggtcgggtagctatggaattttttgatctttccgaggccgctcaagctaaaaagtatgcatttaagtgccaccgaaaatcagaggctggaagagacatcgtatatccagtgaatgctattgcatttcatcctgtttacggtacatttgcaactggaggctgcgatggctttgtgaacgtgtgggatggtaacaacaaaaaaaggctgtatcagtactctaagtacccgtcaagcatagcggcactttctttcagcaaagatggccgcttgttagctgtggcatctagttacacatatgaagagggagaaaaaccgcacgagccagatgcgatatttgtccgcagtgtgaatgaagttgaagtgaagccaaagccgaaagtgtatccaaacccacccgcatgaattttggcaaagggccgcttcattttttccctgtgaaagcttgtgcctgcattagaacacgtcgcaaatgtgatccctagataaaagtttagagagagttcgtcaatttgtgagttatatgtaggataactctatcgttagccatgctcaaaatagtgtatatcatttgcttgcttgccgttgtacaatgcattattccttttgtatttttttcattctgcagagtaacgttttgacaaggtc

SEQ ID NO: 951 - DNA, 1630 bp, Gossypium raimondii
atgccattggcaaaatttttgaaacagcgggacttggccgatccgaataaaaacatttctaaatttcaaatcttcttccctctctttatatcgctcacccagtgaagaaacattcatcgtctctcccaaaaccctaagctctctccgatctccgttagttcatttcatctctctagcagccaatcgagcgatgacatctgtccacccgccaccggtaccaggtcgcgagctctctaaccctccgacggacgggatctcgaaccttcggttctctaatcacagcgataatctactcgtctcttcatgggataagactgtgagattgtacgatgcaagcgcgagcgttttgcgaggagagttcatgcacggtgggccggtacttgattgctgcttccatgatgattcatctgggttcagtgctagcgctgacaataaagttaggaggataatgttcagccatggaaaggaggaaatattaggtagacatgatgctcctgtacgttgtatagagtattcttatgcagcaggacaagtgatcacaggcagttgggacaagacattgaaatgttgggatccaagaggtgcaagtgggcaggagcgtactcttgtcggcacatacccacaacctgaacgtgtttactcgctatctcttgttggaaatcgtttagtcgtggcaactgctggaagacatgtaaatgtatatgacttgcgaaacatgtctcaacctgaacagcgaagggaatcttcattgaagtatcaaactagatgtgtgagatgttatccaaatggaacagggtatgctcttagttcggttgaagggcgagtggcaatggagttctttgatctctcagaggccagtcaagccaaaaagtatgccttcaagtgccatcgaaaatctgaggctggacgggacattgtatatccagtaaatgccattgcattccatcctgtatatggtacatttgcaactggaggttgtgatggttttgttaatgtgtgggatggaaacaataagaagaggctgtatcagtattcaaagtacccaacaagcgttgccgctctttcattcagcagagatgggcgactattggccgttgcttcgagttacacattcgaagagggagataaagcacatgaaccagatgcaatctttgtacgtagcgtaaatgaaattgaagtcaagccaaaaccaaaggtatatcctaatcctccagcgtagctgattaagcatatttttatcttctatgtggtaattctagatgtgtgagatgttaattgctttgtaaggcttgagtgaatggtctgaaccatgaaactaaactttttttaatcataggctagagagttttttttttctcacatcctctgtgaatttgttacaactagactctaatacccctttttcccactttctgttgaaaagtgtttacattgttttcaaatgttaacagtacttagaatctgttatggtctatgttctaatttcttttcttttttttttctcttgaagtatctgtgttaaaacatgtattaatgtgcgaggctacatctttcaaatatatggggaaaattttgaatgtgtagaccatattaatgaagttggaagcattgagacaactaaaaatttaaa

SEQ ID NO: 952 - DNA, 1577 bp, Ipomoea nil
ggagtagaatctaagtttaaatttaaattttgtggatatagtaacctcactcacttgattggatttccaactttgatttcaaactcccttccccccaaatttctctctttcaatcactgctctcactttgatcggaaaagtggaaaaccatcgattgcttaactgagcggaaaaccgacaacatcatgacggcggtgacactctcagccggacgggagctatcgaatcctccgacggacggaatatccaacctccgcttctccaaccacagcgatcacctcctcgtctcttcctgggataagaccgtaagactgtacgatgcaagcgccaatgtgttgagaggagaattcctgcacggcggtgccgtgctcgactgttgcttccacgacgattcttcgggcttcagtgctagtattgataatactgttagaaggcttgtgttcaattatggaagggatgatattttgggaaagcatgatgcacctgttcgctgtgttgagtactcatatactggacaagtgatcactggtagttgggataaaaccttgaaatgctgggatcctagaggagcaagcggacaagagcatactcttgttgggacctatgcacaaccagagagggtttattccttgtctctagttggcaaccgtttagttgtagcaactgctggaaggcatgtaaatgtctatgatttgcggaacatgtctcaacctgaacagcggagggagtcttcactcaaataccagacaagatgtgtgcgctgttatcctaatggaactggttatgctcttagttcagttgaaggccgtgttgcaatggaattttttgatctctctgatgctggtcaaatcaagaaatatgcattcaaatgtcatcgaaaatctgaagctggaagggatatagtctacccagtaaatgccattgcatttcaccctatctatggcacttttgccactggggggtgtgatggttttgttaatgtgtgggatggaaacaacaaaaagaggctatatcagtactcaaaataccctgcgagcattgcagccttgtcattcagcagagatggtagactgttggcgatagcatctagctatacgtttgaagagggacataaaccccacgaaccagataccatatttttgcgcagtgtgaatgaagttgaagtgaagccgaagcctaagctgctacctaatcccaccatgtaagaattcaagcgccttttgttcaacatttcatcgcatattggtagatgtttgtcataaattgaaaaatctgcttaaaattgtaaagaccaactgtttaaacgtagcttctatgtaagttggacactccctgaccaaacatattttagttgctaaaattcataagtttggccgttcagctctgggtttgctgaactatcacatctgctgtcttttgggtagtcatatgcacttcacctaacaaattcatgtatgcaaagtggtagggattgtgtctggtcagatcagttgtttggcatttacttcctatgatcttgtcccttttaaactttaggcccaattgtataatttaggcaatttctatggtgctcaacg

SEQ ID NO: 953 - DNA, 1327 bp, Antirrhinum majus
  misc_feature (22)..(22): n is a, c, g, or t
gaattttgaattccaacaacgngaactatcattttcaaaaaaccctaatctagctcttaacaaccccaaaaaaaaaaaccccaatcttcaaaaaatccttcgattctccgattaacggcagttatgacggcggcgccaccacaatcgatggggattgagatctcaaaccctccgactgacggaatctcgaatctccgcttctcaaatcacagtgacaacctcctcgtttcgtcatgggacaagactgttagattgtatgatgcgagctccaatgcgttgaggggagagtttttgcacggaggagcggtgctggattgttgtttccacgacgattcctcggggtttagcgcttgtgctgataacactgtgagaaggctagtgttcaactacaacagggaggatattttgggaaggcatgatgcacctgttcgttgtattgaatactcctatgccactggccaggttattactggtagctgggacaaaacattgaagtgttgggatcctagaggtgcaagtggtcaggaacattctcttgttggaacatatactcaacctgaacgtgtttattctatgtctcttgtcggcaaccgtttggtggtttcaactgctggaagacatgtaaatgtatatgatcttcgaaatatgtcccagcctgaacacggagagaatcttctttgaagtaccaaacaagatgtgtccgatgctaccccaatggaacaggttatgctcttagttctgtggaaggtcgtgtagcaatggagtttttcgatctctctgaagcaggtcaaaccaaaaagtatgcgtttaaatgtcatcgaaaatctgaagcaggaagggacattgtctaccctgtgaatgccattgcatttcatcccatttatggcactttcgctactggaggttgtgatggttatgttaacgtgtgggatggaaacaataagaagagattgtatcagtactcgaagtacccaacaagcatcgcagcattgtcattcagcagagacggtagactattggccattgcatccagttatacatatgaagagggagaaaaaacccatgaaccagactccatattcgtgcgtagtgtgaatgaagtagaagtcaggccaaaaccgaaggtgctgcctaatcctggtacatgaaggaacacatgccaagagtgaaacatttctgtttaacactgctaaatgcactctgtttctacggcattatatattgcaataggatgatcgttcttataatcattttctcgttgattattttgacttttgttatttgggatcttcgttgatgtactattgacaagattgtgcatgaagga

SEQ ID NO: 954 - DNA, 1227 bp, Cirsium arvense
acgcgggattggattcatattcaaattccgaaatcgaatcccatatctgaacaacaatttgaaacacccccaatttccctctcttctcctacagacctcaccagcatcagtagtgactgaaccctaacttcaatttcaaatggcggcggtgccacaggtcaccggcacggagctaatcagtcctccctccgacggcatatccaatctccgtttctctcatcactctgatcatctcctcgtctcttcttgggacaaacgtgttcgcctatatgatgccagtgccaatgtgttaagaggggagttcctgcatggaggtgcagtccttgattgctgctttcatgatgatacctctggttttagtgctagtggtgataatactgtcaggaggcttgtttttgaccacgaaagggaggacgttttgggacgccatgatgcacctgttcgctgtatcgagtactcttatgcaactgggcaagtgatcactggcagttgggacaaaactctgaagtgttgggatccaagaggtgcgagttcacaggagcgtgctcttgttggaacatacactcaaccagagcgtgtttattctatctcacttgttggaaaccgtgtagtagttgcaacagctggacgtcatgttaatgtctatgatttacggaatatgtctcagcctgaacaacgaagagaatcctcattgaaataccaaactagatgtgtacgatgttatcctaatggaacaggttatgcgcttagctctgtggaaggtcgagttgcaatggagttttttgagcttactgaggctggtcagtccaaaaaatatgcattcaagtgtcatcggaaatcagaagccggaagagacattgtctaccctgtaaacgccattgcatttcacccagtctatggaacatttgcaacaggcggttgtgatggttttgtaaatgtatgggatggaaacaacaaaaagaggctttatcagtactcaaagtacccgacaagtgttgctgctttatcgttcagcagagatggtcgattattggcagttgcatccagttatacatacgaagagggggagaaacctcacgaaccagatgccatattcgttcgcaatgtgaatgaagttgaagtgaagccaaagcctaaagcatacccaaatccttcttcttaactcaagattggagagagctttgtagtttgaatgtaattcctcatcctcttcagtagaattaccat

SEQ ID NO: 955 - DNA, 1380 bp, Cirsium arvense
tccctcccatttgaaaaatctacacataccagacctcgatctgaaccctagataatttgcagattgaaaatggcagcggtgccacaggtcaccggccgggaactatccaatcctccgtccgacggcatttccaacctccgattctctcatcactccgatcatctactcgtttcttcttgggacaaaagtgttcgattgtatgatgccagtgagaatgttctaagaggagagtttacgcatggaggtgcggtccttgattgttgctttcatgatgataattctggtttcagtgccagtgctgataatactgtgaggaggcttgtattcaactatgagagggaggatgttcttggacgccatgatgcccctgttcgttgtattgaatactcttatgcaacagggcaagtgatcactggaagttgggacaaaaccctgaagtgttgggatcccagaggtgcaagtgcacaggagcgtgctctagtggggacttatgctcaacctgaacgtgtctattctctgtccgttgttggcaatcgtttagtggtggcaactgctgggcgacatgttaatgtttatgacttaaggaatatgtcacaacccgaacagcgaagggaatcttccttgaaataccaaaccagatgtgtgcgaagctaccccaatggaacaggttatgctcttagctctgtggaaggtcgtgttgcaatggaattttttgatctttctgacgctggtcaatccaaaaaatatgcattcaagtgtcaccggaaatcagaagctggaagagacattgtctaccctgtaaactccattgcatttcaccctgtctatggcacatttgcaacaggcggttgtgatggttttgtcaacgtatgggacgggaacaacaaaaagaggctgtatcagtactcaaagtaccctacaagcattgcggccttatccttcagcagagatggtcgactactggctgttgcatccagttacactttcgaagagggtgacaaaccccatgagccggatgccatatttgtgcgcagtgttaatgaagtggaagtgaagccaaagcctaaagtgtacccaaatcctgcaacttaaatgggaatagtatagaagaaaggttggtttgttgaatagtaggagtatgtagtgtgattgtggactgctggctttatttgaatgtaagctgtcatcttgttgtgcaaaatatctttgcaacttgatgatggtgaaagtgcattcaagataaggctgctgctataaatctagatgcttgacatttgtgtgcaattggctactgtttctgtatacttggaaattctatatgtttcctcattatgcatctatggagtgccatggtttgtgaaaatcatgagtcttgtgtac

SEQ ID NO: 956 - DNA, 1410 bp, Silene vulgaris
caacaacacctctcacacacttgaaacaaatctttcctttttaaaacccttgttcttcctccctcaattctcgccggaaaatcgaaatgacggcggtggcgccgccagtaacaggcagagaaatatcaaatccaccaacagacggcatcaccaacctccgtttctccaatcacagtgatcacctcctcgtttcttcttgggataagactgttaggttgtacgatgcgagtgcaaatgtgcttcgaggagagtttaaacatggcggtcctgttctagattgctgctttcatgatgattcttcagggtttagcgcttgtggtgattcaactgtcagacggctggttttcaaccatggcaaagaggatattttggggaaacatgatgcgcatgtgcgatgtgtcgaatactcatatacaacagggcaagttatcactggtagttgggatagaactctcaagtgttgggatcccagaggcgcaagtggtcaggagcgtactcttgtcggaacatatcctcaaccggagcgtgtttattctatgtctcttgttggccacagattagttgtagcaactgcaggaagacatgttaatgtctatgatctacgaaatatgtctcaaccagaacaaaagagggagtcatctttaaaatatcagactcgatgtgtacgtagttaccccaatggaacaggttatgctctcagctcagttgaaggtcgagtagcaatggagttttttgatatgtctgaagctggtcaagttaagaaatatgctttcaaatgtcatcggaggtctgaagcgggaagagacattgtttatcctgtgaacgccattgctttccatccaatctatgggacatttgctactggaggctgcgatggaattgttaatgtatgggatggaaacaacaaaaagaggctttatcagtatgcaaagtacccaacaagcgtagcagcattgtcattcagtagagatggtcgtctcttggctatcgcttcaagttacacttttgaagaaggcgaaaaacctcatgagccagatgcaatatttgtgcgtagcgtgaatgaagttgaagtgaaaccaaagcctaaagtcaatcctcctgcttgacgacagttgagctgcttttgcccgatgtattgtagagtttggcattgtaggttttagtttcacgctgctggccttcttgatccctcaagaagcgttaatggaattgtaaagaccgtgctagagatgttattagctttctgtttttatggatgcacaatcttgctgtaatatttgatcagattcttttgtatgattgcgttcactgtttcacatatggtgaaattatggaaaacgactcgtgaatttgtaagagtgggccgtagaattatgccatgacttgctaaatttgcaatattttcatagg

SEQ ID NO: 957 - DNA, 1420 bp, Vitis vinifera
gttttttactgcgtctgtgtgttgggacttaagccaacagtttcactccttgaaatttaaattcaaaaggcagtagggttctctttctccattttcattttcaaatctccttccctctctctctctctctccctccctccctccctcccaaaaccctaactctaaacgctactccaacaatcacgctatgacagctgtgaaccccccggtaatcggccgggagctcgtgaaccctccggcagatgggatctccaatctccgcttctccaatcatagcgacaaccttctcgtatcctcctgggacaagagtgttcggttgtacgatgcgagtgcaaatgtgttgcgaggagagttcatgcacggaggccctgtcttggattgctgcttccatgacgattcctcagggttcagtgccagcgtcgacaattccgtgaggcggcttgttttcagccatggaaaagaggatgttttaggaaggcatgatgcacctgtgcgttgtattgagtactcttatgcaacagggcaagtggtaactggtagctgggacaaaacactcaagtgttgggatcctagaggagcaagtgggcaggagcgcactcttgttgggacatacgcacaacctgagcgtgtttattctctatctcttttcagcaatcgattagtagttgcaactgcaggaagacatgtaaatatctatgatttgcgaaatatgtctcaacctgagcaacgaagagaatcttcattgaaatatcaaactagatgtgttcgttgttaccccaatggaacaggttatgctcttagttctgttgaaggtcgggttgcaatggaattttttgaactctctgaggccagtcaagccaaaaaatatgcattcaagtgtcatcgaaaatcagaggccggaagagacattgtgtatccagtaaatgcaattgcattccaccccatctatgggacatttgcaactggaggttgtgatggttttgtgaatgtttgggatggaaacaacaagaagaggctatatcagtattcaaaatacccttcaagtgttgcagcactatcgtttagcagagacggtcgcctgttggctgtggcatcaagttacacatttgaagagggagacaaaccccatgagccagatgctatcttcgtacgcagcgtgaatgaaatggaagttaagccaaagccaaaagtgttaccctaatcccctcccaaatgactgaaaattgtggaaaggcttgttttaatgatatttctgtctgtgttcatatgttatattacattgcaaggtttcacttcctcatgaagctcattaaacttgatatgtaaactgattttgaatcaaagttacatgatatttcctctttggcctgatattatccccaacagaaaactccatggttaaaaccctctgctaaatcct

SEQ ID NO: 958 - DNA, 1362 bp, Cicer arietinum
gtttagaaaccctagctgctaagcatggctgcaacaaccgtggttgccggacgagagttgtcgaaccctccttctgacggaatctccaacattcgtttctctaatcatagtgatcatcttctcgtttcctcttgggacaagagcgtgcgtctctacgatgcaagcgcaaatgtgctcagaggagaattcatgcacggcggacccgtacttgattgttgcttccacgatgactcttccggcttcagtgccggcgctgataatactgtcagacgcctccttttcagcaccaacaaggaggatattttgggaaagcatgatgcacctgttcgttgtatagagtactcttatgcagcagggcaattgatcactggtagttgggacaaaaccctaaaatgttgggatcctagaggtgcaagcggacaagagcgcactcttgttgggacatatcaacaacctgagcgagtttactctctatcacttgttggacatcggcttgttgtagcaacggctggaagacatgttaatgtttatgacttgaggaacatgtctattcctgaacaaagaagggaatcttcattgaaatatcaaaccagatgtgtgcgctgctacccaaatggaacaggatatgcacttagttctgttgaagggcgggttgcgatggaattctttgacctctctgaggctagccaggcaaagaaatatgcattcaagtgtcacagaaaatctgaagctggaagggatattgtttatcctgtaaatgccatggcattccaccccatatatggtacatttgccacaggaggttgtgacggttttgttaatgtatgggacggaaacaacaaaaagaggctataccagtattcaaaatatccaactagcattgctgcactatcatttagcagagatggacgcctcctggctgttgcatcaagttacacatttgaagagggacctaaaaccaatgaacaagatgctatctacgttcgcagcgtgaatgagattgaggtcaagccaaaacccaaagcctatcccaatcctacagcttgattcaatggttcctaatattaagtttgaaaattagaaatttcttgtcgtattttaactgtgtactctgttcacatctttcgtgtgaacatccttgtgaagctctagcaactttctagatacgtgctggttaacattttgacatttatattttatgcgtccaaatttcccttcaatgtaaataattgttaggttattattattattataaggaccgggtgactactattgttatgcttctactcacaatttcgtaccaactctaacagagacacatgtcccttggtaccaactcatccatccgtatcattgataagt

SEQ ID NO: 959 - DNA, 1633 bp, Cicer arietinum
atctacattttgaaaatgaattagaagtaacaataagagtattgatagggagaacggtgagtctagtgtcgcggaaatttgaaattttgaattgaattgaatatatcattgaatctaaacagaaatatacataacttggcttgcctccgtcttgattcaaaataaaataaaataatttgaaaggtctgtttagaaaccctagctgctaagcatggctgcaacaaccgtggttgccggacgagagttgtcgaaccctccttctgacggaatctccaacattcgtttctctaatcatagtgatcatcttctcgtttcctcttgggacaagagcgtgcgtctctacgatgcaagcgcaaatgtgctcagaggagaattcatgcacggcggacccgtacttgattgttgcttccacgatgactcttccggcttcagtgccggcgctgataatactgtcagacgcctccttttcagcaccaacaaggaggatattttgggaaagcatgatgcacctgttcgttgtatagagtactcttatgcagcagggcaattgatcactggtagttgggacaaaaccctaaaatgttgggatcctagaggtgcaagcggacaagagcgcactcttgttgggacatatcaacaacctgagcgagtttactctctatcacttgttggacatcggcttgttgtagcaacggctggaagacatgttaatgtttatgacttgaggaacatgtctattcctgaacaaagaagggaatcttcattgaaatatcaaaccagatgtgtgcgctgctacccaaatggaacaggatatgcacttagttctgttgaagggcgggttgcgatggaattctttgacctctctgaggctagccaggcaaagaaatatgcattcaagtgtcacagaaaatctgaagctggaagggatattgtttatcctgtaaatgccatggcattccaccccatatatggtacatttgccacaggaggttgtgacggttttgttaatgtatgggacggaaacaacaaaaagaggctataccagtattcaaaatatccaactagcattgctgcactatcatttagcagagatggacgcctcctggctgttgcatcaagttacacatttgaagagggacctaaaaccaatgaacaagatgctatctacgttcgcagcgtgaatgagattgaggtcaagccaaaacccaaagcctatcccaatcctacagcttgattcaatggttcctaatattaagtttgaaaattagaaatttcttgtcgtattttaactgtgtactctgttcacatctttcgtgtgaacatccttgtgaagctctagcaactttctagatacgtgctggttaacattttgacatttatattttatgcgtccaaatttcccttcaatgtaaataattgttaggttattattattattataaggaccgggtgactactattgttatgcttctactcacaatttcgtaccaactctaacagagacacatgtcccttggtaccaactcatccatccgtatcattgataagtggcgattatcaaaataaattattaagaattaaaatcagtgatgtataacatttattattttaatttaattctacatcaatttat

SEQ ID NO: 960 - DNA, 1078 bp, Arabidopsis lyrata
gaaagccctagaatttgtgatcttcaacgggaaaaatgactacgactccgtccgccggtcgtgagctctcgaatccgccgtccgacggcatttccaatctccgattttccaataacagtgatcatctcctcgtttcttcatgggataagcgtgtgagattgtatgatgtgagcaccaattcgttgaaaggggagttcttacatggcggagcagtgctcgattgctgttttcacgatgatttctccggcttcagtgttggcgccgattacaaagtcagaaggattgtattcaatgtcggcaaagaggacattttggggacacatgacaaaccagtgcgatgtgttgagtattcttatgctgcagggcaagtgatcactggatcttgggataaaacagttaaatgttgggatccaagaggcgcaagtgggcctgaacgcacccaggtaggaacatatttgcagccagagcgtgtttactctatgtctcttgttggacatcgtttggtagtggcaacagcaggaaggcatgtaaacatctatgatctcagaaatatgtctcagcctgagcaaagaagagagtcttcactgaaataccagacgagatgtgtgcgttgttatcctaatggaacaggatatgctcttagctctgttgaaggaagggttgctatggagttttttgatctgtcagaagctgctcaagctaaaaaatatgctttcaaatgtcatcggaaatcagaggctggaagggacattgtttaccctgtaaattccattgccttccatccaatctatggcacctttgcaactggaggttgtgatggtttcgtcaacatttgggatggtaacaacaagaagaggttatatcagtactcaaagtatccaacaagtatctcggcactgtcattcagtcgagatggtcagctactggctgttgcttcaagttacacgtttgaagagggggagaaatcgcaagaaccagaggccatctttgtaagaagcgtgaacgaaatcgaagtgaaaccaaaacccaaagtatacccgaatcctgcggcctagaaaggaagaaacacaagttattt

SEQ ID NO: 961 - DNA, 1240 bp, Lotus japonicus
cctctctctgtcgcgtaataaaccctaacatgacgacgacaacaccagtggttgccggccgggaactctcaaacccaccctccgacggcatctccaaccttcgtttctccaatcacaccgatctccttctcgtctcttcttgggacaagaccgtgcggttgtacgatgccagcgctaatgtgctcagaggagagttcatacacggcggacccgtccttgactgttgcttccacgacgactcctccggcttcagtgtcgccgccgacaacactgtcaggcgactcgttttcaacactagccaggaggatattttgggaaaacatgatgctcccgttcgttgtgtcgagtactcctatgcagcaggacaattgatcactggtagttgggacaaaaccctaaaatgttgggatcctagaggtgcaagtggtcaagagcgcactcttgttgggacatatccacaacctgagcgtgtgtactctctatctcttgttggaaataggcttgttgtagcaacagctggaagacatgttaatgtttatgatttgaggaacatgtctctgcctgagcaacgaagggaatcttctctgaaatatcaaaccagatgtgtgcgctgttacccaaatggaacaggatatgctcttagttctgttgaagggcgggttgcaatggaattctttgacctctctgaggctagccaagcaaagaagtatgcttttaagtgtcacagaaagtcggaagctggaagggacttcgtctatcctgtaaatgccatggcattccaccccatatatggtacgtttgcaactggaggttgtgatggttatgttaatgtgtgggacggaaacaacaagaaaaggctataccagtattcaaaatatccaactagcattgctgcactttcattcagtcgagatggacgcctcctggctgttgcatcaagttacacatttgaagaggggcctaaaccccatgaaaaagatgctatctatgttcgcagtgtaaatgagatagaggtcaagccaaaacccaaagtctatcctaatcctgccgcgtaattgattcttgatagtaactttgaaaatataatttttcttttctgtcattgctactgtgtactttgttcatatatcttgtgaacgctgaatgtaaactaatattgtgaagcactaagctaatttctagatacatgctgcgttaatgtttttttgaactccggtgtgtccattttaataattgataa

SEQ ID NO: 962 - DNA, 1317 bp, Pseudoroegneria spicata
cccaaacccggcttacccgagcgaggagcagtgacgatagagcaggggaggcagcaccgctcgggagcaatggagagggcgacgccggtgcggagcccgcacacctcgacggccgacctgctcacgtggtccgccacgggcgccgacgcctccgccgcctcgccggccgccccgtcccgccccagcctcaagccggctggggggatcacgccggccatgttcggcgcgccggtgagcgagcacgaggccgaggatctgagcaacagtgaaaggagattgatgtccggttcaaagatgaaggaaatgactgggagtgggatatttgctgaaaagagcgagaatagtgattcagagtcttcaaatcctgcaaacagaacttctgtgaggatgtatcagcaaactgtaactggagtaagtcagatctcatttagcgctgatggaagtgtttctccaaagaagccatcctcactgcctgaagtggctaagcagcgagagcttagtggcacattcgagactgatgctgaagctaaaattaataagcagctttctgaagccaagaacaaggagctcagtggaagcaatatctttggcccacctcctgagacccctgcaaggccactggctgcacgtaatatggagctacaaggaaatgtagattttgcacttccacaacgaagaagcgtgcacacatcagtgaaagtatccaatcctgctggaggtccaagcaacatcacgttcagtgaggatcctgtaacgaagacagcaaagaaaattcacaaccagaagttccaagagctgacaggcaataacatctttaacgaggatgctccccctggctcagctgacaagtctctgagctcagcaaagctcaaggagatgagcggcaatgacatcttctctgatggaaaggcgtcttcgcgagactacctcggcggtgtccggaagccccctggtggcgagagcagcattgcactcatctaattatggtagactgctctagtcgagactggctagtacgtcctcatttcaggtgctctccttggccttccggggtctagatgatgctttgagatctgaattgtgttggatatcttagccgtaatatagtgtagagtcagcagaatctgactcaggctcatatcatgtacgcttctgcgtgatctcatccttgttttgtggtacttatgtattaatctctccgtactgagaacctgcgcaataagcttttatggactcattcggcatcattgacaagactgttatttgtaactcttttatcagctatgccaggaaaggtccagcagaattcttgtggca

SEQ ID NO: 963 - DNA, 1410 bp, Secale cereale
gagcgagcagaggcgatagagcacgggaggcagcaccgctcgggagcaatggagagggcgacgccggtgcgcagcccgcacacctcgacggccgacctgctcacgtggtcggcgacgggcgccgacgcctcggccgcctcgccggccgcgccgtcccgccccagcctcaagccggctggggggatcacgccggccatgttcggcgcgccggtgagcgagcacgatgccgaggatctgagcaacagtgaaaggagattgatgtccggttcaaagatgaaggaaatgactgggagtgggatatttgctgaaaagaacgagaatagtgattcagagtcttcaaatcctgcaaacagaacttctgtgaggatgtatcagcaaactgtaactggagtaagtcagatctcatttagcgctgatggaagtgtttctccaaagaagccatcatcaattcctgaagtggctaagcagcgagagcttagtggcacattcgagactgatgctgaagctaaaattaataagcagctttctgaagccaagaacaaggagctcagcggaagcaatatctttggtccacctcctgagacccctgcaaggccattggctgctcgtaatatggagctacaaggaaatgtagattttgcacttccacaacgaagaagtgtgcacacatcagtgaaagtatccaatcctgctgggggtccaagcaacatcacgttcagtgaggatcctgtaacgaagacagcaaagaaaattcacaaccagaagtttcaagaactgacaggcaataacatcttcaacgaggatgctccccctggctcagccgacaagtctctgagctcagcaaagcttaaggagatgagtggcaatgacatcttctctgatggaaaggcgtcttcgcgagactacctcggcggtgtccggaagccccctggtggcgagagcagcattgcgctcatctaattgtggtagactgctctagtcgggactggctagtacatcctcatttcaggtgctcttcttggccttcccgggtctagattatcctttgagatctgaattatcttggatatcttagccctaatatagtgtagagtcagcaggatctgactcggctcatatcatgtacgctcgtgcgtgatctcatccttgttttgtggtacttatgtgttaatctctctgtactgagaacctgcgcaataagcttttatggactcatttggcatcattgacaagacaatttgcagctcttttatcagctatgccatgaaaggtccatcagaattcttgtggtcgcacctgtaacaaaaccttctcgctgtattaacctctcttgtgtttcgaatcagtactggtgctaaaagagttacaaatattatgacaaatagacctttggtgagcggcaaaaaaaaa

SEQ ID NO: 964 - DNA, 1274 bp, Triticum aestivum
ccggcttacccgagcgagcgagaagaggcgatagagcacgggaggcagcaccgctcgggagcaatggagagggcgacgccggtgcggagcccgcacacctcgacggccgacctgctcacgtggtcggccacgggcgccgacgcctccgccgcctcgccggccgccccgtcccgccccagcctcaagccggctggggggatcacgccggccatgttcggcgcgccggtgagcgagcacgaggccgaggatctgagcaacagtgaaaggagattgatgtccggttcaaagatgaaggaaatgactgggagtgggatatttgctgaaaagaacgagaatagtgattcagagtcttcaaatcctgcaaacagaacttctgtgaggatgtatcagcaaactgtaactggagtaagtcagatctcatttagcgctgatggaagtgtttctccaaagaagccatcctcaattcctgaagtggctaagcagcgagagcttagtggcacattcgagactgatgctgaagctaaaattaataagcagctttctgaagccaagaacaaggagctcagcggaagcaatatctttggtccacctcctgagacccctgcaaggccactggctgctcgtaatatggagctacaaggaaatgtagattttgcacttccacaacgaagaagcgtgcacacatcagtgaaagtatccaatcctgctggaggtccaagcaacatcacgttcagtgaggatcctgtaacgaagacagcaaagaaaattcacaaccagaagttccaagagctgacaggcaataacatctttaacgaggatgctccccctggctcagctgacaagtctctgagctcagcaaagcttaaggagatgagcggcaatgacatcttctctgatggaaaggcgtcttcgcgagactacctcggcggtgtccggaagccccctggtggcgagagcagcattgcactcatctaattatggtagactgctctagtcgggactggctagtacatcctcctcatttcaggtgctctccttggccttcccgggtctagacgatgctttgagatctgaattatgttggatatcttagccctaatatagtgtagagtcagcaggatctgactcggctcatatcatgtacgcttctgcgtgatctcatccttgttttgtggtacttatgtattaatctctctgtactgagaacctgcgcaataagctttttatggactcattcggtatcattgacaaggcaatttgcaactcttttatca

SEQ ID NO: 965 - DNA, 1613 bp, Triticum aestivum
cgggaaatggatgggtgttacccctactactagtaccgtcgtaccccacgccacgcagcagcaccgcgaggacccaaacccggcttacccgagcgagcgagaagaggcgatagagcacgggaggcagcaccgctcgggagcaatggagagggcgacgccggtgcggagcccgcacacctcgacggccgacctgctcacgtggtcggccacgggcgccgacgcctccgccgcctcgccggccgccccgtcccgccccagcctcaagccggctggggggatcacgccggccatgttcggcgcgccggtgagcgagcacgaggccgaggatctgagcaacagtgaaaggagattgatgtccggttcaaagatgaaggaaatgactgggagtgggatatttgctgaaaagaacgagaatagtgattcagagtcttcaaatcctgcaaacagaacttctgtgaggatgtatcagcaaactgtaactggagtaagtcagatctcatttagcgctgatggaagtgtttctccaaagaagccatcctcaattcctgaagtggctaagcagcgagagcttagtggcacattcgagactgatgctgaagctaaaattaataagcagctttctgaagccaagaacaaggagctcagcggaagcaatatctttggtccacctcctgagacccctgcaaggccactggctgctcgtaatatggagctacaaggaaatgtagattttgcacttccacaacgaagaagcgtgcacacatcagtgaaagtatccaatcctgctggaggtccaagcaacatcacgttcagtgaggatcctgtaacgaagacagcaaagaaaattcacaaccagaagttccaagagctgacaggcaataacatctttaacgaggatgctccccctggctcagctgacaagtctctgagctcagcaaagcttaaggagatgagcggcaatgacatcttctctgatggaaaggcgtcttcgcgagactacctcggcggtgtccggaagccccctggtggcgagagcagcattgcactcatctaattatggtagactgctctagtcgggactggctagtacatcctcctcatttcaggtgctctccttggccttcccgggtctagacgatgctttgagatctgaattatgttggatatcttagccctaatatagtgtagagtcagcaggatctgactcggctcatatcatgtacgcttctgcgtgatctcatccttgttttgtggtacttatgtattaatctctctgtactgagaacctgcgcaataagctttttatggactcattcggtatcattgacaaggcaatttgcaactcttttatcagctatgccaggaaaggttcagcggaattcttgtggtaacacctgtgacaaaaccttcttgctgtattaacctttcttgtggtgaatcagtacttgtgttaaaagagttgcaaatattacaacaaataaagggggaagaaatatgttaagaaaaagggtgaagaaataagaacagacctttagtgatcggtacataatcctgattgcaagttcggcctggcatgtagtatttgtgctgattgaattatgttggatatctta

SEQ ID NO: 966 - DNA, 1245 bp, Leymus cinereus x Leymus triticoides
cccaaacccgatcgagaagcagtgacgatagagcaggggaggcagcatcgctcgggagcaatggagagggcggtgccggtgcggaacccgcacacctcgacggccgacctgctcacgtggtcggccacgggtgccgacgcctcccccgcctcgccggcagccccatcccgccccagtctcaagccggctggggggatcacgccggccatgttcggcgcgccggtgagcgagcacgaggccgaggatctgagcaacagtgaaaggagatcgatgtctggttcaaagatgaaggaaatgactgggagcgggatatttgctgaaaagagcgagaatagtgattcagagtcttcaaatcctgcaaacagaacttctgtgaggatgtatcagcaaactgtaactggagtaagtcagatctcatttagcgctgatggaagtgtttctccaaagaagccatcctcactgcctgaagtggctaagcagcgagagcttagtggcacgttcgagactgacgctgaagctaaaattaataagcagctttctgaagccaagaacaaggagctcagcggaagcaatatctttggtccacctcctgagacccctgcaaggccactggctgctcgtaatatggagctacaagggaatgtagattttgcacttccacaacgaagaagcgtgcacacatcagtgaaagtatccaatcctgctggaggtccaagcaacatcacgttcagtgaggatcctgtaacgaagacagcaaagaaaattcacaaccagaagttccaagagctgacaggcaataacatctttaatgaggatgctccccctggctcagctgacaagtctcttagctcagcaaagcttaaggagatgagtggcaatgacatcttctctgatggaaaggcgtcttcgcgagactacctcggcggtgtccggaagccccctggtggcgagagcagcattgcactcatctaattatggtagactgctctagtcgggactggctagtacgtcctcctcatttcaggtgctcttcttgaacttccggggtctagatgatgctttgagatctgaattatgttggatatcttacccctaatatagtgtagagtcagcagaatcggctcatatcatgtacgcttctgcgtgatctcatccttgttttgtggtacttatgtattaatctctctgtactgagaacctgcgcaataagcttttatggactcattcggcatcattgacaagaca

SEQ ID NO: 967 - DNA, 1353 bp, Brachypodium distachyon
cagtgccctccgcgaagaaacgaagcccgagcgagcagaccagagacggtagcagcagtgctcggaactcggaagcatggagagggcggtcccggtgcggaatcctcacacctcgacggccgacctgctcacgtggtcgccgaccggcgccgacgccccggccgcctcgccggccgcctcctcccgccccagcctcaagcccgccggggggatcacgccggcgatgttcggcgcgccggtgagcgagcacgaggccgaggatctgagcaacagtgaaaggaaattggtctctggctacaagatgaaagagatgactgggagtgggatttttgctgaaaagggtgaatatggtgattcagagtctgcaaatcctgctaacagaacttcggtgaggatgtatcagcaaactgttactggaataagccagatctcatttagtgctgatggaagtgtatctccaaagaagccgtcatcactgcctgaagtggctaagcagcgagagcttagtggcacattcgagagtgatgctgaagctaaaattaacaggcagctttctgaagccaagaacaaggagcttagcgggagtgatatctttggtccacctcctgagacccctgcaaggccattggctgctcgtaatatggagttacaaggaaatctagattttgcacttccacaaccaagaagtgtccacacatcagtgaaagtatctaatcctgctggaggtccaagcaacatcacgttcagcgaggatcctgtaacaaaaacatcaaagaaaattcacaaccagaagttccaagagctgacaggcaataacatcttcaaggaggatgcttcccctggttcagctgagaagtctctgagctcggcgaagctcaaggaaatgagtggcaacgacatcttctctgacgggaaggcgtcttcacgagactacctcggtggtgtccggaagccccctggtggcgagagcagcattgcgctgatctaatgattgtagactgctctaatcgggactggctagtcctcatcggcaaagcgtgtgctcttcccaacaccatgcttgtgatctaaattatggtggatactttagccctaatataatgcagagtcgcagagtctgactccggtcatatcttgtacgcttatgcgtgatccatgatccatccttggtttctgctacttatgtattaatctcaccgtactgagaacctgcgaataagtatcatggactaaggcatcattgacaaggctgtcatctggagcttatacggtaattcgtggagtctttccccaaattactaaaatgtcagtaaaactgaagtgaaatttgaacatcacaaatcttatctatgt

SEQ ID NO: 968 - DNA, 1425 bp, Oryza sativa
gcggccgtgctctccaaacagcggcagtggtggcgctcgcatttttttttcagctccgcggaaggaacgaaacccaacccaagcgaggcaaaagcggcggcggcggaggaggagaggagcaatggagagggcggtgccggtgaggaagccgcacacctcgacggcggacctgctcacgtggtcggcgacggggcccgacgccgccgccgccgcggcctcgccggtcgcctcctcccgccccagcctcaagccggccggggggatcacgccggcgatgttcggcgcgccggtgagcgagaaggaggcggaggatctgagcaagagtgaacgaaaattttgctcgggctcaaagttaaaagaaatgactggaagtgggatattcgctgagaatagtgaaaatgatgattcagaggcttcaaatcctgcaaacaaaacttctgtaaggatgtatcagcaaactgtaactggaataagccaaatctcattcagtgctgatggaagtgtttctccaaagaagccatcgtcattacctgaggtggctaagcagcgagagcttagtggtacactggagactgatgctgaggctaaaatgaataagcagcattctgaagccaagagcaaggagctcagtgggagtgatatttttggtcctcctccagagatccctgcaaggccattggctgctcgcaatatggagctgcaaggaaatctagattttgcacttccacaaccgagaagcgtccacacatcagtgaaagtatccaatcctgctggaggtccaagcaacatcacgttcagtgaggagcctgtagtcaagacgtcaaagaaaatccataaccagaagttccaagagttgacaggcaacaacatcttcaaagaggacgctacccctgcatcagctgagaaatctctgagctcagcaaagctgaaggagatgagcggcagtgacatctttgctgatggagcggcagctccccgagactatctcggcggtgtccgcaagccccctggtggcgagagcagcattgcactgatctaatcgccgcaggctgccctaatctggactggctacttttaccctcatcgctgaagtccgtggcatgtgctcttcctggaccctggttcttgatcatggttgagagctgatatcttggccctgatatcatctagagtcagcagaatctgactcagcttatgtgttgtaaacttgacttaatctcatctgtcttatggtacttatgtattaatctccttggactgagactgaaataagttttattggttcatttttgtgagctcatggtatcatcaggaaataatgtctgtcttgtatcaaattaacttatttgtgagttatgcaaaagataacgaaggtatctacaataccatttcctcttaagcctggtttcctttgaaatttgggag

SEQ ID NO: 969 - DNA, 1393 bp, Zea mays
accagtacagccagtggcaggcagcggtgtcaccggcaaaaaaattcgaaacgagcggtgtctgcctatcactgccatttcgctcgcgaagaaatcgcgaggggaagcgtgccgagctgagcaggcaggcggtagtggccgagcgaaagcatccccgatctcaacgtctcgtagtcgtagctgctgcctctcactcagggcaatggagagggcggtgccggttcggaagccgcacaccagcacggccgaccttctctcctggtcggccacggcccctgacgcatctgcctcgccggccgcgtcctcccgccccagcctcaagccggccgccgggattacgcctgcgatgttcggcgcgccggtcaccgagcaggaggccgaggatctgagcaagagtgaaaggaaattttgctccggatcgaagttgaaagagatgagtgggagtgggattttcgctgagaagagtgaaaatggtgactcagaggcttcaaatcctgataacaagacttccttgaggatgtaccagcaaactgtgactggaataagccagatttcatttagtgctgatggaagtgtttcaccgaagaagccgtcgtcaatacctgaggtggctaagcagcgagagcttagtggtaccctggaagatgctgatgctaaaatcaataagcagctttctgaagccaagaccaaggagcttagtgggagtgacatctttggtccgcctcctgagattcctgccaggccattggctgctcgtaacatggagctacaaggaaatgtcgatttttcacttccacagcgaagcgtccacacatcagttaaagtatcaaatcctgctggaggtccgagcaacatctcattcagtgaagagcccgtagtgaagacagcaaagaaaatccacaaccagaagttccaggagctgacaggtaacaacatcttcaaggaggacgtcccttcctcagccgagaagtctctgagctctgcgaagctgaaggagatgagtggcagtgacatcttcgccgatggaacgccagctccccgagaatacctcggcggcatccggaagccccctggtggcgagagcagcatcgcgctgatctgattgtcctggactgctttaattcggaccggctgtagctcccatcgccactaaagctcgcagagagtgcatttctcgacctctcgattctccatccgtgttgggatcataatttatgttgggtatcgttagtctaatataatgtagagtcagcagaatctgactcgtatcgtctgatacgctggtgtgtgatctcgcatcttttattgttgcgacattattatgttatatatttgtacacccgaaccgaaacttacgcaataattaaattttggactcattttcagggattat

SEQ ID NO: 970 - DNA, 1590 bp, Sorghum bicolor
actgtttcgtgaggggaacaggcatggatgggtaccagtacaaaccaggggcaggcagcggtgtcaccggcaaaaattttcgaaaccgagaggtgtgtgtcagcctatcactgccatttcgcccccgaagaaatcgcgagaggggagcgtgccgagctgagcaggcaggcggtagtggccgagcgaaagcatcctcgatctcgtagcagccgccgccgctcgggtaggaaggaaggagagcaatggagagggcggtgccggttcggaagccgcacaccaacacggccgaccttctctcctggtcggccacgggccctgacgcatctgcctcgccggcggcggcctcgcgccccagcctcaagccggccgcggggattacgccggcgatgttcggcgcgccggtcaccgatcaggaggccgaggatctgagcaagagtgaaagaaaattttgctctggctcgaagttgaaagagatgagtgggagtgggatttttgctgagaagagtgaaattggtgattcagaggcttcaaatcctgctaacaagacttccttgaggatgtaccagcaaactgtgactggaataagccagatttcattcagcgctgacggaagtgtttcgccgaagaagccatcgtcgatacctgaggtggctaagcagcgagagcttagtggtaccctggaagatgctgatgctaaaattaataagcagctttctgaagccaagaccaaggagcttagtggcagtgacatctttggtccgcctcctgagattcctgccaggccattggctgctcgtaacatggagctacaaggaaatgtcgatttttcacttccacagcgaagcgtccacacatcagttaaagtatctaatcctgccggaggtccaagcaacatctcattcagtgaagatcctgtagtgaagacagcaaagaaaatccacaaccagaagttccaggagctgacaggtaacaacatcttcaaggaggatgtccctacctcggctgagaagtctctgagctctgcgaagctgaaggagatgagcggcagtgacatctttgctgatggaacgccagctccccgagaatacctcggcggcatccggaagccccctggtggtgagagcagcattgctctgatctgattgctgtcgagggctctaattcggactggctatagctcccctcgtcactgaagcgcgccgagagtgcatctgttgacctcttggctcttgaattgtgccggggatcataatttatgttgggtatcgttagtctaatataatgtagagtcaggagaatctgactcggttgctcgtgtcatctgatacgccggtgtgtgatctcgtctttgattcatgctacattattttgttatgtattagtgcatccgaactagaacttgtgcaataattattttggactcatttccgggcttatggtattataggatgttttgcttgtgctgttgttgacccaaaagatccatattcgtcttctatttgccctcttaacatttgattgcaaagtgtgggccgaatttgtatcatttggtaacaaaaaccatggaaacgaagattaaagtatccagag

SEQ ID NO: 971 - DNA, 1420 bp, Saccharum officinarum
tgtctctctgcagtaccggcccggaattcgggtcgacaccacgcgtccgccgagaggtgtcgtctgcctatcactgccatttcgctcccgaagaaatcgcgagaggggagcgtgccgagctgagcaggcaggcggtagtggccgagcgaaagcatcctcgatctcgtagccgccgccgctcggtaggaaggaaggagagcaatggagagggcggtgccggttcggaagccgcacaccaacacggccgaccttctctcctggtcggccacgggccctgacgcatctgcctcgccggccgcgtcctcccgccccagcctcaagccggccgcggggattacgccggcgatgttcggcgcgccggtcaccgagcaggaggccgaggatctgagcaagagtgaaaggaaattttgctctggctcaaagttgaaagaaatgagtggaagtgggatcttcactgagaagagtgaaaatggtgattcagaggcttcgaatcctgctaacaagacttccttgaggatgtaccagcaaactgtgaccggtataagccagatttcatttagtgctgatggaagtgtttcaccgaagaagccatcatcaatacctgaggtggctaagcagcgagagcttagtggtaccctggaagatgctgatgctaaaatcaataagcagctttctgaagctaagaccaaggagcttagtgggagtgacatctttggtccgcctcctgagattcctgccaggccattggctgctcgtaacatggagctacaaggaaatgtcgatttctcacttccacagcgaagcgtccacacatcagttaaagtatctaatcctgccggaggtccaagcaacatctcgttcagtgaagagcctgtagtgaaaacagcaaagaaaatccacaaccagaagttccaggagctgacaggtaacaacatcttcaaggaggacgtccctgcctcagctgagaagtctctgagctctgcgaagctgaaggagatgagcggcagtgacatctttgccgatggaactccagctccccgagaatacctcggcggcatccggaagccccctggtggcgagagcagcatcgctctgatctgattgttctggactgctttagttcggactggctatagctcccctcgtcactgaagctcgcagagagtgcatttcttgacctctcggttctccaatcgtgttggggatcataatttatgttgggtatcgttagtctaatataatgtagagtcagcagaatctgactcggtcactcgtatcatctgatacgccggtgtgtgatctctcatctttgattcttgctacattattatgtcaagtattagtacacccgaactggaacttttgcaataattattttggactcatttctgggcttatggcatcataggatgttttgctg

SEQ ID NO: 972 - DNA, 1624 bp, Zea mays
gaacaggcatggatgtgtaccagtaccagtacaaaccagtggcaggcagcggtgtcgccggcaaaaaatttcgaaacgagaggtgtctgcctatcacttgcgaagaaatcgcgaggggaagcgtgacacctgacgagctgagcaggcaggcggtagtggccgagcgaaagcatcctcgatctcgtcgtatcgtagctgccgccgctcagagcaatggagagagcggtgccagttcggaagtcgcacaccaacacggccgaccttctctcctggtcggccacgggccctgacgcatctgcctcgccggccgcgtcctcccgccccagcctcaagccggccgcggggattacgccggcgatgttcggcgcgccggtcaccgagcaggaggccgaggatctgagcaagagtgaaaggaaattttgctctggctcaaagttgaaagagatgggtgggagtgggatttttgctgagaagagtgaaaatggtgatgcagaggcttcaaatcctgctaacaagacttccttgaggatgtaccagcaaactgtgactggaataagccagatttcatttagcgctgatggaagtgtttcaccaaagaagccatcgtcgatacctgaggtggctaagcagcgagagcttagtggcaccctggaagatgctgatgctaaaatcaataagcagctttctgaagccaagaccaaggagcttagtgggagtgacatctttggtccgcctcctgagattccagcgaggccattggctgctcgtaacatggagctacaaggaaatgtcgatttttcacttccacagcgaagcgtccacacatcagttaaagtatctaatcctgccggaggtccaagcaacatctctttcagcgaagagcctgtagtgaagacagcaaagaaaatccacaaccagaagttccaggagctgacaggtaacaacatcttcaaggaggacgtccctgcctcggccgagaagtctctgagctctgcgaagcttaaggagatgagcggcagtgacatcttcgccgatggaacgccagctccccgagaataccttggcggcatccggaagccccctggcggtgagagcagcatcgcgctgatctgattgttctgggctgctctaattcgcactggctagcagcgccccctcgccagtcgtcactgaagcagcacacagagtgcatttcttgacctcttggttctcgaatcgtgttggggatcataatttatgttgggtgtcgttagtctaatataatttggagtcagcagaatctgatccggttacctccgtatcatctgatacgcgggtgtgtgatctcatctgtgatccatgctacattattatgttatgccatccgaactgagaacttatgcaacaattatttttggactcgtttctgggactatggcatcatataggatgttttgcttgtgctgtcgatgattccaaaggtacatagttttgaaaagaagacatgctacattattatgctatgtattagtacaaccgaactgagaacttatgcagtaattattttggactcgtttctgggattatggcatcatagatatgatattttgttttgtgctgttggtgatgcaaaggctccaatact

SEQ ID NO: 973 - DNA, 1469 bp, Panicum virgatum
gccccgcaggccgcagccgctcctccgcaggcaggaagggagggagggagggagggagggggagcagcgcaatggagagggcggtgccggtgcggaagccgcacacctccacggccgacctgctcacctggtcggccgcgggccccgacgcggccgccgcgtcctcccgccccagcctcaagccggcggcggggatcacgccggcgatgttcggcgcgccggtgagcgagcaggaggccgaggatctgagcaagagtgaaaggaaattttgttctggctcaaagttgaaagaaatgagtgggagtggcatctttgctgaaaagagtgaaaatggtgagtcagaggcttcaagtcatgcaaacaaaacttcagtaaggatgtaccagcaaactgtgactggaataagccaaatctcatttagtgctgatggaagtgtttcaccgaagaagccatcttctatacctgaagtggctaagcagcgagagcttagtggtactctggaagatgctgatgctaaaatcaataagcagctttctgaggctaagaccaaggagctcagcgggagcgatatctttggtccgcctcctgagattcctgccaggccattggctgctcgtaacatggagcttcaaggaaatgtggacttctcacttccacagaggagcgtccacacatcagttaaagtatctcatcctgctggaggaccaagcaacatctccttcagcgaagagcctgtggtgaagacagcaaagaaaatccacaaccagaagttccaggaactgacaggaaacaacatattcaaggaggaagcccctgcctcagctgagaagtctctgagttctgcaaagctgaaggagatgagcggcagtgacatcttcgctgatggaacacctgctcctcgagaataccttggtggtgtccggaagccccctggtggtgagagcagcatcgcactgatctaattgttgtcgtctgctctatccggactggctagctcccggatcccccttgtcactgaaatgcgtggcatgtgcatttcctgacctcccagttcttaattgtgctaggggatcttaatctatgctgggtatctttagtctaatataatttagagtcagcagaatctgactcgatcacttggctcatatctgatacgcctgcgtgtcatctcgtcatcttcgttttgtgctacttatatgtattaatccctctgaactgagaacttgtgcaataaataattatttttgaactcattcctgttcccctcattggatgtttagatcattgcttgtgttaacaaataatcaaatatgatgcaagtctctgcgatgcagctgtgccttctgctatttgcactcagaaacattttaagatatctgagttgcaatatccggagtggatttctgcaaatatgtttgctccaaaatataaaatattccagatgattttgatgcatttctaaattctag

SEQ ID NO: 974 - DNA, 907 bp, Festuca arundinacea
ggcacgaggcgccagtgccagtccgagccaagcagagaaggcagcagcagcacagcggcggtcgcacggagagcaatggagagggcggtgccggtgcggaacccgcacacctccacggccgacctgctcacctggtcgcccacggccgccgccgcctcagccgcgtcctcccgccccagcctcaagccggccggggggatcacgccggcgatgttcggcgcgccggtcagcgaggacgacgccgaggatctgagcagcagtgaaaggagattgatgtccggctcgaagatgaaagaaatgaccgggagcgggatatttgctgaaaagggtgagaatggtgattcggagtcttcaaatcccgctaacagaacttctgtgaggatgtaccagcaaactgtagctggaatgagtcagatctcatttagtgccgatggaagtgtttctccaaagaagccgtcctcactgcctgaagtggctaagcagcgagagcttagtggtacatttgagagtgacgctgaagctaaaaccagtaagcagctttctgaatccaagaacaaggagctcagcgggagcaatatctttggtccacctcctgtgaccccggtgaggccattggctgctcgtaatatggagctacagggaaatgtggattttgcacttccacaaccaagaagcgtccacacatcagtgaaagtatcccaccctgctggaggtccaagcaacatcacgttcagtgaggatcctgcaactaaaacatcaaagaaaattcacaaccagaagttccaagagctgacaggcaataacatcttcaaggaggatgcttcccctggctctgacaagtctctgagctctgcgaagcttaaggagatgagtggcaacgacatcttttctgatggaaaggcgtctt

SEQ ID NO: 975 - DNA, 1466 bp, Setaria italica
gtacgaaccagccgcagcagcggtggcaccggcaaatcttttcgaaaccggggcgtcagcctgtcactgccattccgctccgcgaagaaatcgcaggggagcgcgtgcgtgcctgccgagctgagcaggggcaggcgcaagtgccgagcgaaagcatccctcaagccgtcacctcccgccgcggccgctccgtaggaaggaaggaaggaggggcaatggagagggcggtgccggtgcggaagccgcacacctccacggccgacctgctcacctggtcggccacgggccccgacgcgcccgccggggcctcgcccgccgcctcctcccgccccagcctcaagccggccgcggggatcacgccggcgatgttcggcgcaccggtgagcgagcaggaggccgaggatctgagcaagagtgaaaggaaattttgttctggttcgaagttgaaagaaatgagtgggagtggcatctttgctgaaaagggtgaaaatggtgattcagaggattcaaaatctgctaacaaaacttccttgaggatgtaccagcaaactgtgactggaataagccagatctcatttagtgctgatggaagtctttcaccaaagaagccatcatcgatacctgaggtggctaagcagcgagagcttagtggtactctggaagatgctgattctaaaaccaataagcagctttctgaagccaagaccaaagagcttagtgggagtgacatctttggtccgcctcctgagattcctgccaggccattggctgctcgtaacatggagctacaaggaaatgtggacttttcacttccacagcgaagcgtccacacatcggttaaagtatctaatcctgctggaggaccaagcaacatctcattcagtgaagagcctgtagtgaagacagcaaagaaaatccacaatcagaagttccaggagctgacaggcaacaacatattcaaggaggaagcccctgcctcggccgagaagtctcttagctccgcgaagctgaaggagatgagtggcagtgacatcttcgctgatgggacgcccgctcctcgagaataccttggtggcgtccgaaagccccctggtggtgagagcagcatcgcactgatctaattgttatcgactgctcgaatccggactggctagcttccctcctcactgaagcgcacagtgtctgcatttcttgaccttgctcgaatctcaggactggtccttgaatctgcatgctttggggatcttaatttacgatgagtatctttagtctaatataatgtagagtcagcagaatctgactcggtcacttggctcgtatctgatacgcctgtgtgtgatctcatctttggtttgtgctactcattatgtgttagtctctccgaactgagaacttgtgaaataagtattttggactcatttctgttcttattgcatcattggatgcttagattattgcttgtgctg

SEQ ID NO: 976 - DNA, 1352 bp, Pennisetum glaucum
gggcgcgtgcctgccgagctgagcaggggcaggcgcaactgccgagccaaagcatccctcgagtccgccgcgaccggaagcaagcaaggaaggaaggaacaatggagagggcggtgccggtgcggaagccgcacacctccacggccgacctgctcacctggtcggccacgggccccgacgcgcccgccgggacctcgcccgccgcctcctcccgccccagcctcaagccggccgcgggtatcacgccggccatgtttggcgcgccggtgagcgagcaggaggccgaggatctgagcaagagtgaaaggaaattttgttctggttcgaagttgaaagaaatgaatggtagtggcatatttgctgaaaagggtgaaaatggtgattcagaggattcaaaatctgctaacaaaacttccttgaggatgtaccagcaaactgtgactggaataagccagatctcatttagtgctgatggaagtatttcaccaaagaagccatcatccattcctgaggtggctaagcagcgagagcttagtggtactctggaagatgctgatgctaaaaccaataagctgctttctgaagccaagaccaaagagcttagtgggagtgacatctttggtccgcctcctgagattcctgccagaccattggctgctcgtaacatggaactacaaggaaatgtggacttttcacttccacagcgaagcgtccacacatctgttaaagtatctaatcctgctggaggaccaagcaacatctcattcagcgaagagcctttagtgaagacagcaaagaaaatccacaatcagaagttccaggagctgacaggcaacaacatattcaaggaggaagcccctgcctcggccgagaagtctctgagctccgcaaagctgaaggagatgagtggcagtgacatattcgccgatgggacgcctgctcctcgagaataccttggcggcgtccgaaagccccctggtggtgagagcagcatcgcactgatctaattgttatcggctgctcgaatccggactggctagcttccctcctcactgaagcgcacggcgtgtgcatttcttgacctcgcttgaatcttgggactagtccttggatcatgctttggggatcttaatttatgatgggtatctttagtctaatataatataatgtagagtcagcagaatctgactcggtcacttggctcatatctgatacgcctgtgtgtgatctcatctttggtttgtgctactctatgttttagtccttctgaactgagaactgtgcaataagtatttggactcatttctgtttagattacatgtgctgtttatatataatgcaattatgcaaaa

SEQ ID NO: 977 - DNA, 1593 bp, Panicum virgatum
cgggtcccggccgcctccccagtggcccagtccccccaattcgaatcgaactccgccccagaactcaccgacaggtggctccagcgttctccggccccgcaggtcagccgtaccgtctcgttatcggggcgggacaggcgtggatgggtacctgcacaaacccgccgcaccggcaaatcttttcgaaacggggtgtccgggctgacgctgccatttcgctctgcgaagaaaccgcgagggggagcgtgcctgccgagctgagcaggggcaggcggaagcatccctcgtcaaccctgccccgcagccgctccgcaggaaggaggggaggagcacagtgcaatggagagggcggtgccggtgcggaagccgcacacctccacggccgacctgctcacctggtccgccgcgggccccgacgcggccgccggggcctcccgccccagcctcaagccggcggcggggatcacgccggcgatgttcggcgcgccggtgagcgagcaggaggcggaggatctgagcaagagtgaaaggaaattttgttctggctcaaagttgaaagaaatgagtgggagtggcatctttgctgaaaagagtgaaaatggtgagtcagaggcttcaagttatgcaaacaaaacttcagtaaggatgtaccagcaaactgtgactggaataagccaaatctcatttagtgctgatggaagtgtttcgccgaagaagccatcttctatacctgaagtggctaagcagcgagagcttagtggtactctagaagatgctgatgctaaaatcaataagcagctttctgaggccaagaccaaggagcttagcgggagtgacatctttggtccacctcctgagattcctgccaggccattggctgctcgtaacatggagctacaaggaaatgtggacttctcacttccacataggagcgtccacacatcggttaaagtatctcatcctgccggaggaccaagcaacatctccttcagcgaagagcctgtggtgaagacagcaaagaaaatccacaaccagaagttccaggaactgacaggcaacaacatattcaaggaggaagcccctgcctcggctgagaagtctctgagttccgcgaagctgaaggagatgagcggcagtgacatcttcgctgatggaacacctgctcctcgagaataccttggtggtgtccggaagccccctggtggcgagagcagcattgcactgatctaattgttgtcgtctgctctaatccggactggctagctcccggatcccccttgacctcccagttcttaattgtgcttggggatcttaatttatgctgggtatctttagtctaatataatataatgtatagtcagcagaatctgactcgatcacttggctcgtatctgatacgcctgtgttatctcatcttctgtttgtgctacttatatgtattcctccctccgaactgagaacttgtgcaataattattttgaactcatttctatttccctcattggatgtttagatcattgcttgtgttaacaaatatgatgcaagtctgtgtaatgcagctgtgccttctgctatctgcactcagaaacattc

SEQ ID NO: 978 - DNA, 1064 bp, Triticum aestivum
ccatcgaagcaccagtagcaggaactccctaacgccccagcgtgagatcgcgagattgtaatagcttgatcgaggcagtgaagacgagaggatgcagccgccatcgcagtaccaccagtcctcctactacgccgtgctcggcgtccacccaggcgcgtccgccgccgagatacgggccgcttaccaccgcctcgccatgaggtggcacccggataagattgccaatggccgtgtggatccggcgatcgcggaggaagccaagggaaggttccagaagatacacgaggcataccaggtgttgtcggatcagaagcggagggagctctatgacgccgggatgtacgaccccctcgacgacagccaacaagaggtcgagggcttccatgatttccttcaggagatgctctcgctcatggccaccgttggtagagaggagcccgtgtattccctgggggaactccaatccatgctcgacgggatgatgcaagatttcagctccccccaaccgccaccaccaagcagcttcttcaccagcaccggttcgtcgacgcggttcagcgcacccagcggcggagcgcagcagcagcgtcgacccccctcccgggtacggcctcaggggttcggcagctcggcatgcttcagccagacggctttctcgggctgctaagcacccgcgcgatctgcaccgcagttcatgcgtccgtgggtgtacgatcctggttacaaggatcaccggcgtgaagacactgaattgcagagactgggagagccattcacaggaaccgtcgagcgctgtagcgatgcacacagcaggagccggtactgtacatcaacccactggatgagcggaataaagaagacggtagatatttccagttgacagcaactcgaaaggatctccattgttagtttttcttggatagattgtaggtgtacatagatgagaatcagaagtgaagacgtgatgttttgcactgtggtgtatttacttcaaaagcaaccacgatgacacgtgttggagttgtcacaaacaaaaaatcagtaaagagtacgtgtaacgtgtt

SEQ ID NO: 979 - DNA, 1042 bp, Triticum aestivum
gtagcaggaactccctaacgccccagcgtgagatcgcgagattgtaatagcttgatcgaggcagtgaagacgagaggatgcagccgccatcgcagtaccaccagtcctcctactacgccgtgctcggcgtccacccaggcgcgtccgccgccgagatacgggccgcttaccaccgcctcgccatgaggtggcacccggataagattgccaatggccgtgtggatccggcgatcgcggaggaagccaagggaaggttccagaagatacacgaggcataccaggtgttgtcggatcagaagcggagggagctctatgacgccgggatgtacgaccccctcgacgacagccaacaagaggtcgagggcttccatgatttccttcaggagatgctctcgctcatggccaccgttggtagagaggagcccgtgtattccctgggggaactccaatccatgctcgacgggatgatgcaagatttcagctccccccaaccgccaccaccaagcagcttcttcaccagcaccggttcgtcgacgcggttcagcgcacccagcggcggagcgcagcagcagcgtcgacccccctcccgggtacggcctcaggggttcggcagctcggcatgcttcagccagacggctttctcgggctgctaagcacccgcgcgatctgcaccgcagttcatgcgtccgtgggtgtacgatcctggttacaaggatcaccggcgtgaagacactgaattgcagagactgggagagccattcacaggaaccgtcgagcgctgtagcgatgcacacagcaggagccggtactgtacatcaacccactggatgagcggaataaagaagacggtagatatttccagttgacagcaactcgaaaggatctccattgttagtttttcttagatagatcgtaggtgtacatagatgagaatcagaagtgaagacgtgatgttttgcactgtggtgtatttacttcaaaagcaaccacgatgacacgtgttggagttgtcacaaacaaaaaatcagtaaagagtacgtgt

SEQ ID NO: 980 - DNA, 913 bp, Pseudoroegneria spicata
  misc_feature (30)..(34): n is a, c, g, or t
cagccgccatcgcagcaccagtcctcctannnnnccgtgctcggcgtccacccaggcgcgtcctccgccgagatacgcgccgcgtaccaccgcctcgccatgaggtggcacccggataagattgcgagtggccgtgtggatccggcgatcgcggaggaagccaagggaaggttccagaagatacacgaggcataccaggtgttgtcggacgagaagcggagggcgctctatgacgccggggcgtacgaccccctcgacgacagccaagaagaggtcgagggtttccatgatttccttcaggagatgctctcgctcatggccaccgttggtagagaggagcccgtgtattccctcggcgaactccaatccatgcttgacggtatgatgcaggatttcacctccccccaaccgccgccaccaagcagcttcttcaccagcaccagttcgtcgacgcggttcagcgcacccagcggcggagcgcagcagcagcagcagcgtcgatcctcctcccgcgtgcggcctcaggggttcggcagctcggcatgcttcagccagacggctttctctggctgctaagcactcgcgcgatctgcatcgcagttcatgcgtccgtcggtatacattcttatttacaaggatcaccggccggcgtgaaggcactgaaatgcagagaccggggagcgctccagcgatgcagacagcaggagccggcactacatcacccactcactggatcagggaaataaagaagacggtagatatttccagttgagcagcaactcgaaggatctccattcttagttttttcttagataggtgtacatagatgagaatcagaagtgaagacgtgatgttttgcactgtggtgtatttacttcaaagagaaaagtctgaaattaaccttgaatttgta

SEQ ID NO: 981 - DNA, 1026 bp, Festuca arundinacea
  misc_feature (290)..(290): n is a, c, g, or t
  misc_feature (354)..(354): n is a, c, g, or t
  misc_feature (393)..(393): n is a, c, g, or t
  misc_feature (399)..(399): n is a, c, g, or t
  misc_feature (412)..(412): n is a, c, g, or t
  misc_feature (414)..(414): n is a, c, g, or t
ggcacgagggaatcaccagtagcaagaacatcccggcgtgagatcggcgatcgtgtgcagctgctttttttgtttttttgaggaacttcgtgtgcagctgcttggaggacagcattgatcgaagcacggagaggatcgaggatgcagtcgcagtcgcagtacggcacctcctactacgccgtgctcggcgtccacccccgcgcgtctgccgccgagatacgcgccgcgtaccaccgtctcgccatgaggtggcacccggacaagatcgcgaatggccgtgcggatccggngcgcgcggaggaggccaaggccaggttccagcagatacacgaggcgtacaaggtgttgtcggangagaagaggagggcgctctacgacgccgggatgtacgancccctngacgacgaccaanangaggtcgagggtttccacgatttccttcaggagatgctctcgctcatggccacagttggtcgagaggagcccgtgtattccctgggcgaactccagtccatgctcaacgggatgatgcaggatttctcctcgccccaaccaccaccaccgccaagcagcttcttcaccagcactgctccgtcgacgcggtccagcggtgggcagcagcagcgtcgatcatcctccagcgtgcggccccagggattcagcagctcggcatgcttcacccggacggctttctctggctgctaagcacttgggaccagtgatctgcattgcaatccgtgcatccaggtgttcatagctacgactcagttgagaaaccacaaggatcgccgatgtgaaggcactgactgaattgcagattcagggaggtcatcggggatgtcgaacgctcctgcgatgcaacggatcaggggaataaagtagatggaagtagatggcacataggtttccaattgacgagagcatttttgttcttcgttgtagtctttgcataaataggtgtacatagatcgacgaccacctcattctgtacgatcgtgtgacattaggaattggtgttgcatttgt

SEQ ID NO: 982 - DNA, 1456 bp, Brachypodium distachyon
gtggcgagggccggcgctcctggaacgttcccgacgcgagatatttttcccctcgcctttctttcccgccgcgcccaagcccaagcccaagccggctagttcaactcctcccccttcgcaacgcttctcccttcttctcctcctcctcctcctctgatctctctctatatatactcctgccgcctccgttgggatacctccttgcttcccgtctcaggtcgccatcgaagcaccagtagcacgcacgaacgctctaaaaccagcgccagatcgcgcgatcgccagcgcgtagtgtagcttgaaggatagtccctgattgaggcagaggaagaggtggaggatgcagtcggcggagtcgcactaccagtcctactacgccgtcctcggcgtccaccccggcgcgtctgccgccgagatacgcgccgcctaccaccgcctcgccatgaggtggcacccggacaagatcgccaatggccgcgcggatccggcgctcgcggaggaagccaagggcaggttccagaagatacacgaggcgtaccaggtgttgtcggacgagaagaggagggcgctctacgacgccggggtgtacgacccccttgaggacgggcaagaagaggtcgagggtttccacgatttcctccaggagatgctctcgctcatggccaccgttgggagagaggagcccgtgtattcccttggcgaactccaatccatgctcgacggtatgatgcaggatttcgcctcgccccagccggcggcggcggcagcggcaccaccaagcagcagcagcagcagcagcagcagcttcttcaccggcgccggttcgtcgcggttcaacgcaccgagcagcgggcagaagcgtcgacgatcctcctcccgcgtgcgaccccaggggttcggcagctcggcgtgcttcagccgcacggctttctctggctgctgagcactctcgttttcctgcacgcgtcgcaattcatgcatctgggactctgggtgtcccaggcaggcttcagaaaccactatgatcgccgatgtgaggacagtattgtttgaagggtcgttggggatgtcgagcttttgcgatgcacggagcacacccgttagatcgaggggaataaacgatggatatgtttctagttgagcaggaacacaagaggggcttttggtactactttttttttccgagttttttctagataggtgtacatagagaacatcctcattctgtgcgaccgtgtgacattacgaactggtgttgcatttgtacagcttgagcttttgtgcgtgcgtctggtgacaatttgtagtgaaggttgtcctttttttgcccaagataaagcctattttccagctctgcccaatccattctctgctgatgtctctactccaaaagcaatcaacgacgcgtgtctgctgcgcataaaaagctctctagaacctgctcatcttttctttt

SEQ ID NO: 983 - DNA, 2109 bp, Triticum aestivum
ctctctccttcacctcactctctctccaccccgacccccgctgccgaatccccaaacccccgccgtcgcaatcatccgcccgtgggggcaggcgcgcgcggatttctgtggactccggcgtccccggcccggattgatcccgccgctcctcccctcctcccgattctcgccatccaatcttttgctcccttcctttcccggccgcctccctggtttcttgccgaaattgcctgccacctgtttggactctggacgcgcgcataacttgcctcgccattgtggctgctctgctcagcccggctgcttctttggatctgctagctcgcctgccgccggcctccgggccgcgcatgcccgtcctcccccgctccaaatatcgtcctcgtttcggaggtcctcgtatgcggatgaggaggggatcctgacctgactcttgctcggctccggcggtccccttcttggatcctcgctcgcggcggaggcgtgccgggatgggtttcttgatctgcgcctgcctcctccagctgctcttcttgggctcttctccggcggcggcacagtcaccgtcgccggcgagggccctggacgcaatgctgcaggactacgcgtaccgggccttcgtccggccgcacaccggcattgtctacaacggcaccgtgcctgcggacctcgccggcgtcgcggtgtccgggctccgcctgcgcagcggcagcctgcggaggaaaggcttctccgactacttcgagttcagcatcccccctggcgtcatcgtgcagccgtacgtcgagagggtggtgctcgtgtaccacaacctgggcgagctgtcggagaagtactacccgctccccggctacacctacctctcgcccattctcgggctgctggtctacgacgctgccaacttgtcagcagcggggttgtccgagctgagcatcgtcgcgtcagggagcccgatttctgtgagtttcagcaatgtgagggcggtgccctcaggcagtccagcgccgcagtgtgtgtggtttgatttggatggcgtgccacagttccggggcttggaggcaaacaacgtgtgtgcaacgtatcgccgagggcacttctccatagtggtgaactccagtgaggttgctcctgctccagggccttcaggcgcaattgccccaccgataccgactaatggtggtcgtgataagggtagttcggacgcatggaagattgctgtcggcgttgttgggggcgtcattgcattggggctgttggctttgcttctggtgtgttttgtcagatataaaagggaaaagaagatggaggtgatggaacgaaatgcagaggtcggggagactttgcgcatggcgcaggttgggcggtcgcaagcgcctgtagcgttgggaacgcgaacaaaacctgtgattgagagtgagtatgttgcctagttgatttttggtgttctgcagaattcaggcaacagcagcaatgctctatgatgatgccctgagatgtggaattgtccaccggtcagttgaggcagaaagcattccatgtcagtgagggtgctgtgaattgctaggtttagggttcagctgctgctccttgcgggtagcaaattcttttggcggttcttattaggacttgaattgttctgcaatggttactgttgatgttcatagtcgccatgttccttgttgggttcatctgcaagcaagcaatggagaagagatatttgtcatgccagatttggaatccttcgattattttttcattgttgtattcagaaggaaaatgggcctggcaataaggctgaggtaatattcattgcacatgccattgtgctgttccagtgaaattcatacaggttccaactcaattccattttggtgccttttagcttctcctgtttggacaaatgtttaatacaatgtaaatgtttactcatttagtttggtttggtaactaatctgcttatttagatttcattgttgcttgttttaacatgcagtctgtatgcagtgagaaccttccttttttcttctcagaaaggttctcatttctgtctgtaccttcttgatgatccaaccttgtgatttaagaattaacatgcagtctgtgtgcagt

SEQ ID NO: 984 - DNA, 1789 bp, Secale cereale
cccggcccggattgatcccgccgctcctcctcccgattcttgccatccaatcctttgctcctttcctttcccggccgcctccctggtttcttgccgaaattgcctgccacctgtttggactctgggcgcgcgcataactccccttcgccattgcggctgctctgctcagcccggctacttctttggatctgctagctcgcccgcgccgtcctcccccgctccgaatctcgtcctcgttttggaggtcctcgtatgcggatgaggaggggatcctgactcttgctcggctccggcggctcccttcttggatcctcgcggcggaggcgtgccgggatgggtttcttgatctgcgcctgcctcctccagctgctgttcttgggctcttctccggcggcggcgcagtcgccgtcgccggcgaggcccctcgacgcaatgctgcaggactacgcgtaccgggccttcgcccggccgcacaccggcattgtctacaacggcaccgtgcctgcggacctcgccggcgtcgccgtgtccgggctccgcctgcgcagcggcagcctgcggaggaaaggcttccccgactacttcgagttcagcatcccccctggcgtcatcgtgcagccgtacgtcgagagggtggtgctcgtgtaccacaacctgggcgagctctcggagaagtactacccgctccccggttacacctacctctcgcccattctcgggctgctggtctacgacgccgccaacttgtcagcagtggggttgtccgagctgagcatcgtcgcgtcagggagcccgatttctgtgaagttcagcaatgtgagggcggtgccccaggcagtccagcgccgcagtgtgtgtggtttgatttggacggcgtgccacagttccggggcttggaggcaaacaacgtgtgtgcaacgtatcgccgagggcacttctccatagtggtgaactccagtgaggttgctcctgctccagggccttcaggcgcaattgccccaccaataccgactaatggtggtcgtgataagggtagttcggacgcatggaagattgctgtcggcgttgttgggggcgtcattgcattggggctgttggctttgcttctggtatgttttgtcagatataaaagggaaaagaagatggaggtgatggaacgaaatgcagaggtcggggagactttgcgcatggcgcaggttgggcggtcgcaagcgcctgtagcgttcggaacgcgaacaaaacctgtgattgagagtgagtatgttgcgtagttgatttttggtgttctgcagaattcaggcaacagcagcaatgctctatgatgatgccctgagatgtggaattctccaccggtcagttgaggcagaaagcattccatgtcagtgagggtgctgtgaattgctaggtttagggttcagctgctgctcctcgcgggtagcaaattcgtttggcggttcttattaggacttgaattgttctgcaatggttactgttgatgttcatagtcggcatgttccttgttgggttcatctgcaagcaagcaatggagaagtgatatttgtcatgccagatttggaatccttcgattatttttcattgttgtattcaaaaggaaatgggcctggcaataaggctgaggtaatattcattgcacatgccactgtgctgttccagtgaacttcatacaggttccaactcaattccattttggtgccttttagcttctcctgtttggacacatgtttaatacaatgtaaatgtttactaatttagtttggtttggtactga

SEQ ID NO: 985 - DNA, 1624 bp, Triticum aestivum
ctgtggggttggttctcttctccctcccaccgggggcttctggcccccgctataaatcttccccgacgccgcacgcaaaatccaaaaatccccaaccccaaacctagtacactgcactgtagcagcagcgggaggaggaggatggtggtgaagagcggaggaggaggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgcaaggtccacttagactacatagaagcaggtgcaaacattataattacagcatcatatcaggctaccattcaagggtttgagtccaagggattttcaaaagaacaaggtgaaaatttactaacaaagagtgttgagattgcatgtgaagcacgggagatgtttctgaagcagcatccagatcaatccactcccttgcgtcctattctggttgcagcttcaataggaagttatggggcttatcttgctgatggctctgagtacagtggggattacggtgaagctgggacactagaattcctgaaagattttcatcggcggagacttcaggttcttgcagaagcacgtcctgatttgattgcttttgaaacaatccctaacaaattggaagctcaggcatatgttgaacttcttgaggaatgcaacataaatatcccttcatggttttccttcaactcaaaagatggagttaatgttgtgagtggagactcattaatcgaatgtgctaaaattgctaatgaatgtgcaaaggttggtgcagttggtataaactgcacacctccaagatttattcatagcttgatactctccattcggaaggtcacagacaagccaattctgatatatcccaacagtggagaaagatacgatgctgagaaaaaggagtgggtggaatccactggtgtgtcagacggcgatttcgtttcatatgtaggcgagtggtgcaaagatggggctgcccttattgggggctgctgcaggacaactccaaacaccatcagggcaataactagatcccttaaccaatactacccagcagcatagagttgtactccttcagacggcttgcccctggtgttacgttgtcaacatgtcctggagatttagtaatagctgcgtgatgttctacaaaatgagatacctgtgcacttacatttgtgaaatggtggtgtattcttcttagttctcaagtcggcctactcggaggtacaatcagtcgaggattagcaagcagtaatagtgaagttgtactgaggagcgagcgaaatgattgcggcgaaggttcatgaacccttattagctattaagagagtttgaggcaatgtatgtgatacagattcagagttgttatggagatattaacctgcaataagctgctatgctgttgtgtactagtgctgccttatgtataccctgtttcctgtagtgcactgtaggttttatctcaactactatgtatgtattcccctctgaaaatgatgaattctcctgaggatttctttca

SEQ ID NO: 986 - DNA, 1122 bp, Pseudoroegneria spicata
  misc_feature (3)..(3): n is a, c, g, or t
  misc_feature (7)..(8): n is a, c, g, or t
ctncccnntagcagcagcagcaggaggaggatggtggtgaagagccgaggaggcggctgcgcggaggagggggccgcgggcgcggcggtgcggcggtgggtggaggccggcggcgggaggctggtgctggacggcgggctggccacggagctcgaggccaacggcgccgacctcaacgacccgctctggagcgccaagtgcatcctctcctccccgcacctcatccgcaaggtccacttagactacatagaagcaggtgcaaacattataattactgcatcgtatcaggctaccattcaagggttcgagtccaagggattttcaaaagaacaaggtgaaaatttattaacaaagagtgttgagattgcacatgaagcacgtgagatgtttctgaagcaacatccagatcaatccactgcattgcgtcctattctggttgccgcttccatcggaagttatggggcttatcttgctgatggctctgagtacagtggggattatggtgaagccggaacacttgaattcctgaaagattttcatcggcgaagacttcaggttcttgcagaagcacggcctgatttgatcgcttttgaaacaatccccaacaaattggaagctcaggcttatgttgaactccttgatgaatgcaacataaatatcccttcatggttttccttcaactcaaaagatggagttaatgttgtgagtggagactcattaatcgaatgtgctaatattgctaatgcatgtgcaaaggttggtgcagttggtataaactgcacgcctccaagatttattcatagcctgatactctccattcggaaggtcacagacaagccaattctgatatatcccaacagtggagaaagatatgatgccgagaaaaaggagtgggtggaatccactggtgtgtcagacggcgattttgtttcttatgtaggcgagcggtgcaaagacggggctgcccttatcgggggctgctgcaggacaactccaaacaccatcagggcaataagtagatctcttaaccaatactaccctgcgccttaggtatttgtggcacagagttgtaccctccgtcagacgggttactcctggtgttatgttgtgaacatgtcctgg

SEQ ID NO: 987 - DNA, 1527 bp, Triticum aestivum
ccgccccaaacctagtacactgcactgtagcagcagcgggaggaggaggatggtggtgaagagcggaggaggaggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgcaaggtccacttagactacatagaagcaggtgcaaacattataattacagcatcgtatcaggctaccattcaagggtttgagtccaagggattttcaaaagaacaaggtgaaaatttactaacaaagagtgttgagattgcacatgaagcacgtgagatgtttctgaagcaacatccagatcaatccactcccttgcgtcctattctggttgcagcttcaataggaagttatggggcttatcttgctgatggctctgagtacagtggggattacggtgaagctgggacactagaattcctgaaagattttcatcggcggagacttcaggttcttgcagaagcacgtcctgatttgattgcttttgaaacaatccctaacaaattggaagctcaggcatatgttgaacttcttgaggaatgcaacataaatatcccttcatggttttccttcaactcaaaagatggagttaatgttgtgagtggagactcattaatcgaatgtgctaaaattgctaatgaatgtgcaaaggttggtgcagttggtataaactgcacacctccaagatttattcatagcttgatactctccattcggaaggtcacagacaagccaattctgatatatcccaacagtggagaaagatacgatgctgagaaaaaggagtgggtggaatccactggtgtgtcagacggcgatttcgtttcttatgtaggcgagtggtgcaaagatggggctgcccttattgggggctgctgcaggacaactccaaacaccatcagggcaataactagatcccttaaccaatactaccctgcgccttaggtatttgcggcacagagttgtaccctccttcagatgggttactcctggtgttactttatcaacatgtccctgagatttagcaatagctgtgtgatgttctcctgcaaaatgagatagctgtgcacttacatgtgcgaaatggcggtgtgtttctagcaaacagtaagctgtactaaggagtgatcgcaagcagtaacagcgaagttgtactaaggagtgagcgaaactatctgcggcgaggttcatgaccccttattacctattaagagagtttgaggcaatgtatgttatacagattctgagttgttatggaggtattaacctgcaataagctgctatgttgttgtgtgctaatgctgtcttgtgggtaccctgttttattgtaccataagttttatctgagctactatatatgtatttccatctgaaaatgaagaattttcctggtttccttt

SEQ ID NO: 988 - DNA, 1627 bp, Triticum aestivum
gcaatcccaaaccaacctagtacactgcactgtagcagacgcggcagcaggaggaggaggatggtggtgaagagcggaggaggaggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgcaaggtccacttagactacatagaagcaggtgcaaacattataattacagcatcgtatcaggctaccattcaagggtttgagtccaagggattttcaaaagaacaaggtgaaaatttactaacaaagagtgttgagattgcacatgaagcacgtgagatgtttctgaagcaacacccagatcagtccactcccttgcgtcctattctggttgcagcttcaataggaagttatggggcttatcttgctgatggctcagagtacagtggggattatggtgaagctggaacactagaattcctgaaagattttcatcggcggagacttcaggttcttgcagaagcacgtcctgatttgatcgcttttgaaacaatccctaacaaattggaagctcaggcatatgttgaacttcttgaggaatgcaacataaatatcccttcatggttttccttcaactcaaaagatggagttaatgtcgtgagtggagactcattaatcgaatgtgctaaaattgctaatgaatgtgcaaaggttggtgcagttggtataaactgcacacctccaagatttattcatagcttgatactctccattcggaaggtcacagacaagccaattctgatatatcccaacagtggagaaagatacgatgccgagagaaaggagtgggtggaatccactggtgtgtcagatggcgatttcgtttcttatgtaagcgagtggtgcaaagatggggctgcccttattgggggttgctgcaggacaactccaaacaccatcagggcaattagtagatctcttaaccagtactaccctgcgccttaggtatttgcggcacagagttgtaccctccttcagatgggttactcctggtgttactttatcaacatgtccctgagatttagcaatagctgtgtgatgttctcctgcaaaatgagatagctgtgcacttacatgtgcgaaatggcggtgtgtttctagcaaacagtaagctgtactaaggagtgatcgcaagcagtaacagcgaagttgtactaaggagtgagcgaaactatctgcggcgaggttcatgaccccttattacctattaagagagtttgaggcaatgtatgttatacagattctgagttgttatggaggtattaacctgcaataagctgctatgttgttgtgtgctaatgctgtcttgtgggtaccctgttttattgtaccataagttttatctgagctactatatatgtatttccatctgaaaatgaagaattttcctggtttctttcatcactgagatacaaaattgccaacaaaatcattgatttttttttcttgtaccataagatttatctcaactattatgcatgtatttccc

SEQ ID NO: 989 - DNA, 1384 bp, Secale cereale
aggaggaggatggtggtgaagagcggaggaggaggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgccaggtccacttcgactacatagaagcaggtgcaaacattataattactgcatcgtatcaggctaccattcaagggttcgagtccaagggattttcaaaagaacaaggtgaaaatttactaacaaagagtgttgagattgcacatgaagcacgtgagatgtttctgaagcagcatccagatcaatccactgcctcgcgtcctattctggttgccgcttccataggaagttatggggcttatcttgctgatggctctgagtacagtggggattatggtgaagctgggacactagaattcctgaaagattttcatcggcgaagacttcaggttcttgcagaagcacgtcctgatttgattgcttttgaaacaatccctaacaaattggaagctcaggcatatgttgaacttcttgaggaatgcaacataaatatcccttcatggttctccttcaactcaaaagatggagttaatgttgtgagtggagactcgttaatcgaatgtgctaaaattgctaatgcatgtacaaaggttggtgcagttggtataaactgcacacctccaagatttattcatagcctgatactctccattcggaaggtcacagacaagccaattctgatatatcccaacagtggagaaagatacgatgccgagagaaaggagtgggtggaatccactggtgtgtcagatggcgatttcatttcttatgtaggcgagtggtgcaaagacggggctgcccttatcgggggctgttgcaggacaactccaaacaccatcagggcaattagtagatctcttaaccaatactaccctgcgccttaggtatttgcggcagagttgtaccctccttcagatgggttactcctggtgttatgttgtcaacatgtcctggagatttagttatagctgtgtgatgttctcctgcaaaatgagatagctgtgcacttacatgtgcgaaatggcgccgtgtttctagcaaacagtaagctgtactaaggagtgatagcaagcagtaacagcaaaggtgtaccaaggagtgagcgaaacgatccgcggcgatgttcaggaccccttattagctattaagagagtttgaggcaatgtatgtgatacagattatgagttgttgtggagacattaacctgcaataagctgctatgttgttgtgtactaa

SEQ ID NO: 990 - DNA, 1774 bp, Secale cereale
gccttagggcgagacgccaaatgacaaatttacatttgttgtcgctactatttggcgtacactctagtctagtgtgctgcttgaaaagagagtaagccaagtccggtgaggacaagctcacgtggcatgtttacttggataggagaaactcatgtaagatagggtagggtagagcggatgacctaaaaactctctttgccgtgtcatcatcagctgaaacgcacctctccccgcctccgttccagcttgaggttctcttctccctataaatcgtccccaacgccgcacgcaaaatcccaaaatccccaatcccaaacctagtacactgcactgtagcagcaggaggaggaggaggatggtggtgaagagcggaggaggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgccaggtccacttcgactacatagaagcaggtgcaaacattataattactgcatcgtatcaggctaccattcaagggttcgagtccaagggattttcaaaagaacaaggtgaaaatttactaacaaagagtgtggagattgcacatgaagcacgtgagatgtttctgaagcaacatccagatcaatccactacctcgcgtcctattctggttgccgcttccataggaagttatggggcttatcttgctgatggctctgagtacagtggggattacggtgaagctgggacactagaattcctgaaagattttcatcggcggagacttcaggttcttgcagaagcacgtcctgatttgattgcttttgaaacaatccctaacaaattggaagctcaggcatatgttgaacttcttgaggaatgcaacataaatatcccttcatggttttccttcaactcaaaagatggagttaatgttgtgagtggagactcgttaatcgaatgtgctaaaattgctaatgcatgcacaaaggttggtgcagttggtataaactgcacacctccaagatttattcatagcctgatactctccattcggaaggtcacagacaagccaattctgatatatcccaacagtggagaaagatatgatgccgagagaaaggagtgggtggaatccactggcgtgtcagatggcgatttcatttcttatgtaggcgagtggtgcaaagacggggctgcccttatcgggggctgttgcaggacaactccaaacaccatcagggcaattagtagatctcttaaccaatactaccctgcgccttaggtatttgcggcagagttgtaccctccttcagatgggttactcctggtgttatgttgtcaacatgtcctggagatttagttatagctgtgtgatgttctcctgcaaaatgagatagctgtgcacttacatgtgcgaaatggcggtgtgtttctagcaaacagtaagctgtactaaggagtgatagcaagcagtaactgcgaagttatattaaggagtgagcgaaacgatccgcggcgatgttgaggaccccttattagctattaagagagtttgaggcaatgtatttgatacagattatgagttgttgtggagacattaacctgcaataagctgctatgttgttgtgtactaatgctgtcttgtgggtaccctgttttattgtactaccataagttttat

SEQ ID NO: 991 - DNA, 1529 bp, Secale cereale
ttccagcttgaggttctcttctccctataaatcgtccccaacgccgcacgcaaaatcccaaaatccccaatcccaaacctagtacactgcactgtagcaggaggaggatggtggtgaagagcggaggaggaggcggcggcgcggaggagggggccgcgggcgcggcggtgcggcggtgggtggaggccggcggcgggaggctggtgctggacggcgggctggccacggagctcgaggcccacggcgccgacctcaacgacccgctctggagcgccaagtgcatcctctcctccccgcacctcatccgccaggtccacttcgactacatagaagcaggtgcaaacattataattactgcatcgtatcaggctaccattcaagggttcgagtccaagggattttcaaagaacaaggtgaaaatttactaacaaagagtgtggagattgcacatgaagcacgtgagatgttctgaagcaacatccagatcaatccactgcctcgcgtcctattctggttgccgcttccataggaagttatggggcttatcttgctgatggctctgagtacagtggggattacggtgaagctgggacactagaattcctgaaagatttcatcggcggagacttcaggttcttgcagaagcacgtcctgatttgattgctttgaaacaatccctaacaaattggaagctcaggcatatgttgaacttcttgaggaatgcaacataaatatcccttcatggttttccttcaactcaaaagatggagttaatgttgtgagtggagactcgttaatcgaatgtgctaaaattgctaatgcatgtacaaaggttggtgcagttggtataaactgcacacctccaagatttattcatagcctgatactctccattcggaaggtcacagacaagccaattctgatatatcccaacagtggagaaagatacgatgccgagagaaaggagtgggtggaatccactggcgtgtcagatggcgatttcatttcttatgtaggcgagtggtgcaaagacggggctgcccttatcgggggctgttgcaggacaactccaaacaccatcagggcaattagtagatctcttaaccaatactaccctgcgccttaggtatttgcggcagagttgtaccctccttcagatgggttactcctggtgttatgttgtcctgcaaaatgtcctggggatttagttatagctgtgtgatgttctcctgcaaaatgagatagctgtgcacttacatgtgcgaaatggcggtgtgattctagcaaacagtaagctgtgctaaggagtgatagcaagcagtaacagcgaagttgtactaaggagtgagcgaaacgatccgcggcgatgttgaggaccccttattagctattaagagagtttgaggcaatgtttgtgatacagattatgagttgttgtggagacattaacctgcaataagctgctatgttgttgtgtactaatgctgtcttgtgggtaccctgttttattgtactaccataagttttat

SEQ ID NO: 992 - DNA, 1728 bp, Brachypodium distachyon
aggttctctcttcccttctttccctacaaaaccgccccccagcccaggcggccacccacgacacaccgcacgcagcaaaatccagagccccaattccccactcgcaaaccttgtactctctgaggacagccagcagccgccaggaagtagaagaaggaggggagatatggtggtgaagagcggaggaggaggagtgggggaggagggggcggcgtgcgcggcggtgcggcggtggctggaggccggcggcgggaggctggtgctggacggcgggctggccacggagctggaggcccacggcgccgacctcaacgacccgctctggagcgccaagtgcatcctcgcctcccctcacctcatccgcaaggtccatttggactacatagaagcaggtgcaaacatcataatcacagcatcatatcaggctaccattcaagggtttgagtctaaggggttttcaaaacaacaaggtgaagatttactaacgaagagtgttaaggttgcacaggaagcacgtgagatgtttctgaaggagcatccagatcaatccactcccatgcaacatcctattttggttgcagcttccataggaagttatggggcttatcttgctgatggctccgagtacagtggggattatggtgaagctggaacactagaattcctgaaagattttcatcggcgaaggcttcaggttcttgcagaagcaggtcctgatttgattgcctttgaaacaatccccaacaaattggaagctcaggcatatgttgaacttcttgatgaatgcaacataagtatcccttcatggttttccttcaactcaaaagatggagttaatgttgtgagtggagactcactaattgaatgtgctactattgctaatgcatgtgcaaaggttggtgcagttggaataaactgcacgcctccaagatttattcatggcctgatactctccattcggaaggtaacagacaagccaattctgatatatcccaatagtggggaaagatatgatgctgagaaaaaggagtgggtggaatccactggtgtgtgcgatggtgatttcgtttcttatgtaagcgagtggtgcaaagacggggctgcccttatcgggggctgctgcaggacaactccgaacaccatcagggccataaacagatcccttaaccaatgcttgcctgcaccgtagttatctgtggcgtagagttgcggcgcactccttcagacgcatcactccttggtgttatcatatgaacaacatgtcctggagatttagtaagagaaacacaatgttctcctgcaaatgagatagttctgcacttacatttgtgaaaggacggtctgtatatgtccttagttcttaagttggccaggtacaatcagtcaaagagagctgaagtctatgtaagaagtgagctagacaatctgcggcgaagttcatgacccccttattagctatcaagagagctgaacactatgtatgtcatacagactcttgagttgtgctggagatgttaaccttgtgtaataataattaataagctcttatgttaaccttgtggactctgttttcttgtactgtaaattttgtctgaactatggttgtatttccctctttaagatgaggacctcctcccccctgtagctgtgataccaaattaccacaacactctttagtcattccagaatatttattttcttcttaacagaaactcatttacatgatca

SEQ ID NO: 993 - DNA, 3449 bp, Setaria italica
cagcagccgagcacatgcccatcgcgttgcacgctgcctccccccacccccacctttctggcgccgctctccttcctcctataaatcctccccccacgccggaatccaaatccagaccccgattcaagtttttacatcgagaatttgcgagcacaaggcgctgagcagaggagcagcagcagcagcagcggccagggcgaggcgagagatggtggggacggccggcggcggcgcggaggaggcggtgcggcggtgggtggaggccggcggcgggcgcctcgtgctggacggcgggctggccacggaactcgaggccaacggcgccgacctcaacgacccgctctggagcgccaagtgcctcctcgcctccccgcacctcatccgcaaggtccatatggactacctagaagctggtgcaaacattataatcacagcatcatatcaggccacgattcaagggtttgagtcaaagggtttctcaaaagaacagagtgaaaacttattaacaaagagtgtcgagattgcactggaagcgcgtgagatgttcctgaaggaacatttggagcaatccactcctacacaaaaacctattctggttgcggcttctataggaagttatggggcttatcttgctgatggctctgagtacagtggggattatggtgaagctggtacagtacagttcctgaaagattttcatcggcgtaggcttcaggttcttgctgaagcagcccctgatttgattgcttttgaaacgatccccaacaaactggaagctcaggcatatgttgaacttcttgaggaatgtaacatacatatccctgcatggttttccttcaactcaaaagatggagttcatatcgtgagcggagactcattgatcgaatgtgctactattgctgacaagtgtgcaaaggttggtgcggttgggataaattgcacacctccaagatttattcatggactgatactctccattcgaaaggtcacagacaagcctattctgatatatcccaacagtggagaaagatatgatggtgagaaaaaggagtgggtggaatgcactggagtatcagatggtgattttgtttcttatgtaagtgaatggtgcaaagatggggccgcccttattgggggttgctgcaggacaactccaaacaccatcagggccatacaaagaactctaaaccaaggctccaacgcgcgctttactatggcatagagctgtgctctacttccagatgtgcacctcctggagaagtggagattctttaactagtggcccgatatgctgctgtgtgtcctgcaaatgagatggttctgcacctatgtctgtaaataccgatgtatttccaagttcttatgctattgcacttggaggtgcaaccagtgaagagggataaggaagcagcaccgatgaacggagttctactgaggattgagtgaagcaagttgcggctgagttgatgaagcttttagtagctatcgttattaagagtttgtataactgagagttgctctggagatgctatcttgcaataagagagcttatgtcgtgtactagtaacttccctgtgaaatgtttgttagaccatgagttttctctgataaacctgcatgtcctgaaacgaaaagatcttgttacttctcttttgttagcactgagcttctgtgagggctttagatttacttaccaatcagccatcaattttattcttcacagggttgtcactcgtattcgaaaatacaattcacagaaatccataacatagagcccacgattactatgatattaatcatatcattgacatcacctgctttcttccgcaagtgcaaataaagcacgctaacagaaatcgaaataatcaaatcacatcatctaaatgaccggtacctattgacagcaattcgagagtagcaaagcaaatcgtcacaatgtagctaacatggaccttcataacagtaaatattgcggtggcatttaacgaaacaacataaagtagaaaacatcaaagcgttaacggtacttcaatcactccataaacaacagtctggtccatgagcaacatggcatgattgtagctcaaacggtccgcagcccaaatcacttgcagagctaagtaaggccagctaaactgacagtggaccacatcttttttaagccatgatcttggccgatctcatgtaaaggctgtccacaaccttcccgacatttgtgatcgtctcgagcgtggcagggaagatctcctcggtcttggtatcctcgaagatgatgaggcagccagcgccctgatccagagtccccgcgaatttcttgtcgaggatcatctgggacagcttcttctcaacatggtcgatcggcagctcaatcatctctgctatgtgtgcaatctccaccctagagtagggctcaatcaacctgcagaggttctgctccaggagggtatcgtaaagcgacgagaggtgcctatggacgataggatcttcctccagctgggacttgtagtcacggagagcagtttcaaagtacttcagagaccttttggagtaggcatcggccacagctttcatggcatcaacatcaggacccagatacttcaggccagcctttgatgagatgattcctgcaacatcatcggcttggttgaccattatcttgcacagaagcatgtacttcaagctgaagatggccttaggatcctccagagaattgaaagcttcaaatgcttcgaagaagtagctgtaagcagtcttgtagtccttttcttcagcatgaaggattccactctgcagatcaatagtgccctgctgagatggtggcacataaatggcattggctgcagttctagcagcagtcagagaagctttggcctttggcagatttctcagagagaaatggagtttgctctccagaaggtcaatgtccacaagaagcaacttgtcgtccagcctcctgacttccttgatgagaccagaaaggagcgtaagggcctcggtataatcctgattctctaacagaagggctgccagccttgcttccacacgctgcctgaggaaggtacgcttctctgtacgggtccattccaccatctccttgcagagtgagatctgaagctcagaagttccaggtatcttggcaacagcatcaatgatgccacgcacaatcttcgcagtctttgccttcgggatcacagcaaaaaagggcctgagctgggtcaaaagattcctgagatcctcagctctgttttcttttgtgaggtagtttgtcagatttgtaatggcaagctcttttactctcagtgcatccgctgaagaagatgggtcttcgagcacacggtagaggattgagatggactcagacgcatccttggcttcctgagcctttgatatcgactcagtggtagcaggaaggtacggtgattgcaccgaagtagacatcgccactccct

SEQ ID NO: 994 - DNA, 2073 bp, Oryza sativa
ggactttgtaataattgatggtagcttgttgagcaaaaccggaacgctattttattattaaaaaaacttaattagagatgcctatgtgattatccaaaaaaaaaaagtattgacagcaaagacgaaggggataggcataaaccctttctctgtggtgtcagcagccgaacccaactgcaaaaggcgccatttttttcccctctttccctcgtcttcttcctccaaatccttcgccccctcctataaatccacctcgcgcaaatccaaatccaaatccaagctcggagaagagacctacctacctacctacctactctaggcgggagagatggtggggaagagcggggtggcggaggagggcggagcggcggcggcggcggcggtgaggaggtgggtggaggccggcggcgggaggctggtgatggacggcgggctggcgacggagctggaggccaacggcgccgacctgaacgacccgctctggagcgccaagtgcctcctctcctccccgcacctcgtccgcaaggtccatttagactacctagaagcaggtgcaaatatcataatcacagcgtcataccaggctacaattcaaggctttgaatccaagggattttcaaaagaacaaagtgaagacttgctcgcaaagagtgttgagattgcacgtgaagcgcgtgacatgtttctgaaggaacattcagatcgtcccatacaacatcctatcctggttgcagcttccattggaagttatggggcctatcttgctgacggctctgagtacagtggggattatggcgaagctggcacgttagaattcctgaaagattttcataagcgaaggctggaggttcttgcggaagcaggtcctgatttgatcgcctttgaaacaattcccaacaaattggaagctcaggcttacgttgaacttcttgacgaatgtaacatcagtatccctgcatggttctcatttaattcaaaagatggagttcacattgtgagtggagactcgttaattgaatgtgctactattgctaatgggtgttcgaaggttggtgcagttggaataaattgcacacctccaagatttatccatggcctgatactctccattcgaaaggtcacagataagccaattctgatatatcccaacagcggagaaagatatgatgctgagaaaaaggagtgggtggaatcaactggcgtgtcagacggtgattttgtttcctacgtaaacgaatggtgcaaagatggggctgtcctcattggcggctgctgcaggacaactccaaacaccatcaaggccataagtagatcacttaaccaacgccactcttcgctgcatttacctgtggcatagagttgcacgctccttcaggtgtgctactcatgctggtacctgaacctgatgaacatatcctggaggtccttactagcagcatgatgttctctgctgcaaatgagatggctctgcacttacacttgcgaataactgtgcgtttcgtctgagttcttaaagttgcccaatctggaggtacaacctaccaagaaggattagcaagcagaaaacagtgatagtgaactgttctactaagtaagtaacaagtgagtgaaaacaatctgcggcaaagttgatgaagcttgtaagctatcaagagttgttgtgcagacctgagcctgttataagagcctatgttgtgtactactactactgctgtactactactaccctgtgaactcttgttttgctatacaagtctataacaataagttttgtttgttaatggagaacttgatgctcttgcattctgtggaattttctgatggtactagccctaccattaaggattgagatcctctgcagtcgacatcaggcccacgtgtaattgacaaaggtacggtacagtgactgcagaggatcgtgatccaccattaaaggccaccccattagtgatggccaatcctaaccaggggaacagaacacaggacacataacaggggaggaagaaacaattttgttgtgaaatactagtagtattcagctctatttagttgtataaagtttgtgtgatcgaa

SEQ ID NO: 995 - DNA, 1523 bp, Zea mays
caaaaaaaaaaatagagtagactcgccagccaggcagccaccctcaccctggtctggtctcctctccaagcgggcagcgctcctccaaactgaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggctactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacatcaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtagcatagatctgtgctccactcctgatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttccctgtgaaatttgttaaaccattatatgtaagttttgtttgaca

SEQ ID NO: 996 - DNA, 1709 bp, Zea mays
gtattttataaagacgtcccccatcctgcatctgcaaaggccgcccactaccctctccggctctccgctaacaaaatctagaaccctctgaaccctccacattcctccagatcgaataataacctagctctgcacaccgcccagccaccagtggcagcaggagcaggggtcggaacaagatggtggtgacggcggccggcagcgcggaggaggctgtgcggcggtgggtggacgccgccggaggacgcctcgtcctcgacggcgggctggccacggagctcgaggccaacggcgccgacctcaacgacccgctctggagcgctaagtgcctcctctcctccccgcacctcatccgcaaggtccacatggactatctggaagctggcgcaaacattataatcacagcatcgtatcaggccactattcaagggtttgaatcaaagggtttttcaaaagaacagagtgaaaacttactaacaaagagtgtcgagattgcactggaagctcgtgagatgttcttgaaggaacatctggagaagtccactcctatacagcacccggttctggtcgcagcgtctttagggagttatggagcttatcttgccgatggctccgagtacagtggggattatggtgaagctggtacgaaagagttcctgaaagatttccatcggcggaggctccaggttcttgcggaagcaggccccgatttgattgctttcgaaacgattcccaacaaactggaagctgaggcgtatgtcgaacttctcgaggagtgcaacatcaatatccctgcatggttttccttcaactcaaaagatggagtgcatattgtgagcggtgactcgttaatcgaatgcactactattgctgacaagtgtgcaaaggttggtgcggtcgggataaactgcacacctccaagatttatccatggactgatactctccattcgaaaggtcacggacaagcccattctgatatatcccaacagtggcgaaagatacgatggtgaaaaaaaggagtgggtggaatccactggtgtgtcagatggtgattttgtttcttatgtgaacgagtggtgcaaagacggggctgtgcttatcggtggctgctgcaggacaactccaaacactatcagggccatacacagaactctgaacaaaagccccaacaagcagcagttacctgctgtagaataagagctgtgctctactctgatgcgcccgccttcctcctagcagtacctcgaggctataactccatgattccgtaaccgtacgtgttcgttctcttgcaaacgagatgtttgtaaataacgctgtatttctgggttctgagatatgcaacttggatggaggtacaaccggtgaaggggggtgaggaagcagcaacaatggtaagagttctactactgagtgggggaaaaacaacttgcggctgggttagtgaagcttagtagctaccactattcaagagttaaagggagttcgtatgacagttcctctggagatgttatcttcaaagtcttatatcactgctacttgtgagctgtgttaaaacctatatatataagttttgtttgacgtgactgcattaaagatagtacaccaagcttctccagttctcctagctatgtatgttcttgtccattcctccgcttccacaattctaagcaataaattaagggctagcttctccagttctcctag

SEQ ID NO: 997 - DNA, 1661 bp, Pennisetum glaucum
tcctcccccaacctttccggcgccgctctccttcctcggctccccctataaatcctccccacgccgaaatccaaatccagaaccctcatcaattcagtttccacatcgcgaatccgcgagcacaaggcactgaccgctgagcctgtagcagcagcagcagccagggcgaggcgagagatggtggggacggcgggaggcggcgcggaggaggcgatgcggcggtgggtggaggccggcggcgggcgcctcgtgctggacggcgggctggccacggagctcgaggccaacggcgccgacctcaacgacccgctctggagcgccaagtgcctccttgcctccccgcacctcatccgcaaggtccatatggactaccttgaagctggtgcaaacattataatcacagcatcatatcaggccacgattcaagggtttgagtcaaagggtttctcaaaagatcagagtgaaaacttattaacaaagagtgtcgagattgcacaggaagctcgtgagatgttcctgaaggaacatttggagcaatccactcccacacaaaaacctattctggttgcggcttctataggaagttatggggcttatcttgctgatggctctgagtacagtggggattacggtgaagctggtacagtacagttcctgaaagattttcatcggcgtaggcttcaggttcttgctgaagcaagccctgatttgattgcttttgaaactatccccaacaaagtggaagctcaggcatatgttgaacttcttgaggaatgtaacatacatatccctgcatggttttccttcaactcaaaagatggggttcatgttgtcagtggagactcattgatcgaatgtgctactattgctgacaagtgtgccaaggtttgtgcggttgggataaattgcacccctccaagatttattcatggactgatactctccattcgaaaggtcacagacaagcctattctgatatatcccaacagtggagaaagatatgatggtgagaaaaaggagtgggtggaatgcactggagtatcagatggtgattttgtttcttatgtaagtgaatggtgcaaagatggggccgcccttattgggggctgctgcaggacaactccaaacaccatcagggccatacacagaactctaaaccaatgctccaacacatgctttaatgtggcatagagctgtgcgacttccagatatgcatctcctcgtatatccggtatcctggagatcctttaaccagttgcccgatatacagttgtgcgtcctgcaaatgagatggtcctgcacctatgtctgtaaatactgggtgtcttttcaagttcttatgctattgtgcttggaggtacaaccagtgaagggataggaagcagcgttgatgaatgagttctaagagttagtgaaacaacttgcggcagagtcgatgaagctttagtaactatatatcgttattggtaagagtttgtataacagagctgctctgcagatgttatcttgcaataagagagcactgggcttcctcgtgtaatgcttgttaaagcatgacttttgtcggataaacctgcatgccctgtaatggaaggtctttttgcttctcttttatcagcactggctactcactgtcagggattttgatttatcaatcacca

SEQ ID NO: 998 - DNA, 1677 bp, Sorghum bicolor
gcctactccgctctccccgaaagaatccataagctccccaaccccctcctccattcctccaaatcgaagcctagcctagccaagcacgccgcgcagccgccgccagtagcagcaggaggagcaggggcagggacaggggcgagacgagatggtggggacggcagccggcgccgcggagggtgcggtgcggcggtgggtggatgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctggaagctggtgcaaacattctaatcacggcatcgtatcaggccactattcaagggtttgaatcaaagggcttttcaaaagagcaaagtgaaaacttgttaacaaagagtgttgagattgcactggaagctcgtgagatgttcttgaaggaacatttggagaaatccattcctatacagcatcctattctggttgcagcatctatagggagttatggggcttatcttgctgatggctctgagtacagtggggattatggtgaagctggtacaaaagagttcctgaaagattttcatcggcggaggcttcaggttcttgctgaagcaggccctgatttgattgcttttgaaacaatccccaataaactggaagctcaggcatatgttgaactccttgaggaatgtaacataaatatccctgcatggctttccttcaactcaaaagatggagtgcatattgtgagtggggactcagtaattgaatgcactactattgctgacaagtgtgcaaaggttggtgcagttgggataaattgtacacctccaagatttattcatggactgatactctccattcgaaaggtcacggacaagcctattctgatatatcccaacagtggtgaaagatatgatggtgaaaaaaaggagtgggtggaatccactggtgtatcagatggtgattttgtttcttatgtaaatgaatggtgcaaagatggggctgcgctcatcgggggctgctgcaggacaactccaaacactatcagggccatacaaagaactctaaaccaaggcttcaactagcagcacttacctgtagcgtagagctgtgctctactcctgatgagctcctcctagcagtaccttgaactatatacctgagattccttaaccagtgaaccaatataatgttgcattttcgcttgcaaatgagatgtgctgcacctatgtttgtaaataatgttgtatttctgggttctaagatatccaacttggaggtacaaccggtgaagggtgaggaagcagcaacaatgatagagttctactactgaggaaaaactacttgcggctgagttaatgaagcttagtaggtaccactattaagcgtttaaagagtttgtatgaccgttgctctggagatgttatcttcaataagtgcttatgttactgctagttccatatgtaagttatgtttgataaacctgcatctcctgaaacgaagatcttattacttatgttactgttagtgtgagctgtgtttgtaaattttgtttgacaaacctgaatctcctgaaacgaagatcttattactcccttaccaatcaaaagttcgtttt

SEQ ID NO: 999 - DNA, 1599 bp, Panicum virgatum
agcaacaatccgaacgcagtctgcttcacccatattcccggcgccgctctcctccctagttcctcctataaatcctccccacgccgaaatccaaatccaaaccccaaatcccagcctccacatcgcgagcgagcgcaaggcggagcccacagcgcccagcaggaggagcagcagccagggcgaggcgagagatggtggggacggccggcggcggagcggcggaggcggtgcggcggtgggtggaggccggcggcgggcacctcgtgctggacggcgggctggccacggagctcgaggccaacggcgccgacctcaacgacccgctctggagcgccaagtgcctcctcgtatccccgcgcctcatccgcaaggtccatatggactacctagaagctggtgcaaacattataagcacaacatcatatcaggccacgattcaaggatttgagtcaaagggtttttcaaaagaacaaagtgaaaacttactaacaaagagtgttgagattgctcgggaagctcgtgagatgttcctgaaggaacatttaaatcaatccattcctgcacaaaaacctattctggttgcagcttctattggaagttatggggcttatcttgctgatggctctgagtacagtggggactatggtgaagctggtacaataggattcctgaaagattttcatcggcggaggcttcaggttcttgctgaagcaggtcctgatttgattgcttttgaaacgatccccaacaaacttgaagctcaggcatatgttgaacttcttgaggaatgtaacatacatatccctgcatggttttccttcaactcaaaagatggagttaatattgtaagtggagactcgttgattgaatgtgctactattgctgacaagtgtgcaaaggttggtgctgttgggataaattgcacacctccaagttttattcatggactgatactctccattcgaaagatcacagacaagcctattctgatatatcccaacagtggagaaagatatgatggtgagaaaaaggagtgggtggaatccactggtgtatcagatggtgattttgtttcctatgtaagtgaatggtgcaaagatggggctgcccttatcggaggttgctgcaggacaactccaaacaccatcagggccattcagagaactctaaaccaaggctccaacacgctgcagttacctgtggcatagagctgtgctatacttccagatgcgtacctcctcacggttaccttgaccagcggcctgatgtactgttgcatatcctgcaaatgagatggttctgcacctatgtctgtaaattctggtgtatttctgagttcttaagcttttgcacttggaggtacagctagggaaaggatatgaagcaacatgatgatcgagttctactgagtgggtgaatcaacttgtggctgagttgattaagctttattatcagtactaagagttcaagagtttgtacaactgagagttgctttggagatgctttcttgcaaagagtactgccagttccctgtgaaatatttgttaaaccatgagtttcatcggataaatatatgcatgtcctgaattgaaaagttct

SEQ ID NO: 1000 - DNA, 1311 bp, Avena sativa
gggctcgccacggagctggaggcccatggcgccgacctcaacgacccgctctggagcgccaagtgcatcctctcctccccgcacctcatccgcaaggtccatctagactacatagaagcaggtgcgaacattataatcacagcatcatatcaggctaccattcaagggtttgagtccaagggattttcaaaagagcaaagtgaaaatttactaacaaagagtgttgagattgcacatgaagcacgtgagatgtttctgaagcaacattcggatcaatccactcccatgcaccgtcctattctggttgctgcttccataggaagttatggggcttatcttgccgatggctctgagtacagtggggattatggtgaagctggaacactagaatttctgaaagatttccatcggcgaagactccaggttcttgcagaggcacgtcctgatttgatcgctttcgaaacaatccccaacaaattggaagctcaggcatatgttgaacttcttgaggaatgcaatataagtataccttcatggttttcgttcaactcaaaagatggagttcatgttgtgagtggagattcactaattgaatgtgctaccattgctaactcctgtgcaaaggttggagctgttggaataaactgcacgcctccaagatttattcatagcctgatactcaccattcggaaggtcacagacaagccaattctgatatatcccaacagtggagaaagatatgatggcgagaaaaaggagtgggtggaatctacgggcgtgtcagatggtgattttgtttcttatgtaagcgagtggtgcaaagatggagctgcgcttattgggggctgctgcaggacaactccaaacaccatcagggccataactagaacccttaaccaattctgccctgcaccataactatccgcggcatacagttgtgccctccttgagaggtggttttccttggtgttgtcgtatgaagatgtcctggagatttagtaatagcgctgtgatgttctcctggaaacgagacggtttcttttaacttggagatgctaccggtcaacgattaacaagaagtaagttgtactgaggagcgagtgaaacgatctgcggcgaagttcatgaccccttattagctattgagagagtgcaagactatgtagtatgttatacagactgttgggtcgttcgagagatgttatcctggaataagctcttatgttgtgtactagtactgccttgaactatatatgtatgtatgtacctccagctgaaaatgaacactccctctgggttgggttacctctg

SEQ ID NO: 1001 - DNA, 1502 bp, Panicum virgatum
cgcgagcgagcgcaaggcggagcccacagcgcccagcaggaggagcagcagccagggcgaggcgagagatggtggggacggccggcggcggagcggcggaggcggtgcggcggtgggtggaggccggcggcgggcacctcgtgctggacggcgggctggccacggagctcgaggccaacggcgccgacctcaacgacccgctctggagcgccaagtgcctcctcgtatccccgcgcctcatccgcaaggtccatatggactacctagaagctggtgcaaacattataagcacaacatcatatcaggccacgattcaaggatttgagtcaaagggtttttcaaaagaacaaagtgaaaacttactaacaaagagtgttgagattgctcgggaagctcgtgagatgttcctgaaggaacatttaaatcaatccattcctgcacaaaaacctattctggttgcagcttctattggaagttatggggcttatcttgctgatggctctgagtacagtggggactatggtgaagctggtacaataggattcctgaaagattttcatcggcggaggcttcaggttcttgctgaagcaggtcctgatttgattgcttttgaaacgatccccaacaaacttgaagctcaggcatatgttgaacttcttgaggaatgtaacatacatatccctgcatggttttccttcaactcaaaagatggagttaatattgtgagtggagactcattgattgaatgtgctactattgctgacaagtgtgcaaaggttggtgctgttgggataaattgcacacctccaagatttattcatggactgatactctccattcgaaagatcacagacaagcctattctgatatatcccaacagtggagaaacatatgatggtgtgagaaaggagtgggtggaatccactggtgtatcagatggtgattttgtttcctacgtaagcgaatggtgcaaagatggggccacccttatcggaggctgctgcaggacaactccaaacaccatcagagccattcagagaactctaaaccaaggctccaacacgctgcagttacctgtggcatagagctgtgctctacttccagacgcgtatctccacgcggtaccttgaccagcagcctgaggtactgtactactgttgcatatcctgcaaatgagatggttctgaacctatgtctgtaaattccggtgtatttctgagttcttaagcttttgtacttggaggtacagctagtgaaaggataggaagcatcatcgatgatcgagttctactgagtgggtgaaacaacttgcggctgagttggttaagctttagtatcagtactaagagttccaagagtttgtatagctgagagttgctctgcagatgctgtcttgcaataagagtactacttccctgtgaaatatttgttaagacacgagttttatctgataatatgcatgtcctgaaatgaaaagttcttattacttctatttgtcagcg

SEQ ID NO: 1002 - DNA, 1569 bp, Saccharum officinarum
atccagaagccagccccacaacccttcctccattcctccaaatcgaagccttgcctagcctagccttgcacgccgagcagccgccgccagtggcagcaggagcaggggtaggggctgagacgagatggtggggacggcggccggcgccgcggagggggcggtgcggcggtgggtggatgccgccggcgggcgcctggtcctggacggcgggctggccacggagctcgaggccaacggcgccgacctcaacgacccgctctggagcgccaaatgcctcctctcctcctcgcacctcatccgcaaggtccatatggactatctggaagccggtgcaaacattctaatcacggcttcgtatcaggccactattcaagggtttgaatcaaagggcttttcaaaagagcaaagtgaaaaattactaacaaagagtgttgagattgcactggaagctcgtgacatgttcttgaaggaacatttggagaaatccattcctatacagcatcctattctggttgcagcatctataggtagttatggggcttatcttgctgatggctctgagtacagtggggattatggtgaagctggtacaaaagagttcctgaaagattttcatcggcggaggcttcaggttcttgctgaagcaggccctgatttgattgcttttgaaacgatccccaacaaactggaagctcaggcatatggtgaactccttgaggaatgttacatcaatatccctgcatggctttccttcaactcaaaagatggagtgcatattgtgagtggtgactcgttaattgaatgcgctactattgctgacaagtgtgcaaaggttggtgcggtcgggataaattgcacacctccaagatttattcatggactgatactctccattagaaaggtcacggacaagcctattctgatatatcccaacagtggtgaaagatatgatggtgaaaaaaaggagtgggtggaatccactggtgtatcagatggtgattttgtttcttatgtaaatgaatggtgcaaagatggggctgctcttatcgggggctgctgcaggacaactccaaacactatcagggccatacaaagaactctaaaccaagggttcaacgagcagcacttacctgtagcatagagctgtgctctactcctgatgagctcctcctagcagtaccttgagctatatccctgagattcctcaaccagcgaaccaatataatgttgcatgttctcttgcaaatgagatgttctgcacctatgtgtgtaaataatggtgtatttctgggttctaagctatccaacttggaggtacaaccggtgaagggtgaggaagcagagttctactactgagtgaggaaaactacttgcggctaagttcatgaagcttagtagctatcattatttagagttaaaagagttagtatgacagttgctctggagatgttatctttaataagtgcttatgttactgctacttcactgagaactgtcaatcatgtgtaaattctgtttggtaaacctgatcccctgaaatgaagatcgtattacttcccccaaaaccca

SEQ ID NO: 1003 - DNA, 1077 bp, Secale cereale
aagaacgacttgcaagttgtaaccacctctagtcggtagacacgcacctcgtcgccggagccaggaactgatggcggctgccatgagctacgtgcatgccgacgtggagaacctcatggcgacggagctgaggctcggcctgccgggcgtcgaggaggctgacaagatgccgtcgccgccgtccacgcccagggccggcagcaagcgcgccctcgccggggagcaccgcgaggaggagcccaagaccgcgcccccggccgccaaggcgcaggtggttgggtggccgccggtgaggtcctacaggaagagctgcttccagcaggcgagcagcaagaccaaggctgccgccccggcaccggtggtggtgaagcaggaggaggctgccgttgccccggcgccgcccgccgccgcagccgcgggaggttcactctacgtgaaggtgagcatggacggagccccctacctgaggaagatcgacctcaagatgtacaagggctaccgcgagctcagggaggccctggaggccatgttcctcggcttctccggcgacgcaggcagcgtgaacccgtcggacttcgccgtgacctacgaggacaaggatggcgacctcatgctcgtcggtgatgtgcccttcggaatgttcatgagcacttgcaagaggatgaggatcatgaagggatctgaagcaagaggcctagggtcatcaaaggagtgaaatggaatctatctatgaggaacacgcaacatgccatgggtgcatgtgtgcaacatggaggaattcttttgttcttttgggcatgttgtcgactcatctaccacagtgctactcttcaaggcaaagatgcaagctgattcgagtggagttttatttttattttgtttttctaaataggtgttagcaacacaaaaggagtggagatccgttcgagttgaattggatctccatgtgtgtttgtacaaagaaaacagctttctttccgtgttaagctatgtcaatggttggttgatgtctcccttgagtttggttatatcatatcaaaggttagaacaaaaaagaaaaaaaaaaaaaaaaaaaaa

SEQ ID NO: 1004 - DNA, 745 bp, Secale cereale
cagctgagaagaagaacgacttgcaagttgtaaccacctctagtcggtagacaagcacctcgtcgccggagccaggaactgatggcggctgccatgagctacgtgcatgccgacgttgagaacctcatggcgacggagctgaggctcggcctgccgggcgtcgaggaggctgacaagatgccgtcgccgccgtccacgcccagggccggcagcaagcgcgccctcgccggggagcaccgcgaggaggagcccaagaccgcgcccccggccgccaaggcgcaggtggttgggtggccgccggtgaggtcctacaggaagagctgcttccagcaggcgagcagcaagaccaaggctgccgccccggcaccggtggtggtgaagcaggaggaggctgccgttgccccggcgccgcccgccgccgcagccgcgggaggttcactctacgtgaaggtgagcatggacggagccccctacctgaggaagatcgacctcaagatgtacaagggctaccgcgagctcagggaggccctggaggccatgttcctcggcttctccggcgacgcaggcagcgtgaacccgtcggacttcgccgtgacctacgaggacaaggacggcgacctcatgctcgtcggcgacgtgcctttcgggatgttcatgagcacttgcaagaggatgaggatcatgaagggatccgaagcgagaggcctagggtcatcaaaggagtgaaatggaatctatctatgag

SEQ ID NO: 1005 - DNA, 855 bp, Triticum aestivum
cctacagccagctgagaagaacgacttgctagttgcaaccacctctagccggcgacaggaactgatggcggcggccatgagctacgtgcatgccgacgtggagaacctcaaggcgacggagctgaggctcggcctgccgggcgtcgaggagagcgacaagatgccgtcgccgccgtccactcccagggccggcaccaagcgcgcgctcgccggggagcaccgcgaggaggagcccaaggccgcgcccccggccgccaaggcgcaggtggttgggtggccgccggtgaggtcctacaggaagagctgcttccagcaggcgagcagcaagaccaaggaggccgcgccggcacctgtggtggtgaagcaggaggaggctgccgttgccgcggcgccgcccgccgccgcagccgcgggtggatcactgtacgtgaaggtgagcatggacggagcaccctacctgaggaagatcgacctcaagatgtacaagggctaccgcgagctcagggaggccctggaggccatgttccttggcttctccggcgacgcaggcagcgtgaacccgtccgacttcgccgtgacctacgaggacaaggacggcgacctcatgctcgtcggcgacgtgcccttcgggatgttcatgagcacttgcaagaggatgaggatcatgaagggatccgaagcgagaggcctaggatcatcaaaggagtgaaacggaatccatctacgaagaacacgcaacatgccatgggtgcatgtgtgcaacatggaggaattcttttgttcttttgggcatgttgtcgactcatctaccacagtgctactcttcaaggcaaagacgcaagctgattcgagtgg

SEQ ID NO: 1006 - DNA, 1205 bp, Triticum aestivum
cctacagccagctgagaagaacgacttgcaagttgtaaccacctctagtcggtagacacgcacctcgtcgccggcgacaggaactgatggcggctgccatgagctacgtgcatgccgacgtggagaacctcaaggcgacggagctgaggctcggcctgccgggcgtcgaggagagcgacaagatgccgtcgccgccgtccactcccagggccggcaccaagcgcgcgctcgccggggagcaccgcgaggaggagcccaaggccgcgcccccggccgccaaggcgcaggtggttgggtggccgccggtgaggtcctacaggaagagctgcttccagcaggcgagcagcaagaccaaggaggccgcgccggcacctgtggtggtgaagcaggaggaggctgccgttgccgcggcgccgcccgccgccgcagccgcgggtggatcactgtacgtgaaggtgagcatggacggagccccctacctgaggaagatcgacctcaagatgtacaagggctaccgcgagctcagggaggccctggaggccatgttcctcggcttctccggcgacgcaggcagcgtgaacccgtcggacttcgccgtgacctacgaggacaaggacggcgacctcatgctcgtcggcgacgtgcccttcgggatgttcatgagcacttgcaagaggatgaggatcatgaagggatccgaagcaagaggcctaggatcatcaaaggagtgaaatggaatccatctacgaagaacacgcaacatgccatgggtgcatgtgtgcaacatggaggaattcttttgttcttttgggcatgttgtcgactcatctaccacagtgctactcttcaaggcaaagacgcaagctgattcgagtggagttttatttttttttgttttttaaaataggtgttagcaacacaaaaggagtggagatccgttcgagttgaatcggatctccatgtgtgtttgtacaaagaaaacagctttctttccgtgttaagccatgtcaatggttggttgatgtctcccttgagtttggttatatcaaaggttgcaagaaaatttcattcggtggcatcagtttgtgcaatcatctcaaaccatgctaagcatgaacttgactcacttaaccactaaaatgctgcaaaaaagggaccaaaatgttacacagacacgcgtgtcctctcagcatcaatcacttgca

SEQ ID NO: 1007 - DNA, 1121 bp, Secale cereale
gactctcacaactcacctgcagccagctgagaagaagaagaacgacttgcaagttgtaaccacctctagtcggtagacacgcacctcgtcgccggagccaggaactgatggcggctgccatgagctacgtgcatgccgacgttgagaacctcatggcgacggagctgaggctcggcctgccgggcgtcgaggaggccgacaagatgccgtcgccgccgtccacgcccagggccggcagcaagcgcgccctcgccggggagcaccgcgaggaggagcccaagaccgcgcccccggccgccaaggcgcaggtggttgggtggccgccggtgaggtcctacaggaagagctgcttccagcaggcgagcagcaagaccaaggctgccgccccggcaccggtggtggtgaagcaggaggaggctgccgttgccccggcgccgccctccgccgcagccgcgggaggctcactgtacgtgaaggtgagcatggacggagccccctacctaaggaagatcgacctaaagatgtacaagggctaccgcgagctcagggaggccctcgaggccatgttcctcggcttctccggcgacgcaggcagcgtgaacccgtcggacttcgccgtgacctacgaggacaaggacggcgacctcatgctcgtcggcgacgtgcccttcgggatgttcatgagcacttgcaagaggatgaggatcatgaagggatccgaagcgagaggcctaggatcatcaaaggagtgaaaacggaatctatctatgaggaacacgcaacatgccatgggtgcatgtgtgcaacatggaggaattcttttgttcttttgggcatgttgtcgactcatctaccacagtgctactcttcaaggcaaagatgcaagctgattcgagtggagttttatttttattttgtttttctaaataggtgttagcaacacaaaaggagtggagatccgttcgagttgaatcggatctccatgtgtgtttgtacaaagaaaacagctttctttccgtgttaagctatgtcaatggttggttgatgtctcccttgagtttggttatatcaaaggttgctaaagtaaaaatttctattccgtagggaactaaaaaaaaacg

SEQ ID NO: 1008 - DNA, 1121 bp, Secale cereale
ggctcctctataaacatttccatggagaacctccacagctcacaacaaaccttcacaactcacctgcagccagctgagaagaagaacgacttgcaagttgtaaccacctctagtcggtagacaagcacctcatcgccggagacaggaactgatggcagctgccatgagctacgttcatgccgacgttgagaacctcatggcgacggagctgaggctcggcctgccgggcgtcgaggaggccgacaagatgacgtcgccgccgtccactcccagggccggcagcaagcgcgccctcgccggggagcaccgcgaggaggagcccaagaccgcgcccccggctgccaaggcgcaggtggttgggtggccgccggtgaggtcctacaggaagagctgcttccagcaggcgagcagcaagagcaaggctgccgcgccggtaccggtggtggtgaagcaggaggagactgccgttgccccggcgccgcccgccgccgcagccgcgggtgggtcactgtacgtgaaggtgagcatggacggagccccctacctgaggaagattgacctcaagatgtacaacggctaccgcgagctcagggaggccctggaggccatgttcctcggcttctccggcgacgcaggcagcgtgaacccgtcggacttcgccgtgacctacgaggacaaggacggcgacctcatgctcgtcggcgacgtgcccttcgggatgttcatgagcacttgcaagaggatgaggatcatgaagggatccgaagcgagaggcctaggatcatcaaaggagtgaaaacggaatctatctatgaggaacacgcaacatgccatgggtgcatgtgtgcaacatggatgaattcttttgttcttttgggcatgttgtcgactcatctaccacagtgctactcttcaaggcaaagatgcaagctgattcgagtggagttttatttttattttgtttttctaaataggtgttagcaacacaaaaggagtggagatccgttcgagttgaatcggatctccatgtgtgtttgtacaaagaaaacagctttctttccgtgttaagctatgtcaatggttggttgatgtctcccttgagtttggttatatcaaaggtt

SEQ ID NO: 1009 - DNA, 1415 bp, Triticum aestivum
agccgatctttgaactcagccatccacacctgcaaaaccaaaggaattgagcaaggaagtagctaggcagagatatcatcggaggcacgcacgcacgatggccaccatctcttcttgcagccgcctgtgcggcggcggcagcagcaccgccttccaccgccgccgcagccggcctgcgcgtgccgccgtcgtcacctgccggagattctccgccgtcgtccgcgcggccgcggccgcctctgccaccgccgcggcgcccgtgtccaccgtgccgcagaccaaggaggtgaagcttccgacgtgggcggagttcgagctggggaaggcgccggtgtactggaagaccaccaacggccttcctccagccccgggagagggcctgaagatattctacaacccagggacgaccaagctgacacccaacgagcagtttggcatcgccttcaacgggggctttaaccagccgatcatgtgcggcggcgagccgaggcagatgacgctgcaagagagggggaaagcctgtccccccatctacaccatcaggatccgggtgccgcagcatgccatgacactggttttctccttcaccaacggaaatgagtgggacggggcttacaccctcaagttcaaggtccccaagccatggctcgacaagcctttgagcttcttcaacgagggactggctgacgagctcaacctggagggcgcctgcgacagggccatcttcccggatgaaaacatcgtcatcacaagctgcgacatcggtggcttctacgaggagggaggagaccggtgcaagctggacatcgtgagcgggtgcatggacccgacctcgcacatgtttgacccgctggccaccatcgacgacggctcctgcccgctggactctgatacggaggagtgatcaccaccaagacggcatgagcagcagacgatatgtactcataagacgaggagaggacccacaattggtcgatgtgcatgcccttctctctcgtttatactgtatacttgtaaaaagggaatggttgtgatacgattaaagggaaggattgtacaatgcgcactaggtggacacaagcacttcgctggaaagatgaacgcatgacatgtgctgatactatctcagtaaaccgaaacaaatgtagatgaacggaaaagaagcgtacctgtttcgtagtaaggtacggtgcaggcatggctgttagaataaatccgaggctaccgaggaccaaacaatcacacgaaatacggcactgaaatttgttaatgaagttcatcaatatggctacatcccggcctgactatggacgctccttcccgtgacaccgtcacaataccacgcaccggtcaaccgggcgccggcacacgccgccggctccccttgcgcgtctgtgctattatgttggcatatg

SEQ ID NO: 1010 - DNA, 1241 bp, Triticum aestivum
gccatccacacctgcaaaaccaaaggaattaagcaaggaagtagctaggcggatatcatcggaggcacgcacgatggccaccatctcttcttgcagccgcctgtgcggcggcggcagcagcaccgccttccaccgccgccgcagccggcctgcgcgggccgccgtcgtcacctgccggaggttctccgccgtcgtccgcgcggccgcggccgcctctgccaccgcggcggcgcccgtgtccgtcgtgccgcagaccaaggaggtgaagcttccgacgtgggccgagttcgagctggggaaggcgccggtgtactggaagaccaccaacggccttcctccagccccgggagagggcctgaagatattctacaacccagggacgaccaagctgacacccaacgagcagtttggcatcgccttcaacgggggctttaaccagccgatcatgtgcggcggcgagccgaggcagatgacgctgcaagagagggggaaagcctgcccccccatctacaccatcaggatccgggtgccgcagcatgccatgacactggttttctccttcaccaacggaaatgaatgggacggggcatacaccctcaagttcaaggtccccaagccatggctcgacaagcctttgagcttcttcaacgaggggctggctgacgagctcaacatggagggcgcctgcgacagggccatcttcccggatgagaacatcgtcatcacaagctgcgacatcggcggcttctacgaggaggggggagaccggtgcaagctggacatcgtgagcgggtgcatggacccgacctcgcacatgttcgacccgctggccaccatcgacgacggctcctgcccgctggactctgatacggaggagtgaccaccaccaagacgacatgagcagcagcttcacaatatgtactcataagacgaggagaggagccacaattggtcgatgtgcatgcccttctctctcgtttatatacttgtaaaaagggaatggttgtgatacgatcaaaggaagaaggatagtacgacaatgcgcactaggtggacacgagcacttagctggaaacatggatgcatgacatgtgctgatactatatctctgaaacaaatgtagatgaaagaaaaaacagcatacctgttttgtaaggtgcgggcatggccaggggagttctgatctaaatagtactccctctgtcctataatataaggtgttattaccaccaaaaaaaaaa

SEQ ID NO: 1011 - DNA, 1302 bp, Triticum aestivum
agccgatctttgaactcagccatccacacctgcaaaaccaaaggaattaagcaaggaagtagctaggcggatatcatcggaggcacgcacgatggccaccatctcttcttgcagccgcctgtgcggcggcggcagcagcaccgccttccaccgccgccgcagccggcctgcgcgggccgccgtcgtcacctgccggaggttctccgccgtcgtccgcgcggccgcggccgcctctgccaccgcggcggcgcccgtgtccgtcgtgccgcagaccaaggaggtgaagcttccgacgtgggccgagttcgagctggggaaggcgccggtgtactggaagaccaccaacggccttcctccagcccctggagagggcctgaagatattctacaacccagggacgaccaagctgacacccaacgagcagtttggcatcgccttcaacgggggctttaaccagccgatcatgtgcggcggcgagccgaggcagatgaccctgcaagagagggggaaagcctgtccccccatctacaccatcaggatccgggtgccgcagcatgccatgacactggttttctccttcaccaacggaaatgaatgggacggggcatacaccctcaagttcaaggtccccaagccatggctcgacaagcctttgagcttcttcaacgaggggctggctgacgagctcaacatggagggcgcctgcgacagggccatcttcccagatgagaacatcgtcatcacaagctgcgacatcggcggcttctacgaggagggaggagaccggtgcaagctggacatcgtgagcgggtgcatggacccgacctcgcacatgttcgacccactggccaccatcgacgacggctcctgcccgctggactctgatacggaggagtgaccaccaccaaggcgacatgagcagcagcttcacaatatgtactcataagacgaggagaggagccacaattggtcgatgtgcatgtccttctctctcgtttatatacttgtaaaaagggaatggttgtgatacgatcaaaggaagaaggatagtacgacaatgcgcactaggtggacacgagcacttagctggaaacatggatgcatgacatgtgctgatactatatctctgaaacaaatgtagatgaaagaaaaaacagcatacctgttttgtaaggtgcgggcatggccaggggagttctgatctaaatagtactccctctgtcctataatataaggtgttattacaaccaaattgcatgggtcgggagagaagagcatagaggaattgagccaaagaacctt

SEQ ID NO: 1012 - DNA, 1231 bp, Secale cereale
tatgacaactcctgcaagcacgagaagctagccgatcttttaactcagccatccacacctgcaaaaccaaaggaattaagcaaaggaagtagctaggcagatatcatcggaggcacgcacgcacacacgatggccaccatctcttcttgcagccgcctgtgcggcggcggcagcagcaccgccttccaccgccgccgcagccgtgccaccgtcgtcacctgccggagattctcggccgtcgtccgcgcggccgcggccgcctctgctaccgcggcggcgcccgtgtccgccgtgccgcagaccaaggaggtgaagcttccgacgtgggcggagttcgagctggggaaggcgccggtgtactggaagaccaccaacggccttcctccagccccgggagagggcctgaagatattctacaacccagggacgaccaagatgacaccgaacgagcagttcggcatcgccttcaacgggggatttaaccagccgatcatgtgcggcggcgaaccgaggcagatgacgctgcaagagagggggaaagcctgtccccccatctacaccatcaggatccgggtgccgcagcatgccatgaccctggttttctccttcaccaacggaagcgaatgggacggggcttacaccctcaagttcaaggtccccaagccatggctcaacaagcctttgagcttcttcaacgaggggctggctgacgagctcaacatggagggcgcctgcgacagagccatattcccggatgaaaacatcgtcatctcaagctgcgacatcggcggcttctacgaggaggggggagaccggtgcaagctagacatcgtgagcgggtgcatggacccgacctcgcacatgtttgacccactggccatcatcgacgacggctcctgcccgctggactctgattcggaggagtgatcaccagcaagatggcatgagccgcagcttcacaatatgtacttataaaactgggagtggagccacaattggtcgatgtgcatgccctcctctctcgtttacttgtaaaaagggaatggttgtgatacgattaaaggaagaaggatagtacaatgcgcactaggcgggcaccagcgctttgctggaaacatggatgcatgacatgtgctgatactatctctgaaacaaataatgtagatgaaaggaaaaacaccatacctgttttgtaaggtgcaggaatggccatgggagttcaggatataaa

SEQ ID NO: 1013 - DNA, 1274 bp, Avena sativa
cacgcacacacactcgcgtctattctatccacgcttatatactcctccgacgagcacaagctcctgatctttttaactgaaccatacctacaaaatccgagcaagcaagcagagtagatatcgtcacaggacacgatcgatggccacgctctcttcttgcagccggctgagcggcggcggcggcgcaaccgccttccaccgccgccgtagccggccctcgcgtgccacggtcatcacctgccggagcttctcggccgtggtccgcgcggccgcggccgcctctgccacggcgacggaaacggcaacggcttccgtgccgcagaccaaggagtgctcgcttccaacgtgggcagagttcgagctaggaaaggcgcccgtctactggaagaccaccaacggccttcctcctgctccgggagagggcctgaagatattctacaacccggggacaaccaagctgacacctagcgaccagttcggcatcgcgttcaacgggggatttaaccagccgatcatgtgcggcggcgagccgaggcagatgacgctgcaggagaggggatcagcctgtccccccatatacaccatcaggatccgagtgccgcagcacgccacaacactggtcttctccttcacaaatggaagcgaatgggatggcgcctacaccctcaagttcaaggtccccaaaccatggctcaacaagcccttgagcttcttcaacgaggggctggcagacgagctcaacatggagggggcctgcgacagagccatcttcccggacgagaacatcgtcatcacgagctgcgagatcggcagcttctacgaagaaggcggagaccgctgcaagctggacatcgtgagcgggtgcatggacccggcctcgcacatgttcgatccgctcgccgtcgtcgatgacggcacctgcccgctagactccgattccgaggagtgaccgccgccagctctctctgtgtttacacctccaaaacgaaggaagagataagctgccgtttgacgcgtcgccctctcttgttcacactacttgtataaatgagggaagaattcgtgatactattacacgaacaagcatagtagtacagtgcgtgtaatgtgatagtcatgtactaatactagctaggaacaggtgcagagctatggcatgctacagtttgctgcatcgattagcaaaaaggttgtgaatacataaaaaggaaacatgactcggctcctggcatatctatatccttttatttattattttgaagaaaggcaaaaaa

SEQ ID NO: 1014 - DNA, 1138 bp, Festuca arundinacea
  misc_feature (36)..(37): n is a, c, g, or t
gcaaaaccgaagcaagtaagcaaactagatatcgtnncaggacacgatggccacgctctcttcttgcagccgcctgagcggcggcgccaccgccttccaccgccgccgtagccggccttcgcgtgccactgtcatcacctgccggagcttctcggccgcggtccgcgcggctgcggccgcctctgcaacggcgacggaaacagcaactgcgtccgtgccgccgcagaccaaggagtgctcgcttccgacgtgggcagagttcgagctaggaaaggcaccggtctactggaagaccaccagcggccttcctcctgccccgggagagggcctgaagatattctacaaccccgggacgaccgagctgacacctaacgagcagttcggcatcgcgtttaacggggggtttaaccagccgatcatgtgcggtggtgagccgaggcagatgacgctgcaggagaggggatcagccgatccccccatatacaccatcaggattcgagtgccgcagcatgccacgacactggttttctccttcacaaatggaagtgaatgggatggggactacaccctcaagtttaaggtccccaaaccatggctcggcaagcccttgagctttttcaacgaggggctggcagacgagctcaacatggagggcgcctgtgacagagccatctttccggatgaaaacgtcgtcatcacaagctgcgaaatgggcagctactacgaagaaggcggagaccggtgcaagcttgacattgtgagcggatgtatggacccgacctcgcacatgtttgatccactcgccgtcgtcgatgacggcacctgcccactggactctgattccgaggagtgatcaccaccgcctcgcaatgttcacttgtgctagaacaaagagagaagccaccgttggtcgttgtgccctttcttgttcacttgtataaaagaagagagaattagtgatacggttacacaaacaatgatagtacagtacatgtgcggttagtcacatactactacctaggacatggtggatgatgctactgatgatagtacagtgcatcaattagcaaaaggatgtatatatctaaagggaacatgacatacgtgtcctcgtgatataatctaaagatgtttctgt

SEQ ID NO: 1015 - DNA, 3752 bp, Brachypodium distachyon
aaaaatcaagcatgtcatctcatcagttctctaacaatccccaccacacgagcacgcgctcttctatccacgcttatatatgcctcccacaatcccaagaaactgatcttgaactcaaccgtgcctgcagaatcaaagcagccgagcaacgaagtggtgacagattgtagatagcagagagggctgccgcacgatcgataatggccactctctcttcttgcagccgcctgagcggcggcgccaccgcctctcaccgccaccgcagccggccggcgcgtgccgcggttatcacctgccggagattctcggccgctgtccgcgccgccgcggccgcctctgccacggcggcgccaccggcgacggtttctgtgccccagtccaaggagtgcgcgcttccgacgtgggcggacttcgagctggggaaggcgccggtctactggaagaccaccaacggcctccctccatccccgggagagggcctgaagattttctacaacccaggaccaaacaagctgacacccaacgaacagttcggcatcgcgtttaacggcgggtttaaccagccgatcatgtgcggtggcgagccgaggcagatgacgcttcaggcgaggggaaaagccgatccccccatgtacaccatcagaatacgtgtgccgcaacatgccacgaccctggttttctccttcacaaacggcaaggactgggatggcgactacacgctcaagtttagggtccccaaaccctggctcaacaagcccttgagcttcttcaatgatgggctggcggacgagctcaacatggagggcgcctgcgacagagccatcttcccggatgagaacatcgtcatcaccagctgcgacatcggcggcttctacgaagaggggggagaccgatgcaaactggacattgtgagcgggtgcatggacccaacctccaacatgtttgatccactcgccaccgtcgacgatggctcctgcccgctggagtctgattccgaggagtgaccagagcagaggtcttcagcgttttacttagacatgagcctagggcgcagtctctggcgattacttggccaaagagatatcttcttttgccgaaacgaaatttgtgatatacttccaccgttacacgagatttagtactgtacatgtcagttgatatagctacttctcagggcaacgcaatggagcttgctattatacataacataatatagaagtttctgtgaaatagaactgaacttgttattcgagccatttgcacagcaatttctaaccaccaccgagcatatctgatgctagattagtccaaagattaaaaaaaaagcaaacagtggatttttagagtccacacggtattcacatgattaagctgcgaccgcatgccagcactggtccatacaaactgatgcaattccattacattatccataccgctactaaggcagtcataggctacacatgatacggtcatataacatcattaccgcagttcatttttatagaccacagctacaagggcaaagcttagttgcagcagaacgcctttcatgtcgaccagtctagcagctttagcccccaccaacctgacgcttccaggagtcctccacaatgagctcgtcgactccccagtcctcatagctatttcaacacaaagaaacaatgaggctatatagaagtaacaggaagtgtagagaagtgattggtttgtccttctgatctcaccttccatcaggtaagtacctccggattgtgaagggtatcttacgtgctctcagttctttcatggcaatctgaagttgcacagagtaaacaataacatgagaagtgactggtttacggaaaatgggtgcgcatgtaagaaatattgagaactgatgtcaaatttcatttcatttacccttcacatgtgcattgttacttaaaatagttgtcattcatgcttttgaagctactaactagaataaatcaggttaacgttccgatgaaaaagatcacaaattgtagatcaacaaggacaaccttgtggtataaacatgtagaggtttcgttatttgggatttcttgtttaaacaagtcccagaagaatctgaaaattttagatggcacagaggggctgacatgaaacccttgcaaagctagaaaaacaaaagtatgtgtagataaaagcaggaatactcaatttgcatctacttgtttttactcgttttggttctgtccagtatgacaatgatatttgttgtcgtattgaaattagaaaaccccaatctgtgcaatatttctccagaatttttactgccttggttcactctttacagcaatcttcactcttatagatcaacagaaccttttataagctggaacaaggatattgcaaccaacagcatacgtttggggttccagggagagacgaaacaggagaaggtgcatacatatatccacatgtcatatatcagatcatcaaaccaatataccaaattccaatctacaggtttaaaagatggtgatactgcttatactagcaaaaaaaaaaagaaccacaacagaaaatatggagcaaaaaataacccaaactagctagtagatacatgtgcataggtacaacaactaaccaaagattagtcaaataacactgtttagtaacttctgttatgtttagaaacttctgttacatctacttatatgctttaagaaaatcacataattactaatacacatgtagttgcagaaataaatttccttgacttgtcactggcatatttatacttcaaagtagcaaatgcataatgagatgcaatattaaaaggcaagcattcccataatctagtagaacaatgagaaatccataatttcatcagtagttgctcgcattgctgacccagcaattttgagaggctatacactatcaagtattcaactgccaaacacattattgaactcatagtacattgcaaatttctagactaaaaagatgatacacccaatacgcatccagattgtcaaccttttaaatagggaagtcaacaatcatcctcaaggatattcataagtttgcagctggatataaagtagcctccaaaataagaaaatggcatggctaatgcaatggttgtcaaaaacggtccctctttagttagaaagaacaattttcattgaataaaatatcagaatttcatagaaagggaagtacaacgtgtcaactctaactaaaataatgaatacaaataaatgctaccattcacatggaagtctatatcaaaagtatatgtaagaaaaacatataactttacctcaagagggtctgtttctccttcaagctcaaccataactggggcattcatgctagaaataccaaatggtcatttactttgttgaatgaaataattggctggaacggtactcagatagaagcataccttatctgcaaagcacgtgtacccaggatgcgtgcacgctcatacttagtcatatattttgatgtattgcgtggacgaggagtcttttcctgttccttttcttcaccctcgccacctaccacgtcttcaggggcatcctcattgttctcaggatcttcttcgaccccttcctattcaacagaaaaacatcagttgtatgaagccgaaagttcttcctctatagaatggcagaagtatatgagaatagcaacgggtctgcacctcaatatcagcctctgggggctcatcctcgtacctgcataacaaataaggaattgtgaatcctaaattcaatttc

SEQ ID NO: 1016 - DNA, 1194 bp, Festuca arundinacea
  misc_feature (1128)..(1128): n is a, c, g, or t
  misc_feature (1131)..(1132): n is a, c, g, or t
  misc_feature (1138)..(1138): n is a, c, g, or t
  misc_feature (1150)..(1150): n is a, c, g, or t
  misc_feature (1152)..(1152): n is a, c, g, or t
  misc_feature (1160)..(1160): n is a, c, g, or t
  misc_feature (1162)..(1162): n is a, c, g, or t
  misc_feature (1170)..(1170): n is a, c, g, or t
  misc_feature (1172)..(1173): n is a, c, g, or t
  misc_feature (1181)..(1181): n is a, c, g, or t
  misc_feature (1183)..(1185): n is a, c, g, or t
ggcacgaggcacctgcaaaaccaaagcaagcaagcaaattagatatcgtcacaggacacgatggccacgctctcttcttgcagccgcctgagcggcggcgccaccgccttccaccgccgccgtagccggccttcacgtgccacagtcatcacctgccggagcttctcggccgcagtccgtgcggccgcggccgcctctgccacggcgccggaaacagcaacggcttccgtgccgcaaaccaaggagtgctcgcttccgacgtgggcagaattcgagctagggaaggcaccggtctactggaaaaccaccagcggccttcctcctgccccgggagagggcctgaagatattctacaacccagggacgaccgaactgacacctaacgaccagttcggcatcgcgtttaacggggggtttaaccagccgatcatgtgcggtggtgagccgaggcagatgacgctgcaggagagggggtcagccgatccccccatatacaccatcaggattcgagtgccgcagcatgccacgacactggttttctccttcacaaatgggagtgaatgggatggggactacaccctcaagtttaaggtccccaaaccatggctcggcaagcccttgagctttttcaatgaggggctggcagacgagctcaacatggagggcgcctgcgacagagccatcttcccggatgaaaacatcgtcatcacaagctgcgaaatgggcagctactacgaagaaggcggagaccggtgcaagctggacattgtgagcggatgcatggacccgacctcacacatgtttgatccactcgccgtcgtcgatgacggcacctgcccactggactccgattccgaggagtgaccaccaccgtctcgcagtgtacctgtgcggtgatagtcacatactactacctaggacatggtggatgatgctactgatgatagtacagtgcatcaattagcaaaaggatgattgatatatcgaaggagaacatgacatgagtgtgctcgtgatataatgtgaacatgtttctgtagactagatgacccgttgtgccagtggcgcaaatgacataatggagacatgatttaaaccataagtattattttgttttgctgtccatanatnncgcagnatgcaattgagntncattaacnanagaatgcnanncacgagtnannncgagtgcca

SEQ ID NO: 1017 - DNA, 1012 bp, Secale cereale
accatctcttcttgcagccgcctgtgcggcggcggcagcagcagcaccgccttccaccgccgccgcagccgtgccaccgtcgtcacctgccggagattctcggccgtcgtccgcgcggccgcggccgcctctgctaccgcggcggcgcccgtgtccgccgtgccgcagaccaaggaggtgaagcttccgacgtgggcggagttcgagctggggaaggcgccggtgtactggaagaccaccaacggccttcctccagcccccgggagagggcctgaagatattctacaacccagggacgaccaagatgacacccaacgagcagttcggcatcgccttcaacggggctttaaccagccgatcatgtgcggcggcgagccgaggcagatgacgctgcaagagagggggaaagcctgtccccctatctacaccataaggatacgggtgccccagcatgccatgacgctggttttctccttcaccaacggaagtgaatgggacggggcttacaccctcaagttcaaggtccccaaaccatggctcaacaagcctttgagcttcttcaacgaggggctggctgacgagctcaacatggagggcgcctgcgacagagccatcttcccggatgaaaacatcgtcatctcaagctgcgacatcggcggcttctacgaggaggggggagaccggtgcaagctagacatcgtgagcgggtgcatggaccggacctcgcacatgtttgacccactggccaccatcgacgacggctcctgcccgctggactctgattcggaggagtgatcaccaccaagatggcatgagccgtagcttcacaatatgtacttataaaacagggagaggagacagaattggtcgatgtgcatgccctcctctctcgtttacttgtaaaaagggatggttgtgatacgattaaaggaagaaggatagtacaatgcgcactaggtgagcacgagcgcttcgctggaaacatggatgcatgacatgtgctgatactatc

SEQ ID NO: 1018 - DNA, 853 bp, Lolium multiflorum
ggatctctgaactgagccacacctgcaaaaccgaagcaagtaagcaaactagatatcgtcacaggacacgatggccacactctcttcttgcagccgcctgagcggcggcggcgccaccgccttccaccgccgacgtagccggccttcgcatgccacagtcatcacctgccggagcttctcggccgcggtccgcgcggccgcaaccgcctctgccacggcgacggaaacggcaacggcttcggtgccgcagaccaaggagtgctcgctcccgacgtgggcagagttcgagctaggaaaggcaccggtctactggaagaccaccagcggccttcctcctgccccgggagagggcctgaagatattctacaaccccgggacgaccgagctggcacctaacgagcagttcggcatcgcgtttaacggggggtttaaccagccgatcatgtgcggtggtgagccgaggcagatgacgctgcaggagaggggatcagccgatccccccatatacaccatcaggattcgagtgccgcagcatgccacgacactggttttctccttcacaaatggaagtgaatgggatggggaatacaccctcaagtttaaggtccccaaaccatggctcggcaagcccttgagctttttcaacgaggggctggcagacgagctcaacatggagggtgcctgcgacagagccatcttcccggatgaaacatcgtcatcacaagctgcgaaatgggcagctactacgaagaaggtggagaccggtgcaagctggacattgtgagcggatgcatggacccggcctcgcacatgtttgatccactcgccgtcatcgatgacagcacctgcccgc

SEQ ID NO: 1019 - DNA, 1029 bp, Triticum aestivum
gtccatcatcgtcacacctgtatacttgcagagtttttatttatcaagatcagatcgggtcagggcgaggagaggagaggagaaaataaaagcaaactggagagaccatctgttcctctccctaccaaccatcttccttagcgacgaggccacccagagctccacaggaaagaagcgcgaccggagaaagaaggagagcaagatgtcgtcggtgttcagcggcgatgagacggcgcccttcttcggcttcctcggcgccgccgccgccctcgtcttctcatgcatgggggcggcctacgggacggccaagagcggcgtcggggtggcgtccatgggagtcatgcggccggagcttgtcatgaagtccatcgtgcccgtcgtcatggcgggagtgctcggaatctacggcctcatcatcgccgtcatcatcagcaccgggatcaaccccaaggccaagccctacttcctcttcgacggctacgctcacctctcctccgggctcgcctgtggcctcgcggggctcgccgccggcatggccattggcattgtcggtgatgctggagtcagggctaatgcgcaacaaccaaagctgttcgtgggcatgatccttatcctcattttcgcagaagcacttgccctttatggtctcatcgtgggcatcatcctctcgtcccgtgccggccagtcccgtgcggattaggcgcctcgctctaccattctgcaattgccacacaggctacattcttgagaagctgaagcattgaaaagttctaattttgatgtattaaggagatatttgtagatttttaaggaaggtgacacttccagtaccgttttcattctttttgggttgtggtgggcgtttgctgttcgtgcagaggattttggggtaggctggattgctgctcctgggaatatgggttttaatcctactggtggtgaataaaaacacgcattgtagctaaataataaatttatgattatattatgttcatctcttttctccactctaattccttgattcaaatt

SEQ ID NO: 1020 - DNA, 1084 bp, Triticum aestivum
ggagtccagcatcgtcacacctgtatacttccagagtttttattttctatagatcagatcgggtcggggcgaggagaggagaggagaaaataaaagcaaactggagaggccctctgttcctctccctaccaaccatcttccttagcgacgaggccaccccgagttccacaggaaagaagcgcgaccggaggaggaagaagaggagcaagatgtcgtcggtgttcagcggcgatgagacggcgcccttcttcggcttcctcggcgccgccgccgcgctcgtcttctcatgcatgggggcggcctacgggacggccaagagcggggtcggggtggcgtccatgggggtcatgcggccagagctcgtcatgaagtccatcgtgcccgtcgtcatggcgggtgtgctcggaatctacggcctcatcatcgccgtcatcatcagcaccgggatcaaccccaaggccaagccctacttcctcttcgacggctacgctcacctctcctccgggctcgcctgtggcctcgcggggctcgccgccggcatggccattggcattgtcggtgatgctggagtcagggctaacgcgcaacaaccaaagctgttcgtgggtatgatccttatcctcattttcgcagaagcacttgccctttacggtctcatcgtgggcatcatcctgtcgtcccgtgccggccagtcccgtgcggattaggcgcctcgctctaccattctgcaattgccacacaggctacattcttgagaagctgaagcattgaaaagttctaattttgatgtattaaggagatatttgtagattattaaggaaggtgacacttccagtaccgttttcgttctttttgggttgtggtgggcgtttgctgttcgtgcagaggattttggggtaggctggattgctgctcctggttatatgggttttaatcctactggtggtgaataaaaacacgcattgtagctaaataataaatttatgattatattatgttcatctcttttctccactctaattccttgattcaaattcatactctttttctgcatggttagaaaattaatgtggtttgtctgctt

SEQ ID NO: 1021 - DNA, 890 bp, Festuca arundinacea
ggcacgaggagaaaataaaagaagcctctctccatccttccctaccaaccaggcaaaccatcttccttcttcgccaggccaccaacacagaagcgcgagaggaagaaggagagagagagagccaagatgtcgtcggtgttcagcggagatgagacggcgcccttcttcggcttcctcggcgccgccgccgccctcgtcttctcatgcatgggcgcggcctacgggacggccaagagcggcgtgggggtggcgtccatgggcgtcatgcgcccggagctcgtcatgaagtccatcgtgcccgtcgtcatggcgggggtgctcgggatctacggcctcatcatcgccgtcatcatcagcaccgggatcaaccccaaggccaagccgtacttcctcttcgacggctacgcgcacctctcctccggcctcgcttgcggcctcgcggggctcgcagcgggcatggccatcggcatcgtcggtgatgcgggagtcagggcgaacgctcaacaacccaagctgttcgttggcatgatcctcatcctcattttcgctgaagcgctcgccctttacggactcattgttggaatcatcctctcatcccgcgccggccagtcccgcgcggattaggcgtgtttctctatcactccacgattaccatgccgactacattcttgagaaaagctgaaactttatgaagttctaattttgatgtattattaaggagagatttgtagattaaggaaggtggaacttccagtaccgtttcattcttttttggtcgtggtgggcgttttctgttcatgcaggggattttgggggtaggctggattgctgctcctggggaaatgggttttaatcctattggtggtgaataaaaacacggcattgtagct

SEQ ID NO: 1022 - DNA, 871 bp, Leymus cinereus x Leymus triticoides
gcacgaggcttccttggcgacgaggccacccagagttcccaggaaagaagcgcgaccggaggaagaagaagagcaagatgtcgtcggtgttcagcggagatgagacggcgcccttcttcggcttcctcggcgccgccgccgccctcgtcttctcatgcatgggggcggcctacgggacggccaagagcggcgtcggggtggcgtccatgggagtcatgcggccggagctcgtcatgaagtccatcgtgcccgtcgtcatggcgggagtgctcggaatctacggcctcatcatcgccgtcatcatcagcaccgggatcaaccccaaggccaagccctacttcctcttcgacggctacgcgcacctctcctccgggctcgcctgtggcctcgcggggctcgccgccggcatggccattggcattgtcggtgatgctggagtcagggctaatgcgcaacaaccaaagctgttcgtgggcatgatcctcattctcattttcgcagaagcgctcgccctctacggtctcatcgtgggcatcatcctctcgtcccgtgccggccagtcccgcgcggattaggcgacttgctctaccattctgcaattgccacgcaggctacattcttgagaagccgaagctttggaaggttctgattttgatgtattaaggagatatttgtagattaaggaagttgacacttccagtaccgttttcattctttttgggttgtggtgggcgtttgctgttcgtgcagaggattttcgggtaggctggattgctgctcctgggaatatgggttttaatcctattggtggtgaataaaaacacgcattgtagctaaataataaatttatgatatattatgttcatctcta

SEQ ID NO: 1023 - DNA, 856 bp, Lolium multiflorum
gtcgcacccatctccggcgagatcccgcaccgccaccgccacccaccatgtcgtccgtcttcagcggcgacgagaccgcccccttcttcggcttcctcggcgccgccgccgccctcgtcttctcctgcatgggcgcggcgtacggcacggccaagagcggcgtcggcgtggcgtccatgggggtcatgcgcccggagctggtcatgaagtccatcgtgcccgtcgtcatggcgggggtgctcgggatctacggactcatcatcgccgtcatcatctccaccgggatcaaccccaaggccaagccatacttcctcttcgacggctacgcgcacctctcctccggcctcgcctgcggcctcgcggggctcgccgccggcatggccatcggcatcgtcggggacgccggggtcagggccaatgcacagcagccaaagctgtttgtgggcatgatcctcatcctcatcttcgccgaagcgcttgctctctacggcctcatcgtcggcatcatcctctcctcccgtgccggccaatcccgcgccgactagaacaaagcccttgcaagaatggtgcacactcccaccgttacattctatttcagaaggttgatttcttcctagagaactgttttggccttacgttgtggttcttccttgtccatatgaacataatgtgagtgggatcgtagaggtctccacgccctccatctcctgtaattttattcggtcagcaacacaaagctatcatgtgtattacttgtatttagcgcctactgttgttgcgctgttgtatttaattgtttggaataataattggcgatgagccagcctggacgcgatgaatgaataatcaagctaga

SEQ ID NO: 1024 - DNA, 923 bp, Lolium multiflorum
gaaaaccaaatcccatagccagaacacagaagctcgacctgctccgacgagcgagaggaatcccccgatcgcggcagcggcagcaggtgcaggagcgagaagatgtcgtcggtgttcagcggcgatgagaccgcccccttcttcggcttcctcggcgccgccgccgcgctcgtcttctcatgcatgggggcggcctacggcacggccaagagcggcgtcggcgtggcgtccatgggggtcatgcgcccggagctcgtcatgaagtccatcgtgcccgtcgtcatggctggtgtgctcggtatctacggcctcatcatcgccgtcatcatcagcaccgggatcaaccccaaggccaagccgtacttcctcttcgacggatacgcacacctctcttcagggctcgcgtgtggcctcgcggggcttgcggctggcatggccatcggcatcgttggtgacgctggagtcagggcaaatgctcagcagccaaagctgtttgttggcatgatcctcattctcatcttcgccgaggcgctcgctctctacggcctcatcgtcggcatcatcctgtcatcccgagctggccaatcccgcgccgattaggcactttgccacacgtggccctgtgtggcctcctgttttatattgttatattcagacaacaaactgagctctagaagtttattatgtctagttttcttctgttttttcgagaaaaaaacattgtatccagggggtgtttgccctgccgtaccattctttttccgtcaggatgttgggtggtggttgatgcttattatgcacagttatttatttatttttggtctggctggacggtgtaatctggtgaataagcaagaacatgcaatgcaattgatcttaagattctcaaagttaaaaaaacaaaaaagtaaacctcggccgcg

SEQ ID NO: 1025 - DNA, 632 bp, Lolium multiflorum
gagagagccaagatgtcgtcggtgttcagcggagatgagacggcgcccttcttcggcttcctcggcgccgccgccgccctcgtcttctcatgcatgggcgcggcctacgggacggccaagagcggcgtgggggtggcgtccatgggcgtgatgcgcccggagctcgtcatgaagtccatcgtgcccgtcgtcatggcgggggtgctcgggatctacggcctcatcatcgccgtcatcatcagcaccgggatcaaccccaaggccaagccatacttcctcttcgacggatacgcgcacctctcctccggcctcgcctgcggcctcgcggggctcgccgccggcatggccatcggcatcgtcggtgatgccggagtcagggcaaacgctcaacaacccaagctgttcgtgggcatgatcctcatcctcattttcgctgaagcgctcgccctttacggactcattgttggaatcatcctctcatcccgtgccggccagtcccgcgcggattaagctctatcactccacgattgccatgctggctacattcttgagaaaagctgaaactttatgaagttctaattttgatgtattattaaggagagatttgtagattaaggaaggtggcacttcca

SEQ ID NO: 1026 - DNA, 952 bp, Avena sativa
catcccaccgcaaacgccctcctcagatcagatcgcccgaaaccaaatcccatagcgagaacagagaagctcgcgggaggaggcgacctgatcctgctcgggaggaagaccgagtagagcacgaggaatcccccgatcgcgtcggcagtagcaggtgcaggaggaacaagatgtcgtcggtgttcagcggcgatgagaccgcccccttcttcggcttcctcggcgccgccgcggcgctcgtcttctcatgcatgggggcggcctacgggacggccaagagcggcgtcggcgtggcgtctatgggagtcatgcgcccggagctcgtcatgaagtccatcgtgcccgttgtcatggctggtgtgctcggtatctacgggctcattattgccgtcatcatcagtaccgggatcaaccccaaggccaagccctacttcctcttcgacggctacgcccacctctcgtccggccttgcctgtggcctcgctgggcttgctgctggcatggccattggcatcgttggtgatgctggagtcagggcaaatgctcagcagccgaagctgtttgttggtatgatcctcatcctcatcttcgccgaggcgctcgctctttacggcctcatcgtaggcattatcctgtcatcccgagctggtcaatctcgcgccgattaggcacgtttccacacggtggccctgcgtggcctcttgttttatattgttatattcagacaacaaaactgacctctagaggttatcatgtctagttttcatttttctgtttggccgagaacaaaaacatctgtagccaggggcgtttgcccttgccgtaccattctttttctgtcaggttgttgggtggtggctgatgcttatttatgcacagttatttatttatgtggtctggccggaaggtgtaatctggtgaataaggaagaacatgcaatgcaattgagctt

SEQ ID NO: 1027 - DNA, 869 bp, Avena sativa
accatctaccttggcgaggaggcgacccagacacgacaggggagagaagaagaagcagaagcgccagcggaggagccagccagccaagatgtcgtcggtcttcagcggagatgagacggcccccttcttcggcttcctcggcgccgccgccgccctagtcttctcatgcatgggggcggcctacggaaccgccaagagcggcgtgggggtggcgtccatgggcgtgatgcgcccggagctcgtcatgaagtccatcgtgcccgtcgtcatggcgggagtgctcgggatctacggcctcatcatcgccgtcatcatcagcaccgggatcaaccccaaggccaagccatacttcctcttcgacggctacgcgcacctctcctccggcctcgcatgcggcctcgcggggctcgccgcgggcatggccatcggcatcgtcggcgacgcgggagtcagggccaacgctcaacaacccaagctgttcgtgggcatgatcctcatcctcattttcgcagaagcgctcgccctttacggtctcattgttggaatcatcctctcgtcccgtgctggccagtcccgcgcggattaggcgtgttactcttatcaattcgtgattgccacgctgtctacattcttgagaaatgctgaaactttgttaagttctaattttgatgtattattattaaggagagatttgtagattaaggaaggtggaacttccagtactctttcattcttttctggtcgtggttggcgtttgctgttcatgcggaggattctggggtaggctggattgctgctcctgggggttttatcctgttggtggtgaaataaaaacacggcattgtagctaaataataaatttatattat

SEQ ID NO: 1028 - DNA, 978 bp, Avena sativa
tttttttttttttgtacgtccaagacggcccatcgccgattattattccttatcccaaataatatctctcctcctctccccccctctctcctccactcgtcgtcgtcgtcctcccatctccggcgagatccccactccccgccagccagccgccatgtcgtccgtcttcagcggcgacgagaccgcccccttcttcggcttcctcggcgccgccgccgccctcgtcttctcatgcatgggcgcggcgtacggcacggccaagagcggcgtgggcgtggcgtcgatgggggtcatgcgcccggagctggtcatgaagtccatcgtgcccgtcgtcatggcgggagtgctcgggatctacggcctcatcatcgccgtcatcatctccaccgggatcaaccccaaggccaagccatacttcctcttcgacggctacgcgcacctctcctccgggctcgcctgcggcctcgcgggactcgccgccggcatggccatcggcatcgtcggcgacgccggggtcagggccaatgcacagcagccaaagctgttcgtgggaatgatcctcatcctcatctttgctgaagctcttgctctctacggccttatcgtcggcatcatcctctcctcccgtgctggccaatcccgcgccgattagaagaaagccctcgcgagagactagcacacggttccatcattgcattctatttgccttacgttgtggttcttctgtgttggtactcctcagcggaggaacataatgtggggtgggatcatagagattcacatgccttccgtcttctgtaatttcatactgttggcaactgaaaagctatgtgtattattactcctttctagcgccttttgttgttgttcttgttgcgctgttgtatttattatttggaataaggaataataatcggcgatgggccgtctcggacgtgatgaatgataagcaaagctatctagacctagcttcagttt

SEQ ID NO: 1029 - DNA, 905 bp, Avena sativa
aaaccatctaccttggcgaggaggcgacccagacacgacagaggagagaagaagaagaagaagaagtagcgttccctcaaaaaagaaagaagaagtagcgtcagcggaggagcgagccagccaagatgtcgtcggtgttcagcggagatgagacggcccccttcttcggcttcctcggcgccgccgccgccctagtcttctcatgcatgggggcggcctacggaaccgccaagagcggcgtgggggtggcgtccatgggcgtgatgcgcccggagctcgtcatgaagtccatcgtgcccgtcgtcatggcgggagtgctcgggatctacggactcatcatcgccgtcatcatcagcaccgggatcaaccccaaggccaagccatacttcctcttcgacggctacgcgcacctctcctccggactcgcatgcggcctcgcggggctcgccgcgggcatggccatcggcatcgtcggcgacgcgggagtcagggccaacgctcaacaacccaagctgtttgtgggcatgatcctcatcctcattttcgcagaagcgctcgccctttacggtctcattgttggaatcatcctctcgtcccgtgctggccagtcccgcgcggattaggcgcgttactcttatcactccacgattgccacgctggcaacattcttgagaaatgctgaaactttgttaagttctaattttgatgtactattattattaaggagagatttgtagattaaggaaggtggaacttccagtactctttcattctttttctggtcgtggtgggtgtttgctgtttatgtggaggtttctggggtaggctggattgctgctcctgggggttttatcctgttggtggtgaaataaaaacacggcattgtagctaaataataaatttat

SEQ ID NO: 1030 - DNA, 808 bp, Pseudoroegneria spicata
  misc_feature (1)..(3): n is a, c, g, or t
nnnatgtcgtcggtgttcagcggcgatgagacggcgcccttcttcggcttcctcggcgccgccgccgccctcgtcttctcatgcatgggggcggcctacgggacggccaagagcggcgtcggggtggcgtccatgggagtcatgcggccggagctcgtcatgaagtccatcgtgcccgtcgtcatggcgggagtgctcggaatctacggcctcatcatcgccgtcatcatcagtaccgggatcaaccccaaggccaagccctacttcctcttcgacggctacgctcacctctcctccgggctcgcctgtggcctcgcggggctcgccgctggcatggccattggcattgtcggtgatgctggagtcagggctaacgcgcaacaaccaaagctgttcgtgggtatgatccttatcctcattttcgcagaagcgctcgccctttacggtctcatcgtgggcatcatcctgtcgtcccgtgccggccagtcccgtgcggattaggtgcctcgctctaccattctgcaattgccacacaggctacattcttgagaagctgaagcattgaaaagttctaattttgatgtattaaggagatatttgtagattattaaggaaggtgacacttccagtaccgttttcattctttttgggttgtggtgggcgtttgctgttcgtgcagaggattttggggtaggctggattgctgctcctgggaatatgggttttaatcctactggtggtgaataaaaacacgcattgtagctaaataataaatttatgattatattatgttcatctcttttctcca

SEQ ID NO: 1031 - DNA, 1075 bp, Pseudoroegneria spicata
  misc_feature (29)..(29): n is a, c, g, or t
  misc_feature (36)..(36): n is a, c, g, or t
  misc_feature (41)..(41): n is a, c, g, or t
  misc_feature (53)..(53): n is a, c, g, or t
  misc_feature (248)..(248): n is a, c, g, or t
  misc_feature (802)..(802): n is a, c, g, or t
  misc_feature (807)..(808): n is a, c, g, or t
  misc_feature (810)..(810): n is a, c, g, or t
ctttctcctctctcctccctctcccctcnccctccnctcgncgtcgccgtccnatctccggcgagatccccgcccctcccccgccggcagccatgtcttccgtcttcagcggcgacgagaccgcccccttcttcggcttcctcggggccgccgctgccctcgtcttctcctgcatgggcgcggcgtacgggacggccaagagcggggtgggcgtggcgtcgatgggggtgatgcgcccggagctggtnatgaagtccatcgtgcccgtcgtcatggcgggagtgctcgggatctacggcctcatcatcgccgtcatcatctccaccgggatcaaccccaaggccaagccatacttcctcttcgacggctacgcgcacctctcctccggcctcgcctgcggcctcgcgggcctcgccgccggcatggccatcggcatcgtcggcgacgccggtgtcagggccaatgcacagcagcccaagctgttcgttggaatgatcctcatcctcatctttgccgaagcccttgccctgtacggcctcatcgtcggcatcatcctctcctcgcgtgccggccaatcccgcgccgactagaagaaagcgcttgcacgaaaggaggacatggtccatcattgtattctgtttgaaagggtttttttcttcctagagacttgtttggcattacgctgtggttcttctgtgttcatgctcctcgtcggaggaacataatgtgggtgggatcatagcgattccacgccctccatctgtaattttattctatccggcaacgcaaagctacctgtatntactnntngtacctagcacctgttgtatttattgtttggaataatgatcggcgttgagccgtatgggacgtgatgaatgaataagcaaagctagacctagttccacttttgtgtgtaactcctgtgtctagattcgttttattatgtctgggagatgtgcagtgattgttgtgttttgttatgtttagtgtggttatatatttttgtgtaaactatcaagcacactggtgtttgatagtttgtttatgaaaaataaaattgaaggttttgtga

SEQ ID NO: 1032 - DNA, 1000 bp, Secale cereale
gtccagcatcgttacacgtctgcttccagagtttttccatctgagttctcttctggagaaaaaaaggtgagatcagatcgggtcggggagaggagaaaataaaagcaagctgcggacacgatctgttcctccccctaccaaccatcttccttagcgacgaggccacccagagctccagaccaaggaaggaagaagaggagcaagatgtcgtcggtgttcagcggagatgagacggctcccttcttcggcttcctcggcgccgccgccgccctcgtcttctcatgcatgggggcggcctacgggacggccaagagcggggtcggggtggcgtccatgggagtcatgcggccggagctcgtcatgaagtccatcgtgcccgtcgtcatggcgggagtgctcggaatctacggcctcatcatcgccgtcatcatcagcaccgggatcaaccccaaggccaagccctacttcctcttcgacggctacgctcacctctcctccgggctcgcctgtggcctcgcggggctcgccgccggcatggccattggcattgtcggtgatgctggagtcagggctaacgcgcaacaaccaaagctgtttgtgggtatgatcctcattctcatcttcgcagaagctctcgccctttacggtctcatcgtgggcatcatcctttcgtcccgtgccggccagtcccgcgcggattaggcgccttgctctaccattctgcaattgccacacatgctacattcttgagaagctgaagcattgaaaagttctaattttgatgtattaaggagatatttgtagattattaaggaaggtgacacttccagtaccgttttcattcttttttgggtcgtggtgggcgtttgctgttcgtgaagaggattttggggtaggctggattgctgctcctgggaatatgggttttaatcctactggtggtgaataaaaacacgcattgtagctaaataataaatttatgattatattatgttcatct

SEQ ID NO: 1033 - DNA, 1019 bp, Secale cereale
tggggaggttctcttctggagaaaaaaggtagagatcagatcgggtcggggaggaggagaaaataaaagcaagctgcggacacgatctgttcctccccctaccaaccatcttccttagcgacgaggccacccagagctccagaccaaggaagcgcgaccggaggaggaagaagaggagcaagatgtcgtcggtgttcagcggagatgagacggctcccttcttcggcttcctcggcgccgccgccgccctcgtcttctcatgcatgggggcggcctacgggacggccaagagcggggtcggggtggcgtccatgggagtcatgcggccggagctcgtcatgaagtccatcgtgcccgtcgtcatggcgggagtgctcggaatctacggcctcatcatcgccgtcatcatcagcaccgggatcaaccccaaggccaagccctacttcctcttcgacggctacgctcacctctcctccgggctcgcctgtggcctcgcggggctcgccgccggcatggccattggcattgtcggtgatgctggagtcagggctaacgcgcaacaaccaaagctgtttgtgggtatgatcctcattctcatcttcgccgaagcgctcgccctttacggtctcatcgtgggcatcatcctttcatcccgtgccggccagtcccgcgcggattaggcgcctcgctctacccttctgcaattgccacacaggctacattcttgagaagctgaagcattgaaaagttctaattttgatgtattaaggagatatttgtagattattaaggaaggtgacacttccagtaccgttttcattctttttgggttgtggtgggcgtttgctgttcgtgaagagattttggggtaggctggattgctgctcctgggaatatgggttttaatcctactggtggtgaataaaaacacgcattgtagctaaataataaatttatgattatattatgttcatctcttttctacctaaaaaaaaaaaaaaaaaaaaaaaaaaaaaaaa

SEQ ID NO: 1034 - DNA, 940 bp, Secale cereale
actcgtcgccgtcgccgtcgccgtcgaatctccggcgagatcccgcccctcccccgccggcagccatgtcttccgtcttcagcggcgacgagaccgcccccttcttcggcttcctcggcgcggccgccgccctcgtcttctcctgcatgggagcggcgtacgggacggccaagagcggggtgggggtggcgtcgatgggggtgatgcggccggagctggtgatgaagtcgatcgtgcccgtcgtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaacgcacagcagcccaagctgttcgttggaatgatcctcatcctcatctttgccgaagcgcttgccctgtacggcctcatcgtcggcatcatcctctcctcgcgtgccggccaatcccgcgccgactagaaacaaagctgcttgcaagcaaggagcatacggtccaccattgtattctgtttgaaagggtttatttcttcctagagacttgtttggcattacactgtggttctacttctgtgctcatgctcctcgaccgatcaaggaacataatgtggtttgggatcatatggatttccacgccctccatctgtaattttattctgttcggcaacacaaagctacctgtatctactcgtacctagcacctgttgtatttattgtttggagtaataatcggcgctgagcctcttgggacttgatgaatgaataagcaaagctagacctaagtaacccaaaaaaaaaaaaaactagagactagtcgaacggacaccaacgacgggaag

SEQ ID NO: 1035 - DNA, 817 bp, Secale cereale
ccggcagccatgtcttccgtcttcagcggcgacgagaccgcccccttcttcggcttcctcggcgcggccgccgccctcgtcttctcctgcatgggagcggcgtacgggacggccaagagcggggtgggggtggcgtcgatgggggtgatgcggccggagctggtgatgaagtcgatcgtgcccgtcgtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaacgcgcagcagcccaagctgttcgtcggaatgatcctcatcctcatctttgccgaagcgcttgccctgtacggcctcatcgtcggcatcatcctctcctcgcgtgccggccaatcccgcgccgactagaagaaagtccttgcacgaaaggaggacacggtccatcattgtattctatttcaaaaagggattatttcttcctagagacttgtttggcattacactgtggttctacttatgtgctcatgctcctcggcggaggaacataatgtgggtgtgatcatagtgatttccacgcctccatctgtaattttattctgctcggcaacgcaaagctacctgtatctactcgtacctagcacctgttgtatttattgtttggagtaataatcggcgatgagccgcttgggacgtggtgaatgaataagcaaagctagac

SEQ ID NO: 1036 - DNA, 1057 bp, Triticum aestivum
gaggagaggagaaaataaaagcaaactggagagaccatctgttcctctccctaccaaccatcttccttagcgacgaggccacccagagttccacaggaaagaagcgcgaccggagaaagaagaagaggagcaagatgtcgtcggtgttcagcggcgatgagacggcgcccttcttcggcttcctcggcgccgccgccgccctcgtcttctcatgcatgggggcggcctacgggacggccaagagcggcgtcggggtggcgtccatgggagtcatgcggccggagctcgtcatgaagtccatcgtgcccgtcgtcatggcgggagtgctcggaatctacggcctcatcatcgccgtcatcatcagcaccgggatcaaccccaaggccaagccctacttcctcttcgacggctacgctcacctctcctccgggctcgcctgtggcctcgcggggctcgccgccggcatggccattggcattgtcggtgatgctggagtcagggctaatgcgcaacaaccaaagctgttcgtgggcatgatccttatcctcattttcgcagaagcacttgccctttacggtctcatcgtgggcatcatcctctcgtcccgtgccggccagtcccgtgcggattaggcgcctcgctctaccattctgcaattgccacacaggctacattcttgagaagctgaagcattgaaaagttctaattttgatgtattaaggagatatttgtagattattaaggaaggtgacacttccagtaccgttttcattctttttgggttgtggtgggcgtttgctgttcgtgcagaggattttggggtaggctggattgctgctcctgggaatatgggttttaatcctactggtggtgaataaaaacacgcattgtagctaaataataaatttatgattatattatgttcatctcttttctccactctaattccttgattcaaattcctactctttttctgcatggttggtagaaattaatgtggtttgtctgcttttctgctatacatttgttaagccacaaatttgcaattcatataggc

SEQ ID NO: 1037 - DNA, 1043 bp, Triticum aestivum
aggagaggagaaaataaaagcaaactggagagaccctctgttcctctccctaccaaccatcttccttagcgacgaggccacccagagttccacaggaaagaagcgcgaccggagaaagaagaagaagagcaagatgtcgtcggtgttcagcggcgatgagacggcgcccttcttcggcttcctcggcgccgccgccgccctcgtcttctcatgcatgggggcggcctacgggacggccaagagcggcgtcggggtggcgtccatgggagtcatgcggccggagctcgtcatgaagtccatcgtgcccgtcgtcatggcgggagtgctcggaatctacggcctcatcatcgccgtcatcatcagcaccgggatcaaccccaaggccaagccctacttcctcttcgacggctacgctcacctctcatcagggctcgcctgtggcctcgcggggctcgccgccggcatggccattggcattgtcggtgatgctggagtcagggctaatgcgcaacaaccaaagctgttcgtgggcatgatccttatcctcattttcgcagaagcacttgccctttacggtctcatcgtgggcatcatcctctcgtcccgtgccggccagtcccgtgcggattaggcgcctcgctctaccattctgcaattgccacacaggctacattcttgagaagctttctaattttgatgtattaaggagatatttgtagattattaaggaaggtgacacttccagtaccgttttcattctttttgggttgtggtgggcgtttgctgttcgtgcagaggattttggggtaggctggattgctgctcctgggaatatgggttttaatcctacttggtggtgaataaaaacatgcattgtagctaaataataaatttatgattatattatgttcatctcttttctccactctaattccttgattcaaattcctactctttttctgcatggttggtagaaattaatgtggtttgtctgcttttctgctatacatttgttaagccacaaatttgcaattcatataggc

SEQ ID NO: 1038 - DNA, 895 bp, Triticum aestivum
gatcagatcgtggaagcccaaaccaaatcccaaagcgacaacagaaaagctcgagctcttgcttgggtggacgagcgagcagagcgccgatcgcagcagtagcagcaggaggaagatgtcgtcggtgttcagcggcgatgagaccgcccccttcttcggctttctcggcgccgccgcggcgctcgtcttctcatgtatgggagcggcctacgggacggccaagagcggcgtcggcgtggcgtccatgggagtcatgcgcccggagctcgtcatgaagtccatcgtgcccgttgtcatggctggagtgctcggtatctacgggcttattatcgccgtcatcatcagtaccgggatcaaccccaaggccaagccctactacctcttcgacggctacgcccacctctcgtccggcctcgcctgtggccttgcaggccttgctgctggcatggccatcggcattgttggtgatgctggagtcagggcaaatgctcaacagcccaagctgtttgtcggcatgatcctcatcctcatcttcgcagaggcgctcgctctctacggtctcattgtcggcatcatcctgtcatcccgagctggccagtctcgtgctgattaggcatgttccatacacgcggccctgtgtgccctcttgttttatattattcagacagcaaactgagctctagaggttatcatgtctagttttcattcttctgtttggtggagaaaaaaacatctgtagcaaagggagctttgcccttgatgtaccattctttttccgtctggatgctgggtgggggttgatgcttatttatgcacagttatttaccttttgggtctggctggacggtgtaatctggtgaataagcgagaacttaatgcaattgagttttgtcca

SEQ ID NO: 1039 - DNA, 936 bp, Triticum aestivum
caaagcgacaacagaaaagctcgagctcttgcttgggtggtcgagcgagcagaccccgatcccagcagtagcaccaggaggaggaagatgtcgtcggtgttcagcggcgatgagaccgcccccttcttcggctttctcggcgccgccgcggctctcgtcttctcatgtatgggggcggcctacgggacggccaagagcggcgtcggcgtggcgtccatgggagtcatgcgcccggagctcgtcatgaagtccatcgtgcccgttgtcatggctggagtgctcggtatctacgggcttattatcgctgtcatcatcagtaccgggatcaaccccaaggccaagccctactacctcttcgacggctacgcccacctctcgtccgggctcgcctgtggccttgccggacttgctgctggcatggccatcggcattgttggtgatgctggagtcagggcaaatgctcagcagcccaagctgtttgtcggcatgatcctcatcctcatcttcgcagaggcgctcgctctctacggtctcattgtcggcatcatcctgtcatcccgagctggccagtctcgtgccgattagccaattaggcatgttccacacacgcggccctgtgtgccctcttgttttatattattcagacagcaaactgagctctagaggttatcatgtctagttttcattcttctgtttggtggagaaaaaaacatctgtagccaagggagttttgcccttgatgtaccattcttttcccgtcaagatgctgggagggggttggtgcttatgtatgcacagttatttaccttttgggtctggctggacggtgtaatctggtgaataagcgagaacttgcaatgcaattgagttttgtccattcatcccccaatatcctttcttgtgtcgcaaaggagaagtacacatggtttgaaacta

SEQ ID NO: 1040 - DNA, 877 bp, Triticum aestivum
gatcagatcgtgaaaaagcccaaaccaaatcccaaagcgacaacagaaaagctcgagctcgagctcttgcttgggtggacgagcgagcagaccccgatcccagcagtagcaccaggaggaggaagatgtcgtcggtgttcagcggcgatgagaccgcccccttcttcggctttctcggcgccgccgcggctctcgtcttctcatgtatgggggcggcctacgggacggccaagagcggcgtcggcgtggcgtccatgggagtcatgcgcccggagctcgtcatgaagtccatcgtgcccgttgtcatggctggagtgctcggtatctacgggcttattatcgccgtcatcatcagtaccgggatcaaccccaaggccaagccctactacctcttcgacggctacgcccacctctcgtccggcctcgcctgtggccttgcaggccttgctgctggcatggccatcggcattgttggtgatgctggagtcagggcaaatgctcaacagcccaagctgtttgtcggcatgatcctcatcctcatcttcgcagaggcgctcgctctctacggtctcattgtcggcatcatcctgtcatcccgagctggccagtctcgtgctgattaggcatgttccatacacgcggccctgtgtgccctcttgttttatattattcagacagcaaactgagctctagaggttatcatgtctagttttcattcttctgtttggtggagaaaaaacatctgtagcaaagggagctttgcccttgatgtaccattcttttccgtctggatgctgggtggggttgatgcttatttatgcacagttatttaccttttgggtctggctggacggtgtaatctggtgaataagcgaga

SEQ ID NO: 1041 - DNA, 903 bp, Hordeum vulgare
ggaagcccagaccaaatcccaaagcgacaaaaggaaagctcgagctctcccttgggtggacgagcgagcagaccgccgatcgcagcagcagcagcaggaggaagatgtcgtcggtgttcagcggcgatgagaccgcccccttcttcggctttctcggcgccgccgcggcgctcgtcttctcatgcatgggggcggcctacgggacggccaagagcggcgtcggcgtggcgtccatgggagtcatgcgcccggagctcgtcatgaagtccatcgtgcccgttgtcatggctggagtgctcggtatctacgggcttatcatcgccgtcatcatcagtaccgggatcaaccccaaggccaagccctactatctcttcgatggctatgcccacctctcgtccgggctcgcctgtggccttgctggccttgctgctggcatggccattggcattgttggtgatgctggagtcagggcgaatgctcagcagcccaagctgtttgttggcatgatcctcatcctcatctttgcagaggcgctcgctctctacggtctcattgtcggtatcatcctgtcatcccgagctggccagtctcgtgccgattaggcatgttctacacacgcggccctgtgtgccctcttgttttatattattcagacagcaaactgagctctagaggttatcatgtctagttttcgttcttctgtttggtggagaaaaaaacatctgtagccaagggaggtttgcccttgatgtaccattctttttccgtcaggatgctgggtgggggttgatgcttatttatgcagagttatttgcctgttgggtctggctggacggtgtaatctggtgaataagcgagaacttgcaatgcaattgagttttgtccattcaaaaaaaaaaaaaa

SEQ ID NO: 1042 - DNA, 1147 bp, Hordeum vulgare
cacggctcctacatccagaggggcaaaaccgtccagcaaaaagcattccgccccacccccacccccgtcttcttcttccccctaatctccaactccaacgccctcctcagatcagatcgtggaagcccagaccaaatcccaaagcgacaaaaggaaagctcgagctctcccttgggtggacgagcgagcagaccgccgatcgcagcagcagcagcaggaggaagatgtcgtcggtgttcagcggcgatgagaccgcccccttcttcggctttctcggcgccgccgcggcgctcgtcttctcatgcatgggggcggcctacgggacggccaagagcggcgtcggcgtggcgtccatgggagtcatgcgcccggagctcgtcatgaagtccatcgtgcccgttgtcatggctggagtgctcggtatctacgggcttatcatcgccgtcatcatcagtaccgggatcaaccccaaggccaagccctactatctcttcgatggctatgcccacctctcgtccgggctcgcctgtggccttgctggccttgctgctggcatggccattggcattgttggtgatgctggagtcagggcgaatgctcagcagcccaagctgtttgttggcatgatcctcatcctcatctttgcagaggcgctcgctctctacggtctcattgtcggtatcatcctgtcatcccgagctggccagtctcgtgccgattaggcatgttctacacacgcggccctgtgtgccctcttgttttatattattcagacagcaaactgagctctagaggttatcatgtctagttttcgttcttctgtttggtggagaaaaaaacatctgtagccaagggaggtttgcccttgatgtaccattctttttccgtcaggatgctgggtgggggttgatgcttatttatgcagagttatttgcctgttgggtctggctggacggtgtaatctggtgaataagcgagaacttgcaatgcaattgagttttgtccattcatcccccaatgtcctttcttgcgaattatgcttttcgcaaagggaaagcatacaggtttgaaactagaatgagaccctttggttcaaaaaggatcagtttgatttatataggactaaattttgtaggaatttttgata

SEQ ID NO: 1043 - DNA, 1059 bp, Brachypodium distachyon
taatcctcctggtccacacgtcataatatctccttccactcgtcgtcgtcgtctccggcgagatccccttcctcctgcgcccgccgccatggcttccgtcttcagcggcgacgagaccgcccccttcttcggcttcctcggcgccgccgccgcgctcgtcttctcctgcatgggggcggcgtacgggacggccaagagcggggtgggggtggcgtccatgggggtgatgcggccggagctcgtcatgaagtccatcgtgcccgtcgtcatggccggcgtgctcgggatctacgggctcatcatcgccgtcatcatctccacggggatcaaccccaaggccaagccctacttcctcttcgacggctacgcgcacctctcctccggactcgcctgcggcctcgccgggctcgccgccggcatggccatcggcatcgtcggtgacgccggagtcagggccaatgcgcagcagccaaagctgttcgtgggcatgatcctcatccttatcttcgcagaagctcttgctctctatgggctgatcgtgggcatcatcctgtcctcccgtgccggccaatctcgcgctgattagaagaaatcacttgcaagagaggagcacacggttcatcattgtattctgttttcctagagactgtttggtcttctgttgtggttcttctgtgttgatgctcgtcggtggaggaacataatgtgggtgggatcagagatctccaaaccctctgtctgtaattttattctatctgcaatgcaaagctatatgtattacctcatatctagcgtctgttcttcggctgttgtatttattatttggaataataatcggtgacatgctgtcctggatgtgatgaataaataagcaagttagacctagttccagatttgtatgtaactccagtccagattgattttctttgcacctgtgagtgcttgctgtggtctgtgtatatttggtgatgcctgatatatcatatatgcctgatgctgtctgtattaactactctcaagctcactggtatccctcacttgaaagtttgttcataaaaa

SEQ ID NO: 1044 - DNA, 1161 bp, Brachypodium distachyon
aagaaaaagagttattttttgaggagatcagatcggagagcccagaaagaaaataaaaactcgaagagatctccgtatctgttcccctctctccctccctctgccaccaaccatctgccttcgcgacgaggcaacccgccggccggagagacgaagaaggagagcgaagaagatgtcgtcggtgttcagcggcgatgagacggcgcccttcttcggcttcctcggcgccgccgccgccctcgtcttctcatgcatgggggcggcgtacgggacggcgaagagcggggtcggggtggcgtcgatgggggtgatgcggccggagctggtgatgaagtccatcgtgcccgtcgtcatggcgggggtgctcgggatctacggcctcatcatcgctgtcatcatcagcaccgggatcaaccccaaggccaagccgtactacctcttcgacggctacgcgcacctctcctcgggcctcgcatgcggcctcgcgggcctcgccgccggcatggccatcggcatcgtcggcgacgccggtgtcagggcaaacgcacaacaaccaaagctgtttgtgggcatgatcctcatcctcattttcgcagaagcgctggccctctatggcctcatcgtgggcatcatcctctcatcccgtgccggccagtcccgcgcagattagaaaccttcctctaccgttccacggtcaccccgcaggctacattcttgaaaaaaagtgaaacttcgaaaagttctggttttgatgtattaaggaggagagatttgtaggttaaaggaaggtggcacttccagtactattttcttcctgttttggatcctggtggtcccttgctgttcatgcagaggattttggtggaataagaacatggcgttgtagctaaataagaatactatggtatattatgttcatcacttcttcctactcttatgtctgggaaacaaaagaagaatactatggtatattatgttcatcacttcttcctactcttatgtctgggaaacattagtcttattcagcgcgattgcaagaacaattggtttctgcttggattgttgtattttttgtgggaggaaggctatttagtttaacttcctcaaagttgaactaaattggagcctcatacacaaaaaatgtatgcggagaacaacaat

SEQ ID NO: 1045 - DNA, 1344 bp, Brachypodium distachyon
acccagaggggcaaaaccgtccaggaggaaaatagacatcccgccccaccacgctgcgccgtgcccctctcgtcttcttctctcctcctcctcttcctctcgccccacgaccccccaaaacgccctcctcctcagatcagatcgagcgaaaccaaaccaaatcccaaaagctcgagagctctccggaggaggcgccgacgacccgccgttgttgcttcggaggacgagtggctagagcgcgagggtttcccggatcgtagcaggaggagcagcagctgcagagagagagaggatcggagatgtcgtcggtgttcagcggcgatgagaccgcccccttcttcggcttcctcggcgccgccgccgcgctcgtcttctcatgcatgggggcggcctacgggacggccaagagcggcgtcggggtggcgtccatgggtgtcatgcgcccggagctcgtcatgaagtccatcgtgcccgtcgtcatggccggagtgctcggtatctacggcctcatcattgccgtcatcatcagcaccgggatcaaccccaaggccaagccatactacctcttcgacggctacgcccacctctcgtccggcctcgcctgtggcctcgccgggcttgccgctggcatggccatcggcattgttggtgatgctggagtcagggcgaatgcacagcagccgaagttgttcgtgggcatgatccttatcctcatcttcgccgaggcgctcgccctctacggcctcatcgttggtatcatcctgtcgtcccgtgctggtcaatcccgtgccgattaggcaatgttccgacacgcggccctgcgcggcctcctgttttatattattcagacaacaaactgagctctagagattatcatgactagtttttgttcttctgtttggtcgagaaaaaaacatctgtggccaagggaagtttgcccttgccgtaccattctttttccgtgaggatgtttgggtggtggttgatgcttatttatgcacagttatttattttttggggttctggctggacggtgtaatctggtgaataagcaagaacatgcatgcaattgagcttaggactcttttgttaatttgtcctcttgttctgtttcttattcgttcttctgaatcgtgagttcttgtgaagttaaaccgcatattgttctcaacctactatatttcacttaatactgtgctgagttctcgtttgttgtgatggaggattcttggaggaatatgttgaagcgattgcactgttttatgtggagatgtatgaacgagagagagatattttcaaagtatgtttcatttctgggagatataaagaagagagattgatata

SEQ ID NO: 1046 - DNA, 891 bp, Cynodon dactylon
agatcagatcagagcccgcgcccaaagcagaggaggaaaatctcgcgacctcgctctgtgcgccgacgaggggtaggtaggctgcggcacgggagctcctcgattccccgcatcgcagcagcagcaggaggaagaagatgtcgtcgaccttcagcggcgatgagaccgcccccttcttcggcttcctcggcgccgccgccgcgctcgtcttctcatgcatgggagcggcctacgggacagcgaagagcggcgtcggcgtggcgtccatgggagtgatgcgcccggagctcgtcatgaagtccatcgtgcccgtggtcatggctggtgtgctcggtatctacggcctcatcatcgccgtcatcatcagcaccgggatcaaccccaaggccaagccctacttcctcttcgacggctacgcccacctctcgtccggcctcgcctgtggtctcgctgggcttgccgccggcatggccattggcatcgtcggtgatgctggtgtcagggcaaatgcacagcagccaaagctgttcgtgggtatgatcctcatcctcatctttgctgaggcgcttgctctctacggtctcatcgtcggcattatcctgtcatcccgcgctggccagtctcgtgcagattaggcacgttaccagtttcaatatcatgtcggcccttgctgggtcttgttccatattcctgaaatgagaagctggagctctttagaggttattgttgtgtctagtttttatcttctgctgggtcgagtggaaaacaaaaatctgtagccgcaggaggaccttccctgctgttgacattcttttaccgtcgtgatggtcggctgtgggtggtgctacttgtgcagtttttttgggggggtctggctggacggcgatgtat

SEQ ID NO: 1047 - DNA, 658 bp, Cynodon dactylon
acatcttcttcccttctcctcttccttcctcggcgacgcggcaccaccgggaccgagcaaaccaggcgggaggcgaagtccgaggaggaagatgtcgtcggtgttcagcggcgatgagaccgcccccttcttcggcttcctcggcgctgccgccgcgctcgtcttctcatgcatgggcgcggcctacgggacggccaagagcggcgtgggcgtggcgtccatgggcgtgatgcggcccgagctcgtgatgaagtccatcgtgcccgtcgtcatggctggtgtgctcggtatctacggcctcatcatcgccgtcatcatcagtaccgggatcaaccccaaggccaagccgtactacctcttcgacggctacgcgcacctctcgtccggtctggcttgtgggcttgctggcctcgctgctggcatggccattggcatcgtcggtgacgctggagtcagggcaaatgcgcaacagccaaagctgttcgtgggcatgatcctcatcctcatttttgcggaagctcttgctctgtacggtctcattgtgggcattatcctttcatcccgtgctggccaatcccgtgcggattagaagcttccaactacccttttcccgttactactatgtttatttatgctgttttgagagaagctggaactc

SEQ ID NO: 1048 - DNA, 1036 bp, Zea mays
aaaatagtcggtctcgcgtctggagattttcagatcagaaccaaactcggctcgagagagatcgcatacgcctgcctgcccacccacctccccttttccttcctcttcgccccagcgacgcggccgcccggagaccgagcgaggcaggcaactaaccaccgagaggcagggacaggaacaggaagccggaggcgaagatgtcgtcggtgttcagcggcgatgagacggcccccttcttcggcttcctcggcgccgccgccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcacggggatcaaccccaaggccaagccctactacctctttgatggctacgcccacctttcgtccgggcttgcctgtggtctcgctgggcttgcagctggcatggccatcggcattgtcggtgatgctggagtcagggcaaatgcgcaacagccaaagcttttcgttggcatgatcctcatcctcattttcgcagaagcgcttgctctctatggtctaattgttggaattatcctttcgtctcgcgctggtcaatcccgggcggattaagtgcaccaccattctgtgattaccgcaccgtttattatgctattctgagaggattggaactctattcccttgtctagtttattcttgttaccatgtattaatgtaacaatctgtagctgatggaaggtgacttccagtcatgttttggttttggtggtgtcgagcagaggttatttatttttgggttaaggtcggagtcggacggatgctcttgggctaagtggatttaattttatccttgctgaataaagaacacggaattgtagccaaataagaacgtgatatataaatatttctttcccactttgctggatgcctggattttcatcaccatctatact

SEQ ID NO: 1049 - DNA, 994 bp, Zea mays
gataggggtagtcgcaacaaaaagaaaccaaactcggctcgagagagatcgcatcttgcctgcccacccaagcttccctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggctacgctcacctttcgtccgggcttgcctgtggccttgctgggcttgcagctggcatggccatcggcattgttggtgatgctggagtcagggcgaatgcacaacagccgaagctttttgtgggcatgatcctcatcctcattttcgcagaagcgcttgctctgtacggtctcattgttggaattatcctttcatcccgtgctggtcaatcccgagcagattaagtgcactaccattctgcgattaccgtactgtttattatgctattctaagagaattgaaactctatgcccttgtctagtttattcttgttaccatgtattaatgaaacaatttgtagctgaaggaaggtgacacttccagccatgttggttttggcggtgttaagcagaggttatttattgggttaaggttggagggatgtgggttaagattggatggatgctcctgggctaagtggatttaatttttatccttggtgaataatgaacacggaggtgtagccaaataataacgtgatatatatatttctttgccccttta

SEQ ID NO: 1050 - DNA, 1202 bp, Zea mays
actcctccggtcctgcctggctgcctcttcccgggcatcccggccgcagggtaaaaccgtccttgtctcaccaacgtcgcagcgccgtggccctctgagccctctctcgtcttcttccccaccccaccagtgacccacgcgttcctcagatcagatcggcaaggccaatccgaaatctcgagctttcgcgccggcgaccacagcaaagaggaggccacagcacgacagcgccccagggttcctactctcgtcgcagcggcagcagtgaggggaagatgtcgtcggtgttcagcggcgatgagaccgcccccttcttcggcttccttggcgccgccgccgctctcgttttctcatgcatgggggcggcgtacgggacggccaagagtggcgtcggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatactacctctttgacggctatgcccacctgtcgtccggccttgcctgtggtcttgctgggcttgctgcaggcatggccattggcatcgttggtgatgctggtgtcagggcgaacgctcagcagccaaagctgtttgtgggcatgatcctcatcctcatcttcgctgaagcgctcgccctatacggtctcatcgtcggcatcatcctttcatcccgcgccggccagtctcgtgcggactaggcacgttccacatgtctccgccacctggtcgtaaccgggtcgtgttttgtatcggtgatgagccgacaagctggagcacttaattttttttatgctgtctagttttttgaacttgcgttgagtcgagaaaacaaaatagaacttgggtagccgagggggtgaccttttttcccttgtgccattcttttccctgtcgtggtgggtggtgggctgtggctgatgcttctttctgcacacttttttttgcttgggctcggggcgttggtgtaatttggtgaataagcgagtgcgtccagtgcaatgggagctcaggactcttctgttcaaaatccgccttgtttcgtcgttgtcttgttctgtgttctatatgaatattgtcgtgtgggaaatacatgcgtggctcatgaactagtgcttgtttcttctagc

SEQ ID NO: 1051 - DNA, 934 bp, Pennisetum glaucum
tcccttccccagcgacgcggccacccccgcgaccgagcaaccaacaccaccaccgcagggagggaagagcaggaaccgggagagaagagcaagatgtcgtcggtgttcagcggcgatgagacggcccccttcttcggcttcctcggcgccgccgccgccctcgtcttctcatgcatgggcgcggcctacgggacggccaagagcggtgtcggcgtggcgtccatgggtgtgatgcggccggagctcgtgatgaagtccatcgtgcccgtggtcatggctggtgtgctcggtatctacggactcatcattgccgtcatcatcagtaccgggatcaaccccaaggccaagccatactacctcttcgatggctacgcgcacctctcgtctgggctcgcttgtggactcgctgggcttgccgctggcatggccattggcatcgtcggtgacgctggagtcagggcaaacgcacaacagccgaagctatttgtgggaatgattctcattctcattttcgcagaggcgcttgctctctacggtctcatcgtgggcatcatcctctcgtcccgtgctggccaatcccgtgccgattaggcgcttgcggctaccattctataattactgctgtgtttattatgctattttgggagaaacttggaactcgtggttcttgtctagtttattcatgttaccatgtatcaatgaaacatttgtagctgaaggaaggtggcacttccagtcatgttcgtctttggtggtgtcaagaggttattttttgggttaaggctggatggacgctcctgggctaagtggatttaattttatccttggtgaataaagaacacggaattgtagccaaataataacgtgataatcgatatatatttcttggtacccaaaaaaaaaaaaaaaaaaaaaaagtaaaaaacgtactcgt

SEQ ID NO: 1052 - DNA, 956 bp, Pennisetum glaucum
gcaacaaaaagaaaccagcctccgctcgagagagatcgcatctgcctggctgcctcccccgaccttcccttccccagcgacgcggccacccccgcgaccgagcaaccaacaccaccaccgcagggagggaagagcaggaaccgggagagaagagcaagatgtcgtcggtgttcagcggcgatgagacggcccccttcttcggcttcctcggcgccgccgccgccctcgtcttctcatgcatgggcgcggcctacgggacggccaagagcggtgtcggcgtggcgtccatgggtgtgatgcggccggagctcgtgatgaagtccatcgtgcccgtggtcatggctggtgtgctcggtatctacggactcatcattgccgtcatcatcagtaccgggatcaaccccaaggccaagccatactacctcttcgatggctacgcgcacctctcgtctgggctcgcttgtggactcgcggggcttgccgctggcatggccattggcatcgtcggtgacgctggagtcagggcaaacgcacaacagccgaagctatttgtgggaatgattctcattctcattttcgcagaggcgcttgctctctacggtctcatcgtgggcatcatcctctcgtcccgtgctggccaatcccgtgccgattaggcgcttgcggctaccattctataattactgctgtgtttattatgctattttgggagaaacttggaactcgaggttcttgtctagtttattcatgttaccatgtatcgatgaaacatttgtagctgaaggaaggtggcacttccagtcatgttcgtctttggtggtgtcaagaggttattttttgggttaaggctggatggacgctcctgggctaagtggatttaattttatccttggtgaataaagaacacggaattgtagccaaataataacgtgataatcgatatatatttcttggtc

SEQ ID NO: 1053 - DNA, 890 bp, Pseudoroegneria spicata
  misc_feature (8)..(9): n is a, c, g, or t
gaaagccnnaaccaaatcccaaagccacaacagaaaagctcgagctcttgcttgggtggacgagcgagcagagcgccgatcgcagcagtagcaccaggaggaggaagatgtcgtcggtgttcagcggcgatgagaccgcccccttcttcggctttctcggcgccgccgcggcgctcgtcttctcatgtatgggggcggcctacgggacggccaagagcggcgtcggcgtggcgtccatgggagtcatgcgcccggagctcgtcatgaagtccatcgtgcccgttgtcatggctggagtgctcggtatatacgggcttattattgccgtcatcatcagtaccgggatcaaccccaaggccaagccctactacctcttcgacggctacgcccacctctcgtccgggctcgcctgtggccttgccggccttgctgctggcatggccatcggcattgttggtgatgctggagtcagggcgaatgctcagcagcccaagctgtttgttggcatgatcctcatcctcatcttcgcagaggcgctcgctctctacggtctcattgtcggcatcatcctgtcatcccgagctggccagtctcgtgccgattaggcatgttccacacacgcggccctgtgtgccctcttgttttacattgttcagacagcaaactgagctctagaggttatcatgtctagttttcattcttctgtttggtggagaaaaaaacatctgtagccaagggaggtttgcccttgatgtaccattctttttccgtcaggatgttgggtgggggttgatgcttatttatgcacagttatttaccttttgggtctggctggacggtgtaatctggtgaataaaggagaacttgcaatgcaattgagttttgtccaa

SEQ ID NO: 1054 - DNA, 997 bp, Secale cereale
ggggcaataccgtccagtaataaacattccgccccaccccgtcttcttcttattcttccccccaatctccaacgccttcctcctcagatcagatcgtggaagcccaaaccaaatcccaaagcgacaacaggaaagttcgagctcttgcttgggtggaggagcgagcagaccccgatcgcagcagtagcagcaggaggaagatgtcgtcggtgttcagcggcgatgagaccgcccccttcttcggctttctcggcgccgccgcggcgctcgtcttctcatgcatgggggcggcctacgggacggccaagagcggcgtcggcgtggcgtccatgggagtcatgcgcccggagctcgtcatgaagtctatcgtgcccgttgtcatggctggagtgctcggtatctacgggcttattatcgccgtcatcatcagtaccgggatcaaccccaaggccaagccctactacctcttcgatggctacgcgcacctatcgtccgggctcgcctgtggccttgctggccttgctgctggcatggccatcggcattgttggtgatgctggagtcagggctaatgctcagcagcccaagctgtttgttggcatgatcctcatcctcatcttcgcggaggcgctcgctctctacggtctcattgtcggaatcatcctgtcatcccgagctggccagtctcgtgccgattaggcacgtttccacacacgcggccctttgtgccctcttgttttaaattattcagacagcaaactgagctctagaggttatcatgtctagttattcattcttctgtttggtggagaaaaaaacatctgtagccaagggaggtttgcccttgatgtaccattctttttccgtcaaaggatgctcggtgggggttgatgcttgtttatgcacagttatttaccttttgggtctggctggacggtgtaatctggtgaataagcgagaacttgcaatgcaattgagtttggtccattcataccccc

SEQ ID NO: 1055 - DNA, 1363 bp, Sorghum bicolor
tatacgtttgcaaaaaccatgaggcgtcgcggaaaatcgatggacactacagtctacagatcagaaaatcagatcgtggcgtagctggagtggactgccactgctatgatcccaggggcaaaccggtaaaaaaccacggtgggccctaccccggtctcgtgtctggagactttcagatcagatcggggaggaggaggaaggagtcgcatcgcaacaaaaagaaaccaaactcggctcgagagagatcgcatctgcttgcctgcccaacccaccttccctttcctccctccgtccctccctcctcgccccagcgacgcggcacaccggagaccgagcaaagcaagccaccacacagaggcaaggagaggaggaggagcaggaagccggaggcgaacaagatgtcgtcggtgttcagcggcgatgagacggcccccttcttcggcttcctcggcgccgccgccgccctcgtcttctcatgcatgggcgcggcgtacgggacggcgaagagcggcgtgggcgtggcgtcgatgggtgtgatgcggccggagctcgtcatgaagtccatcgtgcccgtcgtcatggctggtgtgctcggtatctacgggctcatcatcgccgtcatcatcagcacggggatcaaccccaaggccaagccatactacctctttgatggatatgcccacctgtcgtccgggcttgcttgtggccttgctgggcttgcggctggcatggccatcggcattgttggtgatgctggagtcagggcaaatgcacaacagccgaagcttttcgtgggcatgatcctcatcctcattttcgcagaagcgcttgctctctatggtctcatcgttggaattatcctttcatcccgtgctggtcaatcccgggcggattaagtgcactaccattctgcgattaccgcactgtttattatgctattcagagagaattgaaactctatgcccttgtctagtttatttttgttaccatgtattaatgaaacaatctgtagctgaaggaaggtgacacttccagtcatgttggttttggtggtgtcaagcagaggttatattttttgggttaaggttggatggatgctcctgggctaagtggatttaattttatccttggtgaataaagaacacggaattgtagccaaataataacgtgatatatatatatttcattgcccctttactggatccctggattttcattgtcatctatacttgagcatgtccaccgtgatagctgatggtttgtttgatgttttttgagccaatggttgaaaggttgtatgaagtacagaatcttgaatatattgaaatcaagctgctagagattcctgccccttgcaattctg

SEQ ID NO: 1056 - DNA, 923 bp, Saccharum officinarum
accaaactcggctcgagagagatcgcatctgcctgcccaccttctttccttctcctcgccccatcgacgcggcagcccggagaccgagcaacccaccaccgagagtctgagtcagggagaggaacagggagaggcagacgaagatgtcgtcggtgttcagcggcgatgagacggcccccttcttcggcttcctcggcgccgccgccgccctcgtcttctcatgcatgggcgcggcgtacgggacggcgaagagcggcgtcggcgtggcgtcgatgggcgtgatgcggccggagctcgtcatgaagtccatcgtgcccgtggtcatggctggtgtgctcggtatctacgggctcatcatcgccgtcatcatcagcacggggatcaaccccaaggccaagccctactacctgttcgatgggtacgcgcacctgtcgtccgggcttgcctgtggccttgctggacttgcggctggcatggccatcggcattgtcggtgatgctggagtcagggcaaatgcacaacagccaaagcttttcgtgggcatgatcctcatcctcattttcgcagaagcgcttgctctctacggtctcattgttggaattatcctttcatcccgtgctggccaatcccgggccgattaagcgcactaccattctgcgactaccgcgctgtttattactctattctgagagaattgaaactctatgcccttgtctagtttattcttgttaccatgtattaatgaaacaatctgtagctgaaggaaggtgacacttccagtcatgttggttttggtggtgtcaagcagaggttattttttgggttaaggttggatggatgctcctgggttaagtggatttaattttatccttggtcaataaagaacacggtattgtagccaaataataacgtgatatatatat

SEQ ID NO: 1057 - DNA, 971 bp, Saccharum officinarum
accgacacatgtccggtcttcaggacgggtcacccacgcgtccgctctcgtcttcttccccaccccaaccaaaacacccacgcgctcctcagatcagatcggcaaggccaatcccgagcagaggagcgaaatctcgagcgctcgcgccggcgaccacacgacgaagaggaggccgcggcacgagagcgccccaggtttcccgctctcgtcgcagcagcagcagcaaggggaagatgtcgtcggtattcagcggcgatgagaccgcccccttcttcggcttccttggcgccgccgccgcgctcgtcttctcatgcatgggggcggcgtatggtacggccaagagcggcgtcggcgtggcgtccatgggtgtcatgcgccccgagctcgtgatgaagtccatcgtgcccgtggtcatggctggtgtgctcggtatctacggcctcatcatcgccgtcatcatcagcactgggatcaaccccaaggccaagccgtactacctctttgacggctacgcccacctgtcgtctggccttgcctgtggtcttgctgggcttgctgcaggcatggccattggcatcgttggtgatgctggtgtcagggcaaatgctcagcagccaaagttgtttgtgggcatgatcctcatccttatctttgccgaagcgcttgccctctacggcctcatcgtcggcatcatcctttcatcccgtgctggccaatcccgtgcagattaggcacacatttcagatgtcaacgccgtgcggaccattacctggtcgtagctgggtcatgttctatatccatgtgacaacaagctggagcacttttagaggcttatttttaatgctgtctagttttcgttcttctgttgagtcgagaaaacaagaaaacgtgtgtggccaagggagggactttccttggtggggtattcttctccccgtcccggtggtgggctgcggttgatgcttatttct

SEQ ID NO: 1058 - DNA, 1213 bp, Triticum aestivum
cctcctcagatcagatcgtggaagcccaaaccaaatcccaaagcgacaacagaaaagctcgagctcttgcttgggtggacgagcgagcagaccccgatcccagcagtagcaccaggaggaggaagatgtcgtcggtgttcagcggcgatgagaccgcccccttcttcggctttctcggcgccgccgcggcgctcgtcttctcatgtatgggggcggcctacgggacggccaagagcggcgtcggcgtggcgtccatgggagtcatgcgcccggagctcgtcatgaagtccatcgtgcccgttgtcatggctggagtgctcggtatctacgggcttattatcgccgtcatcatcagtaccgggatcaaccccaaggccaagccctactacctcttcgacggctacgcccacctctcgtccgggctcgcctgtggccttgccggccttgctgctggcatggccatcggcattgttggtgatgctggagtcagggcaaatgctcagcagcccaagctgtttgtcggcatgatcctcatcctcatcttcgcagaggcgctcgctctctacggtctcattgtcggcatcatcctgtcatcccgagctggccagtctcgtgccgattaggcatgttccacacacgcggccctgtgtgccctcttgttttatattattcagacagcaaactgagctctagaggttatcatgtctagttttcattcttctgtttggtggagaaaaaaacatctgtagccaagggagctttgcccttgatgtaccattctttttccgtcaggatgctgggtgggggttgatgcttatttatgcacagttatttaccttttgggtctggctggacggtgtaatctggtgaataagcgagaacttgcaatgcaattgagttttgtccattcatcccacaatatcctttcttgtgtattatccttttcgcaaaggagaagtacacatggtttgaaactagaacaccagaacagccccctttggttcaaaagtgatttgtaggattaaattctataggattttttaatgatttgtttttgtactatcctaccgaggaaccatccaaaattctattgtttctctattgatgccaccaaagttccttacaaatttaaaatcctttgaattcctttgattcatagggtagtaatatcatagggataggaaacttgtaaacataagatgccatgcatctc

SEQ ID NO: 1059 - DNA, 1214 bp, Triticum aestivum
agatcagatcgtgaaaaagcccaaaccaaatcccaaagcgacaacagaaaagctcgagctcgagctcttgcttgggtggacgagcgagcagaccccgatcccagcagtagcaccaggaggaggaagatgtcgtcggtgttcagcggcgatgagaccgcccccttcttcggctttctcggcgccgccgcggcactcgtcttctcatgtatgggggcggcctacgggacggccaagagcggcgtcggcgtggcgtccatgggagtcatgcgcccggagctcgtcatgaagtccatcgtgcccgttgtcatggctggagtgctcggtatctacgggcttatcatcgccgtcatcatcagtaccgggatcaaccccaaggccaagccctactacctcttcgacggctacgcccacctctcgtccgggctcgcctgtggccttgccggccttgctgctggcatggccatcggcattgttggtgatgctggagtcagggcaaatgctcagcagcccaagctgtttgtcggcatgatcctcatcctcatcttcgcagaggcgctcgctctctacggtctcattgtcggcatcatcctgtcatcccgagctggccagtctcgtgccgattaggcatgttccacacacgcggccctgtgtgccctcttgttttatattattcagacagcaaactgagctctagaggttatcatgtctagttttcattcttctgtttggtggagaaaaaaacatctgtagccaggggagctttgcccttgatgtaccattctttttccgtcaggatgctgggtgggggttgatgcttatttgtgcacagttatttaccttttgggtctggctggacggtgtaatctggtgaataagcgagaacttgcaatgcaattgagttttgtccattcatcccacaatatcctttcttgtgtattatccttttcgcaaaggagaagtacacatggtttgaaactagaacaccagaacagccccctttggttcaaaagtgatttgtaggattaaattctataggattttttaatgatttgtttttgtactatcctaccgaggaaccatccaaaattctattgtttctctattgatgccaccaaagttccttacaaatttaaaatcctttgaattcctttgattcatagggtagtaatatcatagggataggaaacttgtaaacataagatgccatgcatctc

SEQ ID NO: 1060 - DNA, 893 bp, Triticum aestivum
cccaagcttccctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggatacgctcacctttcgtccgggcttgcctgtggccttgctgggcttgcggctggcatggccatcggcattgttggtgatgctggagtcagggcaaatgcacaacagccgaagcttttcgtgggcatgatcctcatcctcattttcgcagaagcgcttgctctctatggtctcatcgttggaattatcctttcatcccgtgctggtcaatcccgggcggattaagtgcactaccattctgcgattaccgcactgtttattatgctattcagagagaattgaaactctatgcccttgtctagtttatttttgttaccatgtattaatgaaacaatctgtagctgaaggaaggtgacacttccagtcatgttggttttggtggtgtcaagcagaggttatattttttgggttaaggttggatggatgcccctgggctaagtggatttaattttatccttggtgaataaagaacacggaattgtagccaaataataacgtgatatatatat

SEQ ID NO: 1061 - DNA, 893 bp, Triticum aestivum
cccaagcttccctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggatacgctcacctttcgtccgggcttgcctgtggccttgctgggcttgcagctggcatggccatcggcattgttggtgatgctggagtcagggcaaatgcacaacagccgaagcttttcgtgggcatgatcctcatcctcattttcgcagaagcgcttgctctgtacggtctcatcgttggaattatcctttcatcccgtgctggtcaatcccgagcagattaagtgcactaccattctgcgattaccgcactgtttattatgctattcagagagaattgaaactctatgcccttgtctagtttatttttgttaccatgtattaatgaaacaatctgtagctgaaggaaggtgacacttccagtcatgttggttttggtggtgtcaagcagaggttatattttttgggttaaggttggatggatgcccctgggctaagtggatttaattttatccttggtgaataaagaacacggaattgtagccaaataataacgtgatatatatat

SEQ ID NO: 1062 - DNA, 1040 bp, Triticum aestivum
cgtcgccgccgtccaatctccggcgagatcccctcccccgccggcagccatggcttccaccttcagcggcgacgagaccgcccccttcttcggcttcctcggcgccgccgccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcacagcagcccaagctgttcgtcggcatgatcctcatcctcatctttgccgaagcccttgccctgtacggcctcatcgtcggcatcatcctctcctcgcgtgccggccaatcccgcgccgactagaaacaaagcgcttgcaagcaaggagcatacggtccatcattgtaattctgtttgaaagggttcatttcttcttagagacttgtttggcaaacactgtggttctacttctgtgttcatgctccttggcggaggaacataatgtggtttgggatcatagggatttccacgcccgccatctgtaattttattctatgttcggcaacgcaaagctacctgtatctactcgtcgtacctagcacctgttgtatttattgtttggagtaataatcggcgctgagcctcttgggacgtgatatgaatgaataagcaaagctagacctagttccacttttgtgtgcaactcctgtgtctagattcattttgttatgtctggggcatgtggagtgaatgttgtgtttgttatgtttagtgcgtattttgtgatgccaactactagctgtatcaagcacactggtgtttgattgtttgcttatgaaaataaaattgaagattt

SEQ ID NO: 1063 - DNA, 979 bp, Setaria italica
ggggaaagcgtcgcaacaaaaagaaaccagcctccgctcgagagagatcgcatctgccctcccttctcaacccacccccagcgacgcggccaccccgagaccgagcaaccaacccaccaccgcagggaggagagagcaagatgtcgtcggggttcagcggcgatgagacggcccccttcttcggcttcctcggcgccgccgccgccctcgtcttctcatgcatgggcgcggcctacgggacggcgaagagcggcgtcggcgtggcgtccatgggtgtgatgcggccggagctcgtgatgaagtccatcgtgcccgtggtcatggctggtgtgctcggtatctacggcctcatcatcgccgtcatcatcagtactgggatcaaccccaaggccaagccatactacctcttcgatggctacgcgcacctctcgtccgggctcgcttgtgggctcgctgggcttgccgctggcatggccattggcatcgttggtgacgctggagtcagggcaaacgcacaacagccgaagctatttgtgggcatgatcctcattctcattttcgcagaggcgctcgctctctacggtctcattgtgggcatcatcctttcatcccgtgccggccaatcccgtgcggattaggcgcttgctgctaccattctataattactgctgtgcttattatgctattttgagagaaacttgaactcgaggttcttgtctagttattcatgttaccatgtatcaatgaaacatttgtagctgaaggaaggtggcacttccagtcatgtttgttttggtggtgtcaagcagaggttattttttgggttaaggctggatggatgctcctgggctgagtggatttaattttatccttggtgaataaagaacacggaattgtagccaaataataacgtgataaatgatatatatttcttcgtccctttactacatccctgtgtttgcaatgtcaagcatgtctg

SEQ ID NO: 1064 - DNA, 939 bp, Eragrostis curvula
  misc_feature (6)..(7): n is a, c, g, or t
  misc_feature (9)..(9): n is a, c, g, or t
  misc_feature (14)..(14): n is a, c, g, or t
  misc_feature (24)..(25): n is a, c, g, or t
gacgtnnangggcngacaaagaannagctcagttgagagagatcgcattaacccacttccttcttctcttcccttccccggcgacgcggcaaccccgagaccgagcaaacagcgacgccgagctcacaggaagaggaagaagatgtcgtcggtgttcagcggcgatgagaccgcccccttcttcggcttcctcggcgccgccgccgcgctcgtgttctcatgcatgggggccgcgtacgggacggccaagagtggcgtcggtgtggcatccatgggtgtgatgcggcccgagctcgtcatgaagtccatcgtgcccgtggtcatggctggtgtgctcggtatctacgggctcatcattgccgtcatcatcagtaccgggatcaaccccaaggccaagccgtactacctcttcgatgggtacgcccacctctcgtccgggcttgcttgtggtcttgctggtctcgctgccggcatggccatcggcatcgtcggtgatgctggagtcagggcaaatgcacaacagccaaagctgttcgtgggcatgatcctcatcctcatttacgcggaagcgcttgctctgtacggtctcattgtgggcattatcctctcatcccgtgctggccaatcccgtgcagattagaggctctccccttctacagttactgcactgtttattatgatgttttgagaagctgaaactctgggttcttgtctagtttattcttgttaccatgtattaaggaaacatttgtagctgaaggaaggcggcacttgcagtcatgttcctggtggttgcccattactgttatgcagaggttatttttttggggttataaggctgggtggacgctcctgggccatgtgaatttaatattgttcttggtgaaccaaaacacgccattgtagcccaataataaccgtgattatattattcttcca

SEQ ID NO: 1065 - DNA, 1365 bp, Oryza sativa
gtgaggtcttactattttaaactcatgcacattgaaaatggaagatggcctaacaaaggattttattatctcgaactagtagtagctagccaaaaagaactttttatctctttgtgacatggggcaaaaaaaaaagaaaaagaaaaaagacagtgatgcccttactaacccaagacaaaccaccagccttgcctctacctgcctcacgagggcaaaaccgtccaaacccagccacgccgccgcgtgcgcctctcgtttttcctcttctcccacctccgtcttcctcctcctcaatccccaaatcgaagcactcctctcctctcctctcctcagatcggatcgcgagagccccaatcccaccaccgatcgatccattcctgctgctcgcggccaccggagaaggagagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcgcacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcatcctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaataattcgtaatgcaatgggagcatgagactcttttgttcactcaatcctctattctttttattcgtcattgagttgtgattcctgatttctgcaaggtaaattcgcaccatggttgttttca

SEQ ID NO: 1066 - DNA, 1195 bp, Sorghum bicolor
gtgtcctactcctccccggtcgaggggtaaaaccgtccttgtcccaccccacctcgcagcgccgtggccctctcgtcttcttccccaccccaaccaaaacacccacgcgctccctcagatcagatcggcaaggccaatcccgagcagaggaccgaaacctcgagcgctcgcgccggcgaccacacgacgaagaggaggccgcggcacgagagcgccccagggttcccgctctcgtcgcagcagcagtaaggggaagatgtcgtcggcgttcagcggcgatgagaccgcccccttcttcggcttcctcggcgccgccgcggcgctcgtcttctcatgcatgggggcggcgtacgggacggccaagagtggcgtcggcgtggcgtccatgggtgtcatgcgccccgagctcgtcatgaagtccatcgtccccgtggtcatggctggtgtgctcggtatctatggcctcatcatcgctgtcattatcagcactggaatcaaccccaaggccaagccgtactacctctttgacggctacgcccacctgtcgtctggccttgcctgtggtcttgctgggcttgctgcaggcatggccattggcatcgttggtgatgctggtgtcagggcgaatgctcagcagccaaagttgtttgtgggcatgatcctcatcctgattttcgctgaagcgcttgccctctacggtctcatcgtcggcatcatcctttcatcccgtgctggccaatcccgtgcagattaggcacatatttcagatgtgaatgctgtgcggactgttaccgttacctggttgtagctgggtcatgttctatatccatgagacaagaagctggagcactttttagaggcttattttttatgctgtctagttttcgttccgttgagttgagaaaacaagaaaacttgtgtaaccatgggtggacttttcccttgtggtgtcattcttttccccgtcgtggtggtgggctgtggttgatgcttctttctgcacagtttttgctggggctgtaatctggtgaataagcgagtgcatgcaacgcaatgggagctgaagactcttgttcaatcctcttgtttagtcgttttctgtgatctaagaatatttttgtgtgggaaatctatgcgtggctcatgaactggtgcttgtttcacgctgctggtacgagaaatttttgtagtggtc

SEQ ID NO: 1067 - DNA, 1116 bp, Sorghum bicolor
tcctgcccctccctggttgcaggggtaaaaccgtccatgtcccaccccacctcgcagcgccgtggccctctcgtcttcttccccacgcgcttcctcagatcagatcggcaaggccaatcccgagcggaggagcgaaatctcgagcgctcgcgccggcgaccacaggacgaagaggaggccgcggtacgagagcgccccagggtcccccctcttgtcgcagcagcagcagtaaggggaagatgtcgtcggcgttcagcggcgatgagaccgcccccttcttcggcttcctcggcgccgccgccgcgctcgtcttctcatgcatgggggcggcgtatgggacggccaagagtggcgtcggcgtggcatccatgggtgtcatgcgccccgagctcgtcatgaagtccatcgtgcccgtggtcatggctggtgtactcggtatctatggcctcatcatcgctgtcattatcagcactggaatcaaccccaaggccaagccgtactacctctttgacggctacgcccacctgtcgtctggccttgcctgtggtcttgctgggcttgctgcaggcatggccattggcatcgttggtgatgctggtgtcagggcaaatgctcagcagccaaagttgtttgtgggcatgatcctcatccttattttcgccgaagcgcttgccctctacggtctgattgtcggcatcatcctttcatcccgtgctggccaatcccgtgcagattaggcacacatttcagatgtcaacgccttgcggactgttaccgttacctggtcgtagctgggtcatgttctatatccatgagacaagaagctggagcactttttagaggcttatttttttatgctgtctagtttcgttcttctgttgagttgagaaaacaagaaatttgtgtagccaagggaggacatttcccttgtggtgccattcttttccctgtcgtggtggtgggctgtggttgatgcttatttctgcacagtttttgctggggctgggactgtaatctggtgaataagcgagtgcatgcaacgcaatgggagctgaagactcgtgttcaaataatcaaatcctcttgtttagtcgttttctatgatctatgaatatt

SEQ ID NO: 1068 - DNA, 911 bp, Saccharum officinarum
accaaactcggctcgagagagatcgcatctgcctgcccaccttctttccttctcctcgccccatcgacgcggcagcccggagaccgagcaacccaccaccgagagtctgagtcagggagaggcagacgaagatgtcgtcggtgttcagcggcgatgagacggcccccttcttcggcttcctcggcgccgccgccgccctcatcttctcatgcatgggcgcggcgtacgggacggcgaagagcggcgtcggcgtggcgtcgatgggcgtgatgcggccggagctcgtcatgaagtccatcgtgcccgtcgtcatggctggtgtgctcggtatctacgggctcatcatcgccgtcatcatcagcacggggatcaaccccaaggccaagccctactacctctttgatggctacgcccacctctcgtccgggcttgcctgtggccttgctgggcttgcagctggcatggccatcggcattgtcggtgatgctggagtcagggcaaatgcacaacagccaaagcttttcgtgggcatgatcctcatcctcattttcgcagaagcgcttgctctctacggtctcattgttggaattatcctttcatcccgtgctggccaatcccgggccgattaagcgcactaccattctgcgactaccgcgctgtttattacgctattctgagagaattgaaactctatgcccttgtctagtttattcttgttaccatgtattaatgaaacaatctgtagctgaaggaaggtgacacttccagtcatgttggttttggtggtgtcaagcagaggttattttttgggttaaggttggatggatgctcctgggttaagtggatttaattttatccttggtgaataaagaacacggaattgtagccaaataataacgtgatatatatat

SEQ ID NO: 1069 - DNA, 965 bp, Triticum aestivum
acccgacgtcgccgtcgccgtccaatctccggcgagatcccctcccccgccggcagccatggcctccaccttcagcggcgacgagaccgcccccttcttcggcttccttggcgccgccgcggccctcgtcttctcctgcatgggggcggcgtacgggacggcgaagagcggggtgggggtggcgtcgatgggggtgatgcggccggagctggtgatgaagtccatcgtgcccgtggtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcgcagcagcccaagctgttcgtcggaatgatcctcatccttatctttgccgaagcccttgccctgtacggcctcatcgtcggcatcatcctctcctcgcgtgccggccaatcccgtgccgactagaaacaaagcacttgcaagcaaggagcatacgtggtccatcattgtattctgtttgaaagggtttatttcttcttagagacttgtttggcattacgctgtggttctacttctgtgttcatgctcctgaacagatcaaggaacataatgtggtttgggatcatagggatttccacgcctgccatctgtaattttattctatccggcaacgcaaagctacctgtatctactcgtcgtacctagcacctgttgtatttattgtttggagtaataatcggcgatgagcctcttgggacgtgatgaacgaataagcaaagctagacctagttccacttttgtgtgcaactcctgtgtctagattcattttgttatgtttggggcatgtggagtgaatgctgtgcttgttatgttt

SEQ ID NO: 1070 - DNA, 1066 bp, Triticum aestivum
cctccctctcccatcccctctctctcctccactcgccgtcgccgtcgtcgtcgccgtccaatctccggcgatatcccctcccccgccggcagccatggcctccaccttcagcggcgacgagaccgcccccttcttcggcttcctcggcgccgccgcggccctcgtcttctcctgcatgggggcggcgtacgggacggcgaagagcggggtgggggtggcgtcgatgggggtgatgcggccggagctggtgatgaagtccatcgtgcccgtggtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcgcagcagcccaagctgttcgtcggaatgatcctcatccttatctttgccgaagcccttgccctgtacggcctcatcgtcggcatcatcctctcctcgcgtgccggccaatcccgtgccgactagaaacaaagcacttgcaagcaaggagcatacgtggtccatcattgtattctgtttgaaagggtttatttcttcttagagacttgtttggcattacgctgtggttctacttctgtgttcatgctcctgaacagatcaaggaacataatgtggtttgggatcatagggatttccacgcctgccatctgtaattttattctatccggcaacgcaaagctacctgtatctactcgtcgtacctagcacctgttgtatttattgtttggagtaataatcggcgatgagcctcttgggacgtgatgaacgaataagcaaagctagacctagttccacttttgtgtgcaactcctgtgtctagattcattttgttatgtttggggcatgtggagtgaatgctgtgcttgttatgtttggtatatatagctgtatcaatcacactggtgtttgatagtttgcttatgaaaataaaattgaaga

SEQ ID NO: 1071 - DNA, 889 bp, Triticum aestivum
cgccgcccaatctccggcgagatcccctcccccgccggcagccatggcctccaccttcagcggcgacgagaccgcccccttcttcggcttcctcggcgccgccgccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcccacctctcctccggcctcgcctgcggcctcgcgggcctcgccgccggcatggccatcggcatcgtcggcgacgccggcgtcagggccaacgcacagcagcccaagctgttcgtcggaatgatcctcatcctcatctttgctgaagcccttgccctgtacggcctcatcgtcggcatcatcctctcctcgcgcgccggccaatcccgcgccgactagaaacaaaagcgcttgcaagcaaggggcatacggtccatcattgtaattctgtttgaaaggggtttatttcttcctagagacctgtttggcattacgctgtggttctacttgtgtgttcatgctcctcgacagatcaatcaaggaacataatgtggtttgggatcatggggatttccacgcccgccatctgtaattttattctatgttcgacaacgcaaagctacctgtatctactcgtcgtacctagcacctgttgtatttattgtttggagtaataatcggcgctgagcctcttgggacgtgatatgaatgaataagcagagctagacctagttccacttttgtgtg

SEQ ID NO: 1072 - DNA, 1041 bp, Triticum aestivum
gcgagatcccctcccccgccggcagccatggcctccaccttcagcggcgacgagaccgcccccttcttcggcttcctcggcgccgccgccgccctcgtcttctcctgcatgggggcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaacgcgcagcagcccaagctgttcgtcggcatgatcctcatcctcatctttgccgaagcccttgccctgtacggcctcatcgtcggcatcatcctctcctcgcgcgccggccaatcccgcgccgactagaaacaaaagcgcttgcaagcaaggggcatacggtccatcattgtaattctgtttgaaaggggtttatttcttcctagagacctgtttggcattacgctgtggttctacttgtgtgttcatgctcctcgacagatcaatcaaggaacataatgtggtttgggatcatggggatttccacgcccgccatctgtaattttattctatgttcgacaacgcaaagctacctgtatctactcgtcgtacctagcacctgttgtatttattgtttggagtaataatcggcgctgagcctcttgggatgcgaatgcgatgaatgaataagcaaagctagacccagttccacttttgtgtgtaactcctgtgtctagattcattttgttatgtttggggcatgttgagtgaatgttgtgtttggttatgtttggtgtatattttgtgattccaactactgctgtgtcaagcacactggtgtttgatagttttgcttatgaaaatgaaattgaagattttgaaatt

SEQ ID NO: 1073 - DNA, 947 bp, Triticum aestivum
cgccgtccaatctccggcgagatcccctcccccgccggcagccatggcttccaccttcagcggcgacgagaccgcccccttcttcggcttcctcggcgccgccgcggccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcacagcagcccaagctgttcgtcggcatgatcctcatcctcatctttgccgaagctcttgccctgtacggcctcatcgtcggcatcatcctctcctcgcgtgccggccaatcccgcgccgactagaaacaaagcgcttgcaagcaaggagcatacggtccatcattgtattctgtttgaaagggttcatttcttcttagagacttgtttggcaaacactgtggttctacttctgtgttcatgctcctcggcggaggaacataatgtggtttgggatcatagggatttccacgcccgccatctgtaattttattctatgttcggcaacgcaaagctacctgtatctactcgtcgtacctagcacctgttgtatttattgtttggagtaataatcggcgatgagcctcttgggacgtgatatgaatgaataagcaaagctagacctagttccacttttgtgtgcaactcctgtgtctagattcattttgttatgtctggggcatgtggagtgaatgttgtgtttgttatgttt

SEQ ID NO: 1074 - DNA, 1158 bp, Triticum aestivum
caagagtggctctggctttatttactcctaaagaatcgttcagccgagcttgacccctcccctctctctcctccactcgtcgccgccgtccaatctccggcgagattccctcccccgccggcagccatggcttccaccttcagcggcgacgagaccgcccccttcttcggcttcctcggcgccgccgcggccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggtctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcacagcagcccaagctgttcgtcggcatgatcctcatcctcatctttgccgaagctcttgccctgtacggcctcatcgtcggcatcatcctctcctcgcgtgccggccaatcccgcgccgactagaaacaaagcgcttgcaagcaaggagcatacggtccatcattgtattctgtttgaaagggttcatttcttcttagagacttgtttggcaaacactgtggttctacttctgtgttcatgctcctcggcggaggaacataatgtggtttgggatcatagggatttccacgcccgccatctgtaattttattctatgttcggcaacgcaaagctacctgtatctactcgtcgtacctagcacctgttgtatttattgtttggagtaataatcggcgatgagcctcttgggatgtgatatgaatgaataagcaaagctagacctagttccacttttgtctgtaactcctgtgtctagattcattttgttatgtctggggcatgtggagtgaatgttgtgtttgttatgtttagtgcgtattttgtgatgcgaactactagctgtatcaagcagactggtgtttgatagtttgcatatgagaataaaattgaagattttgaaaaaaaaaaaaagcccacctgcccgggcggccgctcgaa

SEQ ID NO: 1075 - DNA, 914 bp, Triticum aestivum
aggaggagaggagaaaataaaagcaaactggagagaccatctgttcctctccctaccaaccatcttccttagcgacgaggccacccagagctccacaggaaagaagcgcgaccggagaaagaaggagagcaagatgtcgtcggtgttcagcggcgatgagacggcgcccttcttcggcttcctcggcgccgccgccgccctcgtcttctcatgcatgggggcggcctacgggacggccaagagcggcgtcggggtggcgtccatgggagtcatgcggccggagcttgtcatgaagtccatcgtgcccgtgtcatggcgggagtgctcggaatctacggcctcatcatcgccgtcatcatcagcaccgggatcaacccaaggccaagccctacttcctcttcgacggctacgctcacctctcctccgggctcgcctgtggcctcgcggggctcgccgccggcatggccattggcattgtcggtgatgctggagtcagggctaacgcgcaacaaccaaagctgttcgtgggtatgatccttatcctcattttcgcagaagcacttgccctttacggtctcatcgtgggcatcatcctgtcgtcccgtgccggccagtcccgtgcggattaggcgcctcgctctaccattctgcaattgccacacaggctacattcttgagaagctgaagcattgaaaagttctaattttgatgtattaaggagatatttgtagattattaaggaaggtgacacttccagtaccgttttcgttctttttgggttgtggtgggcgtttgctgttcgtgcagaggattttggggtaggctggattgctgctcctggttatatgggttttaatcctactggtggtgaataaaaacacgcattgtagctaaataataaatttatgattata

SEQ ID NO: 1076 - DNA, 1006 bp, Sesamum indicum
ctctctctctgcggagttttgcgcaaaaattaaaattctttcagatccgatctctgcagaaatccaaatcgatcgaagatgtcttcaaccttcagcggcgatgaaacggcaccattcttcggcttcctcggcgctgccgctgccctagtcttctcctgtatgggagcggcgtatggcactgctaagagtggcgtcggagtggcgtcgatgggtgtgatgagacctgagctggtgatgaagtctattgttcccgtggtcatggctggtgttttgggtatttatggtttgattattgctgtgattattagtaccggtattaaccctaaggctaagtcttactacttgtttgatggctatgctcacctttcttctgggcttgcttgtggtctcgccggccttgctgctggtatggccatcggaatcgtaggagatgctggtgttagagccaatgctcaacaaccaaaactctttgtcgggatgattcttatcctcatttttgctgaagctttggccctttatggtctcattgttggcatcatcctctcttctcgtgctggccagtctagagcagattagaagattacttcttgcacaagggttgttgctgttcttcctatcaagtaagaatcaacattatgttctccatggttagcttgataatttggctgggcagtgttttaagctcaagttttctgttgctcgtgtcaattgctcggctggaagaattgagggtggcatgtttatgttggtaggatgtagatgagaagtttgattttcgctgaataaatttgtctgatatattaatggtgctatatctggaccatatttgatttgtataaaccattttggctgtattatttgtttttccaagttcggccttaaaaggcttacaattacttttgttcttgtgattcctgcgagtacacaaagtcgagaagagtttgaaagttattttgccaagtgccagtgttgaatacaagtttctataaaagaaagtgttaagtcc

SEQ ID NO: 1077 - DNA, 814 bp, Ocimum basilicum
aactctgctgctcacagatctcaaatccgaacccctctttgctgattacgcaatcaaattccatcggaaacaaacatgtcgtcgaccttcagcggtgatgaaactgctcccttcttcggatttctcggcgccgccgctgctctcgtcttctcctgtatgggcgcggcgtatggaacagcgaagagtggagtgggcgtggcgtcgatgggggtgatgcggccggagctggtgatgaaatcaatcgtgccggtggttatggctggagttttgggtatatatggattgattattgctgtgattataagcactgggattaaccctaaggccaaatcgtattaccttttcgacggctacgcccatctctcttccggcttggcgtgtggcctcgctgggcttgctgctgggatggctattggcattgtgggagatgctggtgtgagggctaatgcacagcaacctaagctctttgtgggaatgatccttattctcatcttcgctgaagctttggcactctacggtctgattgttggaattatattgtcctcgcgagctggccagtcccgagccgactaagggtagaagctactgatattattctatatttataatatggcaagtttgagagagagctaccagttgcaatattttttattagtatagctaacttgtgtttctttccatcattagttattacacgaggatttggtttttgttgaataagagcccgtatgttggtgttattgcagtcgtgaagaatgcaaaaactttgaaaatcgtggtcatcttctgaaaacgtgcttaacccagtttgaat

SEQ ID NO: 1078 - DNA, 869 bp, Fagus grandifolia
gaatggttctgtgccaatgtgtgaaaactgaatagcccaaaagatgagggtatttctgtaattatgcaccccatcattttgtcgtaaggattagaatctgagattggtatacaatcattcccattggagaggtagaaggggtctgctgatctgctccacaagtattaaccaacaaacaaacaaaccctgcgcttcctatagaattaactgacaaagaaattctcttcgtagatcggatcgtttttctgagtttcaaacaaaaatgtcttcagtgttcagcggcgatgaaacagccccattctttggcttcctcggcgctgcagccgccctagtcttctcatgtatgggagcggcgtacggaacagcgaagagcggggtgggagtggcgtcgatgggtgtgatgaggcctgagctggtcatgaagtcgatcgtgccggtggttatggctggagtgttgggtatttatggtcttatcattgctgtcattattagtactgggattaaccctaaggccaaatcctattacctcttcgatggctacgcgcatctctcttctggtcttgcttgtggcctcgctggcctctctgccggtatggctattggtatcgtcggtgacgctggtgtcagagccaacgcacaacagccaaagctttttgttgggatgattcttattctcatttttgctgaagcactggccctctatggcctcattgttggcatcatcctctcttcccgagctggtcagtcgagagctgactgaatgaccaaattctgctggatggttgtgtgggttgttgctatatcttgggtagttgtttttttgttttactacagattcttggtgggtgagtgtgattgttctaccatat

SEQ ID NO: 1079 - DNA, 1031 bp, Fagus grandifolia
aaagcctatctccaaacgactctttggatgcccgtgagagagccactccaatcaatcatcaccgcctcgatcagatcttctcccacctaaaaaaaaaaaacacaccaaccttgaacagatctccatccgattcccggcatccgctacaccaatccccataaccaaacaaaggaggagaagatgtcatccgttttcagcggcgacgaaactgcaccgttcttcgggttcctcggcgccgccgccgctctggtgttctcatgcatgggcgcggcgtatgggacagcgaagagcggagtgggcgtggcctcaatgggagtgatgcgtcctgagcttgtgatgaagtcaattgttcccgttgttatggctggagtgttggggatctatgggcttatcattgctgttattattagtaccggaattaaccccaaggccaagtcttattatctctttgatggctatgcccacttgtcttctggtctcgcttgtggcctcgctggtctctctgctggcatggctattgggattgtcggtgacgccggtgttcgggctaatgcacagcagccaaaactgttcgtgggtatgattctaatccttatctttgctgaagcacttgctctctatggcctcattgtggggattatcctttcatcccgagcaggccaatctcgtgcagattaaaggaggccaagtttcttgaaaatttttgcttctctgtattacttgcagattatgccagttggatgccttcacaacaatgacattgttaagctttaccatattgttaaattggatcatgcttgtccaaattgtactctatgaaggcaagttgtgatgacaatttgttaaataaggactgattagttataagaaatgtttatccttgtgttttgtgattttgtcaagagatttgcgtatctgatattagttgtgataattagcggattgaaccttagaacaaaaaggctgtttacatggttaattttggatagagaaactttttctcttctgaatgaatgatgagctttaccgat

SEQ ID NO: 1080 - DNA, 882 bp, Fagus grandifolia
aaatctaaaccaaacaatttccgatcaatttcccaatcaacaaaaatgtcttctgtattcagcggcgacgaaaccgccccattcttcggcttcctcggcgccgcagctgccctagttttctcctgtatgggagctgcttatgggacagctaagagtggtgttggcgtggcgtcgatgggtgtgatgcgaccagagctggtgatgaaatcgatcgtgccggttgttatggctggagtgttaggtatttacggtttgatcattgcggttattatcagtacaggaattaaccctaaggccaaatcgtattacctttttgacggttatgctcatctctcctcgggtctcgcttgtggtcttgctggcctctccgctggtatggctatcggtatcgtcggcgatgctggtgttagagcaaatgctcaacagccaaagctttttgttggaatgattcttattctcatcttcgctgaggccttggccttgtatggcctcattgttggtatcatcctttcttctcgagctggccaatccagagcagattagagaaaggcttgccgcaagcagctgatgttggtgttgtagacgttgctcaaggtttgtgatgcattcagagtgggcagtcttgtgtcaagttattcattttgtatgtggactttccatttcattataggaagttctctgctaatttggagctgagttttctgaaataaagctttgctgagctgtttctatacctattgctgtattttagatgttagcttaaactagtctagaaactgtcgttgaaacagatccctgtcaaacgttcacttcacatttctaataaatattattgtacttgaagttgtgtttctagactttctgtatgtctgtgtgtgtgag

SEQ ID NO: 1081 - DNA, 1023 bp, Brachypodium distachyon
cgagggagggagggggcaacctagtaatttcatcagaacgtcgtgtcgtcgtgttctcttccccacccatcgtcttcctcctcgacaccaaccagacgcgagccccctcttatcaatcagacattcagacgcctagggtttcaccaagaaaagaaggggaaagccgattctaaccaagccatggccgcgtccgtcttcagcggcgacgagacggcgcccttctttgggttcctgggcgccgccgcggcgctggtcttctcgtgcatgggcgccgcgtacggcaccgccaagagcggcgtcggggtggcgtcgatgggcgtcatgcggccggagctggtcatgaagtcgatcgtgcccgtcgtcatggcgggagtgctcggcatctacgggctcatcatcgccgtcatcatcagcaccgggatcaaccccaaggccaagccctactttctcttcgacggatacgcgcacctctcctccggactcgcctgcggcctcgctggactcgccgccggaatggccatcggcattgtcggcgacgccggtgtcagggcgaatgcgcagcagcctaagttgttcgtgggtatgatcctcatccttatctttgctgaagcacttgcgctgtatggcctcatcgtcggtatcatcttgtcatctcgagctggtcaatcccgagcagattagacattgggcattgggctgtgatgcctataccatctgtccttgtgatggataccgtgccagtgtgttgttttgctgtatccttgtggtttgtttctgctttttcaaactatatgtttttttctgcttattcttggttgtagtatgatgcacctgtaacttgtaatacacatacctggctacaatggttgcttggaacatggaggatttggtgaataaatcagtcttttttcctctaatgaatatttttctgccgatttctgtgtcttcagtgaccgtgaagttgtaaagaaaaatgctcgccgttgtggcaggataatgagttgccttttgttgatgtagttc

SEQ ID NO: 1082 - DNA, 917 bp, Cenchrus ciliaris
gcctcccccaacctgccctttccttcctccacccccaccccggcgacgcggctacccagcgaccgagcaaccaacccaccaccatcgcaggccgcgcagggaggaaccgggagaggagagcaagatgtcggcggcgttcagcggcgatgagacggcccccttcttcggcttcctcggcgccgccgccgcgctcgtcttctcatgcatgggcgcggcctacgggacggcgaagagcggcgtcggcgtggcgtccatgggtgtgatgcggccggagctcgtgatgaagtccatcgtgcccgtggtcatggctggtgtgctcggtatctacggcctcatcatcgccgtcatcatcagtaccgggatcaaccccaaggccaagccatactacctcttcgatggctacgcgcacctctcgtccgggctcgcttgtgggctcgctgggcttgccgctggcatggccattggcatcgttggtgatgctggagtcagggcaaacgctcaacagccaaagctgtttgtgggaatgatcctcattctcatttttgcagaggcgctcgctctctatggtcttatcgtgggcatcatcctctcgtctcgtgctggccaatcccgtgctgattaggcgcttgtggctaccattctataattaccgctgtgtttattatgctattttgagagaaactttgaactcaaggttcttgtctagtttattcatgttaccatgtatcaatgaaacatttgtagctgaaggaaggtggcacttccagtcatgttcgttttggtggtgtcaagcagaggttattttttgggttaaggctggacggatgctcctgggctaagtggatttaattttatccttggtgaataaagaacacggaattgtagccaaataataacgtgataattgatatatattt

SEQ ID NO: 1083 - DNA, 891 bp, Carpinus betulus
tgtttctgtaattacggaccactatttcgtcgtaaggctgagacaatctgagaacacgagtacacattggcccgctgaggaaggtgtgagatccagaagcatcagcgagcaaaccctcagcttaaagaataaaggaaattctcttctcagatcgtcaatttcgcgaagaaaagatgtcttcagtgttcagcggcgatgaaacagcacctttcttcggcttcctcggcgctgccgccgccctagtcttctcctgtatgggggctgcgtatgggacggcaaagagtggggtgggagtggcgtcgatgggcgtgatgaggccggagctggtgatgaagtcgatcgtgccggtggtcatggcaggagtgttgggtatatatggtctcatcattgccgtgatcatcagcaccgggatcaaccctaaggccaagtcctattacctcttcgatggctacgcccacctctcctctggtctcgcttgtggccttgctggtctctccgccggtatggccattggcatcgtcggtgacgctggtgtcagagcaaatgcccaacagccgaagctctttgttgggatgattcttattctaattttcgctgaagcactggctctctatggcctcattgttggcatcatcctctcttcccgagctggccagtcaagagctgactaaacgtgcacattctactgggtggttgcctggtttgtttctattgagcgagaagtgtttcttactgcagattcttgttggcgagtgtgattgtttttatgcattagggagttgccatgctatggtgttaggatatagtattagaaatgactttgccccttaataaagtttactgttttatctatctgatcctgcactgtgcggatttaagtaaagttctagg

SEQ ID NO: 1084 - DNA, 1325 bp, Zea mays
atcctttctatttttccacacacacagatgcccctccccggtggcagggtaaaacagtacttgtcccgccccacgtcgcagcgccgtgtccctctcgccttcttccccaccccaccctaccctggcacccacgcgctcttcagatcagatcggcaaggccaatcccgagcagtggtgcgaaacctcgagcgctcgcgccggtgaccataacaaagaggaagccgcggtagcactggtagcggcagcagtaaggggaagatgtcgtcggcgttcagcggcgatgagaccgcccctttcttcggcttccttggcgcctccgctgcgctcgtcttctcatgcatgggggcggcgtacgggacagccaagagtggcgttggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatactacctctttgacggctatgcccacctgtcgtctggccttgcctgtggtcttgctgggcttgctgcaggcatggccattggcatcgttggtgatgctggtgtcagggcgaacgctcagcagccgaagttgtttgttggcatgatcctcatccttatttttgctgaagcgcttgccctctatggtctcatcgtcggcattatcctctcgtctcgtgccggccagtcccgcgcagattagaggcacgtttcagatgtcaacaccgtgccgccgacagttgcctggtcgtagctgggtcatgttctatatccatgagacaagaagctggagcactttgactctttgagaggcttacttttatgctgtctagttttccatcttctgttgagtcgagaaaacaagaaaggctgtgtagccaagggatgacttttacccttgtgccattcttttccctgtcgtggtggggggtgggttgcggttgatgcttatttatgcacagtttttgcttgggtcggggctggggctgggacgttggtgtaatgtggtgaataagcgagtgcatgcaacgcaattggaacttaagacatttttggtaaaatactctttcgtattctgttctctgttctatgaatattggtaatatgcgtggctcatgaactagtgtttgtttctcgcagccggtacgggttcttagtggtcctatcagtgttagtagagtggatggatcgcgatccaaatgttttacaatttattagtgctctaaattgatttttgttaaaaataaatagaaatagagcttgattctaatc

SEQ ID NO: 1085 - DNA, 863 bp, Elaeis guineensis
cttccatatccccaattctttcctccttcttcctcgccgaaaattccataaattttgcgatcagggttcgaaggtccgaatcgaggttagggtttcccaagatatcagaggtttcttctatctcggcgacgatgtcgagcttcagcggcgacgaaaccgctcccttcttcggattccttggcgccgcggccgccctcgtcttctcatgtatgggggcggcgtatgggacggcgaagagtggggtgggggtggcgtcgatgggagtgatgcggccggagctggtgatgaagtcgatcgtgcccgtggtcatggctggagtgcttgggatctacgggttgatcatcgctgtgatcattagcacagggataaaccctaaggccaagtcgtattacctcttcgatggctacgctcatctttcctctgggctggcttgtggtcttgcagggctcgccgcgggcatggctattggaatcgttggcgatgctggagtccgggccaatgcgcagcagccaaaactttttgtcggcatgattctcattctcatctttgctgaagcacttgccttgtacggtcttattgttggcatcatcctttcctctcgtgctggccaatctcgggcagactaagaggcgagcagctggctaaaaatgattctacgagcctttgtaataattatattgaacttgaggattttgttaattttgtgattccattgtgatggtatttccaaatgccgtaacagatctttctactttgtgatctgacatctatgtattaaatttattgatagttgctcaagcaaacagtagcttaagtgttgacttattagcagattaatagatcatttcggaatggcatataca

SEQ ID NO: 1086 - DNA, 910 bp, Orobanche aegyptiaca
agtctatgtccaataatcattagctcctcattctctctctctctctctctcacgcagaaagatctaaaaccgaaacctcatcagaactcaattttttgtgtgattttatcagcaaatttgatccaaacgacaatgtcgtcgaccttcagcggcgatgaaactgctcctttctttggctttctcggcgccgccgccgcccttgtcttctcctgtatgggtgcggcttatggaacagcaaagagtggagttggtgtggcgtcgatgggggtgatgaggccggagcttgtgatgaaatcaattgtgccggttgtcatggctggtgttttgggtatatatggactgattattgccgtgattatcagcacaggaattaatcctaaggccaagtcttattacctttttgatggctatgcgcatctctcttcgggcttggcatgtggccttgctggccttgctgctggcatggccattgggattgtgggagatgctggtgttagggctaatgcacagcagcctaaactttttgttgggatgattcttattctcatttttgctgaagctttggcactctatggtctaattgtcggaattatattgtcttcacgagccggccagtcgagagctgactagggttaaaagcttggtaatttacttatattctgtataacttatttatttttcctggaaaatgaaatcttggagaagttgagttcgtagccagtttgaacttgttactttccattattcatcaccattggtactggtaattatcttctgtatttatttaattttatatacgttatttggtggtgttagataagatttttgtcttgtggagtaggctgtattttttactagcgatctatgcgcgagttcctttattagagcatcttacaaaaaaaaaaaaaaa

SEQ ID NO: 1087 - DNA, 1032 bp, Orobanche aegyptiaca
tgcttattcatctctttctctctctagctgcggagtttcgcgcaaaaacaaagacaaacaaatccgcagacagatccgatctctgcaggaatccaatcgatcagaagatgtcgtcaaccttcagcggcgatgaaacggccccgtttttcggcttcctcggcgccgccgcagctctagtcttctcctgtatgggagccgcgtatggcacagccaagagtggcgtcggagtggcgtcgatgggtgtgatgaggccggagctggtgatgaaatccattgttccggtggtcatggctggtgtgttgggtatttatggtttgattattgctgtgattattagtactggtattaaccctaaagccaagtcttactacttgttcgatggctatgctcatctttcttctggactcgcttgtggtcttgctggacttgctgctggtatggctattggaattgtcggagatgctggcgttagggccaatgctcaacaaccaaagctctttgtcgggatgattcttatcctcatttttgccgaagccttagctctttatggtctcatagtcggcattatcctatcttctcgtgctggtcagtcgagagcagattaggagagcttcttttcactccacactagttgtcgaattacctctatatcgagaaagattcgtggcctgttttccctggttagcttggtagtttggccatggcaatttttcaggctcaagttttctgattgggcatggcgatttacttggccaaaagatttgatggttcatatgttacttcggtggtgatgtaaagaagtttgatttatcaatggaataaagatttttgatatttttatggaggtgtagaccatatttgatttgtgtattcggttgccttgtattatttaatcaaaacggatcgtatatcttgagccatgatgtacgtttcattgtgcatgtgactgtaaaattaccgtagtacctttattttcgtgggtatatggcgcgctcacgtgagcaattttcaaaatcgacgatatatacatta

SEQ ID NO: 1088 - DNA, 978 bp, Lippia dulcis
caaatccaacaactgtttattcatccctctctctctctctgcggagtctcgcgcaagaacagagcaggaatcctttcagatccgatctctgcagaactccttatcgatccaagatgtcttcgaccttcagcggcgatgaaacggcaccgttcttcggcttcctcggcgctgccgccgctctagttttctcctgtatgggagcggcgtacggaacggccaagagcggcgtcggagtggcgtcgatgggtgtgatgaggcctgagctggtgatgaagtctattgttcccgtggttatggctggtgtgttgggtatttatggtttgattattgctgtgattatcagtactggtattaaccctaaggccaagtcgtactacttgtttgatggctatgcacacctttcttctggcctcgcttgtggtcttgctggccttgctgctggtatggccatcggaatcgtcggagatgccggtgtcagagccaatgcacagcaaccaaaactctttgttgggatgattcttatcctcatttttgcggaagccttggcactttacggactcattgttgggatcatcctctcttctcgagctggtcaatctagagctgattagaggaatgccgccattcttcccatcaagtcatacgtattcatcgtggttagtatggttagtatggcattttttcaggctcaagttctttgttgtgcgtggcaattcctcggcctgaagatgagggttcatgtgttatgttggtaggactttcttgaataaaggcgccccatattttattggtgattgtatcttccatggaccgttgagtgatttgtcagaactgtttcctgtattattttgtcgaaactcggtacgctgtttttctaagctttataattattttttggtggtgtccatttgacagctcatttgccaattgattattagtttttgttcgagagtatcagctgatatgatggtggtgttt

SEQ ID NO: 1089 - DNA, 836 bp, Lippia dulcis
ctttttgtcagatccgatctccatagaaatccacaaccgacagaaaaaatgtcgtcaaccttcagcggcgatgaaacggcaccgttcttcggcttccttggcgccgccgctgctcttgttttctcctgtatgggggccgcttatggcacggcgaagagcggcgttggtgtggcttcgatgggtgtgatgagaccggagctggtgatgaaatcgattgtgcccgtcgtcatggctggtgttttgggtatatacgggttgattattgctgtaattatcagtacgggtattaaccccaaggctaagtcttactacttgtttgatgggtatgctcacctttcttctggattggcctgtggtctcgctggtcttgctgccggtatggccatcggaatcgtcggagatgctggtgtgagagcaaatgcccaacaaccaaagctctttgtcggaatgattcttatccttatttttgctgaggctttggctctctatggtctaattgttggaatcatcctttcttctcgtgctggtcagtctagggctgactagaaatagtacatagcacgtgaagattgttcgtttgcagtttcttgcactcaagcaacaatcataattatgtcatcccagttagtgagttagtttggccatggcagtggttttaggttcgagctattgtatgtgtggaaattgagcagttgatgtgtattgcggtagattgtagagaggaagtttggttttccctgaataaagtttctggtactttgtggtgctgtatcttgcgaagaaccagtttgatttctgtaaaacgatgcctgtattattttgtcaaaaaaactctg

SEQ ID NO: 1090 - DNA, 854 bp, Lippia dulcis
gaagaagccacgtgtttattgcttatccaaacacaatcacacactggaaagaaatcggcagatcaaagctccgaagtcagaaccctagcgatagagccttttcccagatttttggattcaggagtgatttcgatctgcaatcatgtcttcgacattcagcggcgatgaaactgctccattcttcggattccttggcgcagctgctgccctcgtcttctcatgtatgggtgcagcctatgggacagcgaagagtggtgtaggtgtggcatcaatgggagttatgaggcccgagctggtaatgaaatcgatcgtgccagtggtcatggctggtgttttgggtatttacggtttgattattgctgtcattatcagcaccggtattaacccgaaagccaagtcctattacctttttgatggctatgcccatctctcttctggtcttgcctgtggcctagctgggcttgctgctggaatggctatcggcattgttggagatgctggtgttagggccaatgcacaacaaccaaagttatttgtgggaatgatccttatcctcattttcgcagaagctttggcgctctacggtcttatcgttggaattatcttgtcctcgcgagcaggccagtctagagccgactaggtaacacaccattaatttaatatgcatttgagagagtatatagtactcctggagttcagagcctggagaaatttaaattgtggcaggtttgagggaaccatgttgtactacgactaattttcgcggttgatggtaccgtttttttgtgtttcttgatgctgtttgtaaacaattattcgttttctgcagaataaaagcttcttggagagctgtt

SEQ ID NO: 1091 - DNA, 913 bp, Plantago ovata
tcaaagtaagatctgaaatccaaatcccagctcaacttcatcttcttctccaactctctccgcaaattcgcttccgatccaaatcaaacaatacaccatgtcttctaccttcagcggcgatgaaactgctcctttcttcggcttcctgggagccgctgctgccctcgtcttctcctgcatgggtgcagcctacggaacggcgaagagtggtgttggagtggcgtcgatgggagtcatgaggcctgagctggtgatgaagtcgattgttccagtggttatggctggtgtgttgggtatctatggtttgattattgctgtgattatcagcactggcattaaccccaaggccaagtcttactaccttttcgatgggtatgctcatctctcttccggtcttgcttgtggattggctggtcttgctgctgggatggctattgggatcgttggagatgccggtgtcagggctaatgcacaacagccaaagctttttgttggcatgatccttatcctcattttcgctgaagcgttggcactttacggtcttatcgtcgggatcattctgtcttcacgagctggccaatctagagctgattaagaaacaaacctctgattgagtttcactgcataaatttatggtatgtcacagaaaaagggcttggagaagtttaaatgtgtgcctgttttgtactgccttaattatttttactacaattatttgtcttcacctgcatattcattctgtggtaacttcgtcccgtttgtaatattagataaccatcttatcacttctgtttctctaaataagaaagcttgcagtgctaggctttgtcggattaatctgttttgtgtattttgagttgtgaacagtgtagtgacctttattatttagcaattatctatgatttatcaatac

SEQ ID NO: 1092 - DNA, 903 bp, Plantago ovata
aagttaagatctgaaatccaaatccccagctcaacttcatcagctccttcaactctctctgcaaattcgcttccgatccaaatcaaacaacaaaccatgtcttctaccttcagcggagatgagactgccccgttcttcggcttcctcggagccgctgctgccctagtcttctcctgcatgggtgcggcttatggaactgcaaagagtggtgtcggagtggcgtccatgggagtcatgaggcctgagctggtgatgaaatccattgtcccagtggttatggctggagttttgggtatttacggtctcatcatagctgtcattatcagtactggcattaaccccaaggccaagtcctactaccttttcgatgggtatgctcatctatcttctggtcttgcttgtggattggccggtcttgctgctggtatggctattgggattgtaggagatgctggtgtcagggctaatgctcaacagccaaagctttttgtcggcatgatccttatcctcatttttgctgaagctttggcactgtacggtcttatcgttggaattattctgtcttcaagagctggccaatctagagctgattaagaaacaaatcctctgatttgagttacattgcataaattcatggcatgtcagagaaaaaagggcttggagaagtttaaatgtgtgcctgtttcatactgccttaattgtttttaccactgcaattatttgtcttcccctgcatattcattctgtggtaccttggtcccgtttgtaatattagattaccatcttatcacttctatttctcctaaataagaagcttgcagtgctagctttgtcggattgttttgtgtattttgagttgtgaacagtgtagagacctttattatttagcaattttctatgatt

SEQ ID NO: 1093 - DNA, 928 bp, Plantago ovata
ttcttccagagttccacatcaatcctagcacgaagaagagagagtagagagagatctaaatacgactcagatcccaattattactaaaatctctcttatcaatactttccacccccgattttcgaccgatcctcacccgaacaacgatgtcgtcaactttcagcggcgatgaaactgctccgttcttcggctttctcggcgctgctgccgccctagtcttctcctgcatgggagcagcttatgggacagcaaagagtggtgtaggagtggcgtctatgggtgtgatgaggccagagctggtcatgaagtctattgttccagtagtcatggctggtgtgttgggtatctacggtttgattattgctgttatcatcagtactggtatcaaccctaaggcaaagtcatactacctttttgatggatatgcacatctttcatccgggcttgcttgtgggctcgctggcttggctgctggtatggctattggaattgtgggagatgctggtgtcagggctaacgcacaacagccaaagcttttcgttggcatgatccttatcctcattttcgctgaagctttggcgctgtatggccttattgttggaatcattctgtcttcacgtgctggccagtcaagagctgactagaaaactgacctttggtctagttgcttctttagaagttgtatatccagtaaaaagagctcggagaaaattgctggactcccaatatttttctttattatgcttgcctattcttactgctcacattcattctgtggtactgcgtggtatttatggttttagattaattattatcttgttagctattttgtttgctgaataagaaggcctttagagctatttttgttggattggattacgccgaagggacctcgaattcttatattaaaaccactggtgtcttttat

SEQ ID NO: 1094 - DNA, 850 bp, Plantago ovata
aatactttccacccccgattttcgaccgatcctcacccgaacaacgatgtcgtcaactttcagcggcgatgaaactgctccgttcttcggctttctcggcgctgctgccgccctagtcttctcctgcatgggagcagcttatgggacagcaaagagtggtgtaggagtggcgtctatgggtgtgatgaggccagagctggtcatgaagtctattgttccagtagtcatggctggtgtgttgggtatctacggtttgattattgctgttatcatcagtactggtatcaaccctaaggcaaagtcatactacctttttgatggatatgcacatctttcatccgggcttgcttgtgggctcgctggcttggctgctggtatggctattggaattgtgggagatgctggtgtcagggctaacgcacaacagccaaagcttttcgttggcatgatccttatcctcattttcgctgaagctttggcgctgtatggccttattgttggaatcattctgtcttcacgtgctggccagtcaagagctgactagaaaactgacctttggtctagttgcttctttagaagttgtatatccagtaaaaagagctcggagaaaattgctggactcccaatatttttctttattatgcttgcctattcttactgctcacattcattctgtggtactgcgtggtatttatggttttagattaattattatcttgttagctattttgtttgctgaataagaaggcctttagagctatttttgttggattggattacgccgaagggacctcgaattcttatattaaaaccactggtgtcttttattgataagttcgtgtacgattca

SEQ ID NO: 1095 - DNA, 1013 bp, Plantago ovata
cgtttagaaaggtattcgtgtcttcttataaatatgaaataattgaaaattacataaatagccacagaagagatctgactcttcgatttctttccatcatccacagaagagagaaacgagatctgaatcgaaatcctaacaaaccagacttcaactccctctcattattctttcaattcaatcaatcatatataacccctctctcttccgatctccaaattcaatcaacagcaaaccgaaacgatgtcgtctaccttcagcggcgatgaaactgctccattcttcggcttcctcggcgctgctgcggcgctcgtcttctcctgcatgggtgccgcttatggaacagctaagagtggtgttggtgtggcttcgatgggtgtgatgagacctgagcttgtgatgaagtctattgtgcccgttgttatggctggtgtgttaggtatttatggtttgatcattgctgttattatcagcactggtattaaccctaaggccaagtcctattaccttttcgatgggtatgctcatctgtcttctggactcgcttgtggactagctggcctggccgctggtatggctattggtatagttggagatgctggtgtcagggctaatgcacaacagcccaagcttttcgtaggaatgatcctcattctgattttcgctgaagctttggcactgtatggtcttattgtcggaattattttgtcttcaagagctggccagtccagagctgactagagatggtaatccatttgagtggagaagttgataagctacctgggactaagagcttgctagaaatttggacgacctgctttgatgactatttttgtacttacaacgctttcgacattagaattgtctctttatcttttatcacctccctcattccccttgctgtatttttatggattttgatagttattttcttcatttgtttttggaataaagatttgtggagctatctttgttggattacttttttcgtagttgaaaacctcgactagtat

SEQ ID NO: 1096 - DNA, 1788 bp, Oryza sativa
aaaccgtgacgtcgctcgcttccagagatcttcagatcagatcagaaatccccaaaaaaaaaaaacacaacaaaaccaaacccgacagatcttctcttcttcctcctccctttcccatcttcgacgaggcgacccggcgcgagagaagaagagatcgatcgatcgatcaaccgatctcgccggagaaggaagaggagcaaagatgtcgtcggtgttcagcggcgatgagacggcgcccttcttcggcttcctcggcgccgcctccgccctcatcttctcatgcatgggtgcggcgtacgggacggcgaagagcggcgtcggcgtggcgtccatgggcgtgatgcgcccggagctcgtgatgaagtccatcgtgcccgtggtcatggctggtgtgctcggtatctacggcctcatcatcgccgtcatcatcagtacagggatcaaccccaaggctaagccgtactacctctttgacggctacgcgcatctgtcgtccgggctcgcctgtggcctcgccggtctcgctgccggaatggccatcggcatcgtcggtgatgctggtgtcagggcaaatgcacagcaaccaaagcttttcgtgggcatgatcctcatcctcattttcgcagaagcgcttgccctgtatggtctcattgtgggcatcatcctctcatcccgtgccggccaatctcgtgcagattaggcactttgcggtaccataccgctgttattccactggctatattcttgagaaaacctgaaacttacttgggagctctagtttaatgtattaaaagatcgatttgtagcttaaggaaggtggcacttccagtcctttttgtttcttttgtggtggttcatgcaaagttttttgggttaggctggatttgctgctcctgagcaaacggatttaatctcattcgtggtgaataaaaaacacggcattgtagcaaaataaaatcattacaatatattatgttcatcccttcactctaatgtattggattgcaaaaatcatcaatgctcctttttgttatgagttcaagtcatcattatatcatccgacttgtgtgataagctcatgtgttcattgagatgagtaggctaattactctcagatgttgctctaagaaaggtgatcttttcctcttgaatggccgttctgtacaatcgcaccaaatttcgtacgctgctagtgctcaaccaatctgtaactattgttgactcaattcattaccctattgcagcatctcttgtaccgaaaatctcagataacctctcaaagagctaagaaaatctcaggtaatttacaagaaacaaggccaataccacagaattccaaatctacctgttccccatttcaggaatgcttcttccaaatgcattgacctacatctgtttcatcgctacccactgatgccattgcaaaaacagtggtttttggatgtttcgaaactaggaaagaaaattttgttattgccacgagacagaactcgtgctgttgatttttcttcagtatcagaaaaacagaatgcagcggcaactttagctgtataacgccgcaaggtcatcctcgtacgccttcttgatggcctccctcttgagcttgagggcagccgtgacgagtcctgactctggggtccatggctccggcaccagcttgactttggctgggatctcaaacttctccagccgcgcttgcttggcagcctgaagaacaaacacacgtcagtacgatccaattgtcataagacttgcatgtcttgcattgatattacttaataagcttgc

SEQ ID NO: 1097 - DNA, 800 bp, Salvia sclarea
agatccaaaatccaaacccctgcagaaattgctcttgatttttcacactaaattcgatctgaatcgaagatgtcgtcgaccttcagcggcgatgaaactgcccccttcttcggctttctcggcgccgccgccgcgctcgtcttctcctgtatgggcgcggcttacggaacagcgaagagtggagttggcgtggcgtcgatgggggtgatgcggccggagctggtaatgaaatcgattgtgccggtggttatggctggtgttttgggtatatatggattgattattgctgtgattatcagcaccgggattaaccctaaggctaagtcttactacctcttcgacggctatgctcatctctcttcgggcttggcttgtggcctcgctggacttgctgctgggatggctattggcattgtgggagatgctggtgtgagggctaatgcgcagcagcctaagctttttgttggaatgatccttattctcatttttgctgaagctttggcgctctatggtcttattgtaggaattatattgtcttcacgagctggccagtcccgggctgactagggcggaagctagtggtttaagtttattattttggagaaatttatggtacttcggcaagtttgagtctgaattactagttatacctccaacattttcatcagtaacgctaacttgtggttgtttgttttgatagtgtggtgtttatttgtagtattagatgaggatttgcttttgttgaataagagccggtagggttatttattaaattacacgatttattgttgcctcgtgcc

SEQ ID NO: 1098 - DNA, 610 bp, Salvia sclarea
ctactagaccttggctgtcactcaaaccctctcctctctccctctccatcaagatcagatctccgcaccgaatcaaacaatgtcgtcgaccttcagcggcgatgaaacggcgcccttcttcggcttcctcggcgccgccgccgccctcgttttctcctgcatgggagcggcgtacggaacggcgaagagcggagttggagtggcgtcgatgggcgtgatgcggccggagctggtgatgaagtcgattgtgccggtggtcatggctggtgtgttgggtatttacggtttgattattgccgtgatcatcagcaccggtattaaccctaaggccaagtcttactacttgtttgacggctacgctcacctttcttctggactcgcctgcggcctcgccggtctcgctgctggtatggccatcgggatcgtcggagatgctggtgtgagagccaatgcacaacaaccaaagctcttcgtagggatgattcttattcttatttttgctgaagccctggctctatatggtctcattgtgggaatcatcctttcttctcgtgctggtcaatctagagccgactagaagagtacattttattcaaagctcgttgcagct

SEQ ID NO: 1099 - DNA, 635 bp, Salvia sclarea
gatcccccgggctgcaggaattcggcacgaggcaaaaaccagagaagatcatctcagatccgatctttgcaggaatccaaaccgatcgaaaatgtcgtctaccttcagcggcgatgaaacggcaccgttcttcggctttctcggcgccgccgccgctctagtcttctcctgtatgggagcggcgtacggcaccgccaagagcggcgtcggagtggcgtcgatgggcgtgatgaggccggagctggtgatgaagtctattgttccggtggtcatggctggtgttttgggtatttacggtttgattattgctgtgattattagcaccggtattaaccctaaggccaagtcttactacttgtttgatggctatgctcacctctcttctggacttgcttgtggtctcgccggcctcgccgccggtatggccatcggaatcgttggtgatgctggtgttagagccaatgcacaacaaccaaagctcttcgtcggcatgattcttatcctcatttttgctgaagccttggctctctatggtctcattgttggcatcatcctctcatctcgtgctggtcagtctagagcggattagatgagtaaatctcggctgatgcgagttgctattctttccttaaatt

SEQ ID NO: 1100 - DNA, 762 bp, Sesamum indicum
ctgaactctgcagagctacagatcgatcaaaaatgtcgtcaaccttcagcggcgatgaaacggcaccctttttcggctttctcggcgccgctgccgccctcgtcttctcctgtatgggagcggcgtacggcacggcgaagagcggcgtcggtgtggcgtcgatgggtgtgatgagaccggagctcgtgatgaagtctattgttcctgtggtcatggctggtgtcttgggtatttatggcttgattattgctgtgattatcagtaccggtattaaccctaaggccaagtcttattacttgtttgacggttatgctcacctttcttctggactcgcttgtggtctcgctggtcttgctgctggtatggctatcggtatcgtcggagatgctggtgttagggccaatgcacaacaaccaaagctctttgttggaatgatccttatccttatctttgctgaagccttggcactttatggcctcattgttggtatcatcctttcatctcgtgctggtcagtctagagctgactagaggagtacgtcaaactcgacgatttatggagtttcttcctgtcaagaaccataattattgttctcctggttagcatggtagcttggccatggcattgtttctaggttcaagctttgatatgtgtgtgggaaatgagtggccagaaaaattgagcggttgatgtgtatggcggtagattgtagatgacaagttcggttttcccttttccctgaataaagtttcttatattttt

SEQ ID NO: 1101 - DNA, 906 bp, Panicum virgatum
ccttcccttcctccccaccccaccccggcgacgcggccgccccgagaccgagcaaccccaccgagagggagaggagcagaggaacagggagagcaagatgtcgtcggcgttcagcggcgatgagacggcccccttcttcggcttcctcggcgccgccgccgccctcatcttctcatgcatgggtgcggcgtacgggacggcgaagagcggcgtcggcgtggcgtccatgggtgtgatgcggccggagctcgtgatgaagtccatcgtgcccgtggtcatggctggtgtgctcggtatctacggcctcatcatcgccgtcatcatcagtaccgggatcaaccccaaggccaagccctactacctcttcgatgggtacgcccatctctcgtccgggcttgcttgtggcctcgctgggcttgccgctggcatggccattggcatcgttggtgatgctggtgtcagggcaaatgcacaacagccaaagctctttgtgggcatgatcctcattctcattttcgcagaagcgcttgctctctatggtctcatcgtcggcatcatcctctcatcccgtgccggccaatcccgcgcggattaggcacttgctgctaccattctataaccactgctgtgtttattacatgctgttttgagagaaacttgaactcgaggttcttgtctagtttattcatgttaccatgtatcaatgaaacatttgtagctgaaggaaggtggcacttccagtcatgttcgatttggtggtgtcaagaggttattttttgggttaaggctggatggatgctcctgggctaagtggatttaattttatccttggtgaataaagaacacggaattgtagccaaataataacgtgataattgatatatatatttcttcgccccattactg

SEQ ID NO: 1102 - DNA, 861 bp, Panicum virgatum
ccgagaccgagcaaccccaccgcgagaggaacaggtagggcaagaagatgtcgtcggcgttcagcggcgatgagacggcccccttcttcggcttcctcggcgccgccgccgccctcatcttctcatgcatgggcgcggcgtacgggacggcgaagagcggcgtcggcgtggcgtccatgggcgtgatgcggccggagctcgtgatgaagtccatcgtgcccgtggtcatggctggtgtgctcggtatctacggcctcatcatcgccgtcatcatcagtaccgggatcaaccccaaggccaagccctactacctcttcgatgggtacgcccacctctcgtccgggcttgcctgtggcctcgcggggcttgctgctggcatggccattggcatcgttggtgatgctggtgtcagggcaaatgcacaacagccgaagctctttgtgggcatgattctcattctcattttcgcagaagcgctagctctctacggtctcattgtgggcatcattctctcatcccgtgccggccaatcccgtgcggattaggcgcttgctgctaccattctataattactgctgtgtttattatatgctcttttgagagaaacttgaactcgaggttcttgtctagtttattcatgttaccatgtatcaatgaaacagttgtagctgaaggaaggtggcacttccagtcatgttcgatttggtggtgtcaagaggttattttttgggttaaggctggatggatgctcctgggctaagtggatttaattttatccatggtgaataaagaacacggaattgtagccaaataataacgtgataattgatatatatatatatttcttcgccccgttactgc

SEQ ID NO: 1103 - DNA, 1026 bp, Panicum virgatum
ggcctccctctcgtcttcttccccaccccaccccacccccgagctcggcggaagcccaaatcccaagcagaggagcaaaatctcgagcgctcgtgccggcgacgaccacgagaaggaggccgcggcacgagagctccccaggccccaggcctctgtttctcttcgcagctccagcggcagcggcagcagaaagcatcagcaagaggaagatgtcgtcggcgttcagcggcgatgagaccgcccccttcttcggcttcctaggcgccgccgccgcgctcatcttctcatgcatgggggcggcgtacgggacagccaagagtggcgtaggcgtggcgtccatgggtgtcatgcgccctgagctcgtcatgaagtccatcgtgcccgtggtcatggctggtgtgctcggtatctacggcctcatcattgctgtcatcatcagtactgggatcaaccccaaggccaagccatactacctcttcgacggctacgcccacctgtcgtctggccttgcctgtggtcttgctgggcttgccgccggcatggccattggcattgtcggtgatgctggtgtcagggccaacgctcagcaacctaagctgttcgtgggcatgatcctcatcctcattttcgccgaagcgcttgccctctatggtctcattgtcggcatcatcctctcatcccgcgccggccagtcccgtgcagactaggcgcgttccagatgtcgataccatgtctggccgtggaagatccattatctgtagagggttaattttcattctgtctagtattctgtttgggtctgaggaaaaaaaaaaacatgtgcatcctagggaggacttccccttgtggtgccggtgccattctttcgctgtctgtggtggtggtggtggtgggctgtggtcgatgcttagtatttatgcacagtttttttggttgggttatggctggacggcgttgtaatctggtgaataagaataagcaaggacatgcaatataatgcgacgagtgtcgaggacaccttttgtt

SEQ ID NO: 1104 - DNA, 934 bp, Utricularia gibba
ggggggcgacgtgtggaaggtttcagctgtccaggaagatctgaggctaatcgagtaggatttgttggattctacgatcggagtgattttaacggaactaataatgtcttcgacgtttagtggtgatgaaactgctccgtttttcggtttcctgggggccgcggctgctctggtcttctcctgtatgggtgcggcctatggcacagcaaaaagtggcgtgggtgtcgcttcaatgggagtcatgaggccggagctggtcatgaaatcaattgttccagtggtcatggctggtgttcttggaatttatggtttaattattgctgtaatcatcagtaccgggattaatccgaaagccaagtcttattacctttttgatggctatgctcatctatcttctggccttgcttgtggtcttgctggccttgcagctggaatggcgattggcatcgttggagatgctggcgtgagggcgaatgcacagcagccgaagctctttgttgggatgattcttattctcatttttgctgaagctctggcgctctatggtcttattgtcggaattattttgtcttcgcgtgctggccagtccagagcggactaggtattattgatccctgatcaagaattccttttagaagctatagtaatcaaggcagggagaaagcatcacacgaaaatcggttccctaccctgtacttctcctcactttgcaagtgatgttatttctgctgaataagagctgccttggtgcttccactgtgaccgctcattgtcatgtttccagttttcttgtgcacacctttgcagtgtttctttccactgtgcatgcgtcatgttatatattttgtggatattcaatattctatcatcgttgttctcccatgtttatgttttcagtatccacattctcctagaaaaaaaaaaaaacacgcgc

SEQ ID NO: 1105 - DNA, 818 bp, Utricularia gibba
tggcgttctctgcagatccgatctcgggggaagctgaaactgtccgataccatcaagaatgtcgtcgaccttcagcggggatgaaacggcgccgttctttggtttcctcggcgccgcagcggcgctcgtcttttcttgtatgggggcggcgtacggcacggcaaagagcggtgtcggagtggcgtccatgggtgtcatgcggcctgagctggtgatgaagtctattgttccggtggtcatggctggtgttttgggtatttatgggctgattatcgctgtgataatcagtactgggattaacccaaaggcgaaatcgtactacttgtttgatggctatgctcatctttcgtctggacttgcgtgtggtctggctggtctcgctgctggtatggcaattggaatcgttggtgatgctggcgttagagcgaatgcacagcagccaaagctgttcgttgggatgatcctcatccttatttttgccgaagcacttgctctctatggactgatcgtgggtattattctctcatctcgtgcgggtcagtcaagagctgattaaaaaaggttcattcagtggattttggttgacatgcaccctcccgttgccgctgttgtgctgcaatgctgtttatctaggttcaagttatacttgtgcctcattggtgcctgagaatctgagtgtgtgtgggtataaattgttgatgatacgtttgatgtgggatgaataagttgtggatgcaaacttcatctgccctaaagcagcggtatactgttttctaaaggctctttgcaactcgaaacaaaaaaaaaaaaaaaacaac

SEQ ID NO: 1106 - DNA, 759 bp, Aquilegia formosa
aaacttgttaaaaataacaaaccagaagaagaagaagaacgaatctccaaatctccaaatctcaaattagggttagggtttctcttcagatctaaaatcaaaatgtcttcaaccttcagcggcgatgaaactgctcctttcttcggtttccttggagccgcagcagctctcgttttctcatgtatgggagcagcatatggaacagcaaagagtggtgttggagttgcatcaatgggtgtaatgagacctgaacttgttatgaaatcaattgtaccagttgttatggctggagttttgggaatttatggattgattatagctgttattataagtactggaattaatcctaaagctaaatcttattatttgtttgatggttatgctcatttgtcttctggtcttgcttgtggtcttgctggtctttctgctggtatggctattggaattgttggtgatgctggtgtaagggccaatgcacagcagccaaagttgtttgtgggcatgattctgatccttattttcgctgaagcccttgctctgtacggtcttatcgtgggtatcattctctcctcccgagctggccagtcacgagcagactaagcagaagctgatgttgtttgggagcctcttttgtcttaatactagcaagtggatttattgttctgtttaatttcttggtttattcttttgtgatgttaagagattgtatatttcggatgttatccaattgaagctaaaacaaatatgcactttctctat

SEQ ID NO: 1107 - DNA, 752 bp, Aquilegia formosa
agaaaatcaaaatgtcttcaacatttagtggtgatgaaactgctcctttctttggtttccttggtgcagcagcagctttagttttctcttgtatgggagcagcatatggaacagcaaagagtggtgtgggtgtagcatcaatgggtgtgatgagacctgaacttgtaatgaagtctattgttccagttgttatggctggagttttgggtatttatggattgattattgctgttattattagtactggaatcaatccaaaggctaagtcgtattaccttttcgatggttatgcacatctttcatctggtcttgcttgtggtcttgccggtctttctgctggtatggccattggaattgttggtgatgctggtgtcagggctaacgctcagcagcctaagctttttgttggtatgattctcatcctcatttttgctgaagctctggccttgtatggccttattgttggtatcatcctttcttcccgagcgggacaatctagagcagactgaggtaaatcctccagtgttgatattctactgtgctttgttggaaacaccgtccattcatttgaggctagaatcggattgtagttcagaacttgcagtcttatcgaaattgtgtattctggacatggtttctctccctcccttattgggtagttgttgtgtacttataaaaatgcacaattagtttctttgaaaataaagctcctagagctgggttttgtttatcattcttgctgtaatttttta

SEQ ID NO: 1108 - DNA, 944 bp, Aquilegia formosa
attttctttctcttcaacatttaacaacgaagggaagaacagaggagagagagagagaaaaactccaaatcagatctcaaacttcttctcttcagatttcaaaatctgtaaatcgaactcgaagcaaaagaaaaatcaaaatgtcttcaacattcagtggagatgaaactgctcctttcttcggtttccttggtgcagcagcagctttagttttctcttgtatgggagcagcatatggaacagcaaagagtggtgttggtgtagcatcaatgggtgtgatgagacctgaacttgtaatgaagtcgatcgttccagttgttatggctggagttttgggtatttatggattgattattgctgttattattagtactggaatcaatccaaaggctaaatcttattaccttttcgatggttatgcacatctttcatctggtcttgcttgtggtcttgctggtctttctgctggtatggccattggaattgttggtgatgctggtgttagggctaatgctcaacagcctaagctttttgtcgggatgattctcatcctcatttttgctgaagctctggccctgtatggccttatcgttggtatcatcctttcctcccgagctggccaatctagagcagactgagggaaacctccattgttgatattctactgtgccttgtggaaatcaccttctattcatttgagactagttgttgtagttcagaacttgcagtgctctctaaattgtttattctggacctggtttctctgcctcccttattgggtatgtgttgtgttaattacaaatatgcatacttagtttcattctgaattctgaaataaagctccttgttctagagctgggttttgtttatcagtattgctgtaattctttatatggctagcacttgtatgacattactaatctcaccaaatcatctttatgttt

SEQ ID NO: 1109 - DNA, 817 bp, Vaccinium corymbosum
aaagcgtgcatccacatcaccttccaaacttctccaatctccgtaccactatcacaccaattctccaattggcaatcgataattcgaacacacgaatcaacaatgtcgtcggaattcagcggcgatgaaactgctcccttcttcggcttcctgggcgccgcagccgcactcgtcttctcctgtatgggagctgcctatgggacggcgaagagcggtgtgggagtggcgtcgatgggcgtaatgaggcctgaattggtgatgaagtcgattgtgccagttgttatggctggtgtgttgggcatttacggcttgattatcgctgtgatcatcagcaccggaattaaccctaaggccaagtcgtattacctcttcgacgggtacgcacacctgtcgtctggtcttgcttgtggtctcgccgggctttcggctggtatggctatcgggatcgttggtgatgctggtgtgagagctaatgcacaacagcctaagctgtttgttggaatgattctcattctcatctttgctgaggcattggcactgtatgggctcatcgtcggcatcattctatcctcccgtgctggccaatccagagcagattagagagaataccatccttgctggatcttttgtgtgttttgttggcatcgcctcactcaggttagtgatgctagtttggaatgtgatttgtttcttgtttactattatgttgcccttactttcttcatcacttggaaattttacggattgtaatatggcgagcattttcctccctgaaataaatctgtgcaaagctagattcttccatttgcatacttta

SEQ ID NO: 1110 - DNA, 875 bp, Vaccinium corymbosum
cacaaagaaccaaatcaaatcgaagcttttatcctaaaaattccaaacctcaaacagctttcggattttgcattagcaccatttcatcccagatccgagtaaccaatcatgtcttcaggtttcagcggcgacgaaacggcaccgttcttcggcttcctcggagccgctgcagccctcgttttctcctgcatgggagctgcttatggaactgcaaagagtggagttggtgttgcctcaatgggagttatgagaccagagcttgtcatgaaatcaattgttccagtggttatggctggagttttggggatttacggattgattatagcggttattattagcacagggataaacccaaaggcgaaatcttattacttgtttgatgggtatgcacatttgtcctcgggtcttgcttgtgggctggctggtctctctgctggaatggccattggaattgttggtgatgcgggagtcagggctaatgctcagcagccaaagctatttgttggtatgatcctcatcctcattttcgctgaagcccttgctctctatggtctcattgttgggatcattctttcatcccgagcaggccaatctcgcgcagattgaaaaggccaaggaggctttgatcttctcgactcttcaaattgtaagctaacgttggtgtcattggctgttatgctgatcctgcattattctatattttatcggatttctattctctaagtatctggattctggaatttgtgatggatattctcctgatgtttatgattcttttaagaatgcttcaatgaatgacgcacttgtgaagatttttgtctcactgattaaacgcttcaacgaatggcattaactttgctatttgtgtaccaaac

SEQ ID NO: 1111 - DNA, 851 bp, Vaccinium corymbosum
tcactgtaaaacgtgcgatcgacatcaccttccaaacttctccaatctctgtaccactatcacaccaattctccaattggcaatcgataattcgaacacacgaatcaacaatgtcttcagaattcagcggcgatgaaactgctcccttcttcggcttcctgggcgccgcagccgcactcgtcttctcctgtatgggagctgcctatgggacggcgaagagcggtgtgggagtggcgtcgatgggcgtaatgaggcctgaattggtgatgaagtcgattgtgccagttgttatggctggtgtgttggggatttacggcttgattatcgctgtgatcatcagcactggaattaaccctaaggccaagtcgtattacctcttcgacgggtacgcacacctgtcgtctggtcttgcttgtggtctcgccgggctttcggctggtatggctattgggatcgttggtgatgctggtgtgagagctaatgcacaacagcctaagctgtttgttggaatgattctcattctcatctttgctgaggcattggcactgtatgggctcatcgtcggcatcattctgtcctcccgtgctggccaatccagagcagattagagagaataccatccttgctggatcttttgtgtgttttgttggcatcgcctcactcaggttagtgatgctagtttggaatctgatttgtttcttgtttgctattatgttgcccttaatttcttcatcacttggaaattttacggattgtaatatggtgagcattttcctccctgaaataaatctgtacaaagctagattcttccatttgcatactttaccggtagtttatgcaagtctcaagta

SEQ ID NO: 1112 - DNA, 989 bp, Lactuca sativa
cacactccgaggcataacccgtccacgactaaacagggccatacaattcaactaacatatataacgtcatctcccctttcgctctttctctccctctctcgatcctcagatccgatcaatttctctgcaaaatataaaccctaaacttgatcgtaatcaaccgatcatgtcttcaacattctccggcgatgaaacggctccgttcttcggctttctcggtgccgcggccgcgttagtcttctcctgtatgggggcggcgtacgggacggcgaagagcggtgttggagtggcgtctatgggagtgatgaggccagagctcgtgatgaagtctattgtgccagttgttatggctggagtgttgggtatttacggtttgattatcgctgtgattatcagtactggaattaaccctaaggctaaatcctattaccttttcgatgggtatgctcatctttcctccggtcttgcttgtggccttgctggtctttctgctggtatggctatcggaatcgtcggtgatgctggtgttagagccaatgcacaacaaccaaaactatttgttgggatgatcctgatcctcatttttgctgaagctcttgctctgtatggtctcattgttggcatcattctttcttctcgtgctggtcaatccagagcagattagaaggtattcattcagtggcataatcgtgtgttctacagctataacttatgtgtttttttgatctttcattttgaggagagttgaagctgtagttatgtcgttttttcataatttgtgggtggtaaatggtgatgatatgtgtgttgagggggtagggtgtagggtagattgtgggttttcactataataaagatgtctcatactctcattactcgtattatttatttatttgcaaacaacatgttgggatatgtatgctttcgttgtatttgatttgcttgattttgaaaaagatattcataatgttttggtatggtattatttc

SEQ ID NO: 1113 - DNA, 925 bp, Lactuca sativa
ccgtacaacgtgtataaataccatcatctcttcttctatgtggagtttggatatctagaaaaacaaaatcctcagatccgatcaatttttctgcagatctacactccaaattcaatcatcatgtcttcaacattctccggcgatgaaacggctccgttcttcggcttcctcggtgccgcggcagccctggtcttctcctgcatgggggcggcatacgggacagcgaaaagcggcgttggtgtggcgtcgatgggagtgatgaggccggagttggtgatgaagtcgattgtgccggtggttatggctggagtgttaggtatttacgggttgattattgctgtgattatcagtaccgggattaacccaaaggccaaatcttattatctctttgatggatacgctcatctttcctctggtcttgcttgtggccttgctggtctttctgctggtatggctatcggaattgttggtgatgctggtgttagggcaaatgcacaacaaccaaaactctttgttgggatgattttgattttgatttttgctgaagctttggctttgtatggtcttattgttggcatcatcctttcttctagagctggccaatcaagagcagactagaaggatatacagaggtggtgtgtctgtgtttccattattattaattaattaaaagcaagcatatgattattatccactttgtaattgttggttttgctacaaacaaaactaattctttggtgcctgtcgtaggttttagaccaaattctagctctcttgttataataagattcgtctctttttcgtatattatttttcgattttggacatgaaatagataattttggagatttatcccacatttgtaatttgttggtaactctttttttatcatatggtctaaattttggttttgttgcacttattg

SEQ ID NO: 1114 - DNA, 916 bp, Lactuca sativa
gaacaaaataccaatcggcaatttggcatcaaacgtgaggctacaagattgtacgcgtgctatatttatctgctcaatcaatattcatactccggcgaccagttcaccggaaaacgaaatccattgcgatctctcccgcagatcaaaagctgtaattcatgtcgtctactttcagcggcgatgaaactgctccgttcttcggcttcctcggagccgcagcagccctcgttttctcctgtatgggagcggcgtatgggacggcgaagagcggcgttggtgttgcctcgatgggagtgatgaggccggagctggtaatgaagtcgattgtgccggttgttatggcaggagtgttaggtatttacggattgatcattgctgttattattagtaccggaatcaatccaaaggcaaaatcgtattacttgtttgatggttacgctcatctgtcatctggtcttgcttgtggtcttgccggactttccgccggaatggccattggaatcgtcggcgatgctggtgttagggcaaatgcacagcagccaaagctttttgttggaatgattttgattcttatctttgctgaagcacttgcattatatggtctcattgttggcatcattctctcttcgcgtgctggtcagtccagggccgattaagtctttttacactttcttatccttccattatcaggttagtttcaccagtgttcagaaggattcaaaatcatgcttttatctttgtgttgttaaattgtttgttagttattaaactggatgacacttttgcccttgaataaagccttaaagctaccattgtttgttttcttattttgtatcataaatacatgaaggtgaaacggtgtatgattatttattatgctcattgttaggtgttgtttcatttttacttaatgggc

SEQ ID NO: 1115 - DNA, 828 bp, Olea europaea
caaaagaaaaaatcttcagatctgatctctgcatatccaaacatatccaaacaagaaaagatgtcatcgatattcagcggcgatgaaacggcaccgttcttcggcttccttggcgccgcggctgccctagttttctcctgtatgggtgcggcatatggcacggcgaagagtggcgtcggtgtggcgtctatgggcgtgatgcgaccggagttggtgatgaagtcgatagttccagttgttatggctggtgtcttgggtatttatggattgattattgctgtcatcatcagtactggaatcaaccctaaggccaagtcatactacttgtttgatggctatgctcacctttcttctggcctcgcttgtggccttgctggcctttctgctggtatggccattggaattgttggggatgctggtgttagagccaatgcacaacagccaaagctttttgttggaatgattcttattctcatttttgctgaagcactggctctttatggccttattgttggcatcatcctctcttctcgtgctggtcagtctagggcagattagaagacggcattcggctttgcagctgcagtttgttactatctctattgtgttcccagtatgaattattagttcggtcagcaatgtttttaggctcaatctttatctttatgtggctattgcttggcctgaagaagaggagggttgatttctgctgatggtagatagtagttcaggacttcggttttccctaaataaagttctctattaatttatattttctttatgttgcaagacgatgtttgatttgtgtaaaaccatttgtttgtatta

SEQ ID NO: 1116 - DNA, 703 bp, Olea europaea
gagtacgtcgggtaacgatatcgtgacttcaatcaaaacaactcgttctgtactgagttacccgcattcaccgatccgatccttatctgcagatccaaatcagaatccgaaacaatgtcatcgacttttagcggcgatgagacggcaccgttcttcggctttctcggcgctgctgccgctctagtcttctcttgtatgggagcggcgtacggtacggcgaagagcggcgttggggtggcgtccatgggtgtgatgcgaccggagctggtgatgaagtcgattgtgccagtggttatggctggagtgttgggtatttatggattaattattgctgtgattattagtactggaattaaccccaaggctaagtcttattacttgttcgatggatatgctcacctttcttccggtctcgcttgtggcctcgctggcctttctgctggtatggccatcggtatcgtcggtgatgccggtgttagagccaatgcacaacagccaaagctctttgttgggatgattcttattcttatcttcgctgaagcacttgctctttatggcctcatcgttggcatcatcctctcttctcgagctggtcagtcaagagcagactagaagacatcatttggcttgagaactacggtttgttactatcaattgcacactaaattatgttctctccaattccaaacggtagttcgggtgt

SEQ ID NO: 1117 - DNA, 866 bp, Ambrosia trifida
atatctaataaacataaccctcatcagatccaatcaagtttcgagcagatctacaatcaatcaatcatcatgtcttcaacattctccggcgatgaaacggcaccgttttttggctttctcggtgccgctgctgcccttgttttctcctgcatgggggcggcgtatgggacggccaagagtggtgttggagtggcgtcaatgggagtgatgaggccggaattggtgatgaagtcgattgtgccggtggttatggctggagtgttaggtatttacgggttgattatagcagttattatcagtaccgggattaaccccaaggccaaatcttattatctctttgatggatatgctcatctttcttctggtcttgcttgtggccttgctggtctttctgctggtatggctattggaattgttggtgatgctggtgttagagccaatgcacagcaaccaaagctatttgttgggatgatcttgattctcatttttgctgaagctctggctctctatggtctaattgtcggcatcatcctttcttctcgtgccggtcagtcccgagctgactagaagggcagcagccttggtggactttcctgtctctgtggttttggttgtgttagttgagctgcagacatgatcaattctttggtggtaatgataccttgggctatggctctgctcatccagtaggttttagaccaaactctagctctaccttataataaaatttatctgttttgtgttatatactggataaatatttgcacaattgtcccacatttgttggtaactatttattttatggccaagaatactgttttatcacatccatttgaagcaaacccaacaaggtgacttggcttttt

SEQ ID NO: 1118 - DNA, 885 bp, Ambrosia trifida
ttattattagtttagatatctaataaacataaccctcagatccaatcaagtttcgagcagatctacaatcaatcaatcatccatcatgtcttcaacattctccggcgatgaaacggcaccgttttttggctttctcggtgccgctgctgcccttgttttctcctgcatgggggcggcgtatgggacagccaagagtggtgttggagtggcgtcaatgggagtgatgaggccggaattggtgatgaagtcgattgtgccagtggttatggctggagtgttaggtatttacgggttgattatagcggttattatcagtactgggattaaccccaaggcgaaatcttattatctctttgatggatatgctcatctttcttctggtcttgcttgtggccttgctggtctttctgctggtatggctattggaattgttggtgatgctggtgttagagccaatgcacaacaaccgaaactatttgttgggatgatcctgatcctcatttttgctgaagctctggctctctatggtctaatcgttggcattatcctttcttctcgggccggtcagtcccgagctgactagaaagggcggcggccttggtggacaaccctgtctctgtggttttggtggtgttagttgagctgcagacatgatcaattctttggtggtaatgataccttgggctatggctctgctcctctagtaggttttataccaaactctagctctaccttataataaaatttatctgttttgtgttatatactggataaatatttgcacaattttcccacatttgttggtaactatttattttatggtcaagaatactattttatcatatccatttgtagcaaatccaacaaggtgacgtggcttttttt

SEQ ID NO: 1119 - DNA, 1108 bp, Amorphophallus konjac
atttttcaccattccccgttgcacgtctcttcttctccatcaccgcgtgctgtgtgtttacgggagatccagggagcggcagaagcccagaagctagggtttcccccagatccagagtcaccggcaagatgtcctccttcagcggcgacgagacagctccattcttcggcttcctcggcgccgccgcggccctcgtcttctcctgcatgggggcggcttacgggacggcgaagagtggggtcggggtcgcctcgatgggggtgatgcggccggagctggtgatgaagtccatcgtgcccgtcgtcatggcgggagtgctcgggatctacggcttgatcatagccgtcattatcagcacggggataaaccccaaggcgaagtcgtactacttgttcgatgggtatgctcatctctcgtctgggcttgcctgtggcctcgcggggctctccgcggggatggcgatcggaattgtcggtgacgctggagtcagggccaatgctcagcagccaaagctgttcgtaggtatgatcctcatcctcatttttgctgaagcacttgccctctatggtcttatcgtcggcatcatcctctcttctcgtgccggtcagtctagagcagactaggagcatagagcaccagctgttgtcatttccagcatcttcttcagttcttgttatattgggcgttagaacatgggtaaaaaaattatgttttattctctcaattcagtttgtaatgaaaattcagtcaaccacttgatgtatgcatgctcttttccctgcatctcttaaaatgatctgataagaaaaaaaaagattataaatatcacaacagcaactgaaaaacacatgccaattgtgcagctaggtactccctatatacaagcaaatcttgatcactaacaaagtacagaggcagcaacaacaaaagacaaaaataacactgtagcagcatatgctcctgctgtacacattttttgttgaatggtaacattacaacaccatgctacagatgcaaaccccgattgtgaacctgttgtaccaaaattcttgagcaaaagattccaatgaatgcccatttaaactgagtcaatctgtcaacaatgtgc

SEQ ID NO: 1120 - DNA, 947 bp, Antirrhinum majus
tctctcttcaacctacctcagatccgatcaactgaaccagatcaaaatcaacaacaataatgtcgtcaaccttctccggcgatgaaactgcaccgttcttcggcttcctcggtgccgccgccgcactcgtcttctcctgtatgggagcggcgtacggaacggcgaagagcggcgtcggagtggcgtcgatgggcgtgatgaggcctgagctggtgatgaagtcgattgtgccggttgttatggctggtgtgttgggtatttacggattgattatcgctgtgatcattagtaccggtattaaccctaaggcgaagtcgtattacttgtttgatggatacgctcacctttcgtctggattggcttgtggtcttgctggattagctgctggtatggctattggaatcgttggtgatgccggtgttagagccaatgcacaacagccaaagctctttgttgggatgattcttatccttatttttgctgaagccttggctctctatggtcttattgttggcattatcctctcttctcgcgctggtcagtctagagcagaatagaggagcgggtgctcgcttgacacgattactactgtttttggtatcaaataagaaccactactacattctccttggttagcatggtactttcaccatgacagtttatatttaggtttgagctttatatgtgcgattgcgcaggagaatcgagctgttaatgtgttatgttagactgtagatggatggtttgattttttttctgaataaggttctctcatatttttatggtttctgtaacttgttgaggaccagattatcgatttgtgtaagaccattgtttgtattattattttcttgaaacttgctcttatgttatcagctatcgtacactttgtgatatggtaattttgtgatggtatatgcagatttgtgaagtgtaagaaaaagcgg

SEQ ID NO: 1121 - DNA, 692 bp, Antirrhinum majus
  misc_feature (49)..(50): n is a, c, g, or t
  misc_feature (55)..(55): n is a, c, g, or t
  misc_feature (59)..(59): n is a, c, g, or t
aacccaaacaaagagatcgatttcggcacgagcacacacacacacacgnngaganaganagggagagagagagagagaaagagatccaaaaatgtcttcaaccttcagtggcgatgaaactgctccgttcttcggcttcctcggcgccgccgccgccctcgtcttctcctgcatgggagcggcatacggaaccgctaagagtggcgtcggagtggcgtcaatgggtgtgatgaggccagagctcgtgatgaagtcgatcgtgccggttgttatggccggtgttttgggtatttacggtttgattatcgctgtgattatcagtaccggtattaaccctaaggcgaaatcgtattacttatttgatggatatgcgcatctgtcgtctggtctggcttgtggacttgctggtctcgctgctggtatggcgattgggattgtgggagatgctggtgtgagggctaatgcacagcagcctaagctttttgttggcatgatccttattctcattttcgctgaagctttggcgctttacggtcttattgttggaattattttgtcttcaagggctggccagtctagagctgagtagaagacaaatcttttactgtatttcactacagaaatctgagttcgctcaggtttgagtgcatattttgtacttccataattcttcacctttttaattatttata

SEQ ID NO: 1122 - DNA, 853 bp, Arnica chamissonis
gaaaacgtaatcctcagatagtcagatccgatcaaattttctgcagatctacgatcatcatgtcttcaacattctccggcgatgagacggctccgttcttcggctttctcggtgccgcggcagccctagttttctcctgcatgggggcggcatatgggacggcgaagagcggtgttggagtggcgtcaatgggagtgatgaggccggaattggtgatgaagtcgattgtgccggtggttatggctggagtgttaggtatttacgggttgattattgcggtgattatcagtactggaattaaccccaaggccaaatcttattatctctttgatggatacgctcatctttcttctggtcttgcttgtggccttgctggtctttctgctggcatggctattggaattgttggtgatgctggtgttagagccaatgcacaacagccaaaactatttgttgggatgatcctgattctcatttttgctgaagctctggctctctatggtctgattgtcggcatcatcctttcttctcgtgctggtcagtcccgagctgactagaagggcggcggccttggtggattattctctctgtggttgtggtggtgttggttgagctgcagacatgatcaattctttgatggtgatgatacattggcctttggctatgatcttctagacctaactctagctctcctctataataaattcacctctttttttgttatacactggttaaattttgcacatttgttggtaactatttattttatggtcaagaattcagttttacccatatgtattttatattcttccggctttgaatgtcaaattaatcttgatttaaatttccaaaa

SEQ ID NO: 1123 - DNA, 840 bp, Arnica chamissonis
atacaactcaactttacatatacaagtcaccctcactctcgatagatcctcatatccgatcaaccgatcatgtcttcaacgttctccggcgatgaaacggcaccgttctttggctttctcggcgccgctgccgcactagtcttctcctgtatgggggcggcgtatgggacggcgaagagcggcgtcggagtggcgtcaatgggagtgatgcggccagagttggtgatgaaatctattgtgccggttgttatggctggagtgttggggatttacggtttgattattgctgtgattatcagtaccggaattaaccctaaggctaaatcgtattacctttttgatggatacgctcatctttcttccggtcttgcttgtggtctcgctgggctttctgctggtatggctattggaatcgttggtgatgcaggtgttagagccaatgcacaacaaccaaaactttttgtggggatgatcctaattctcatttttgccgaagctcttgctctgtatggtcttattgtcggcatcattctttcttctcgagctggtcagtccagagcagactagaagtttggcattcggctcggtaatcttgtgttttacagctataaaaattaagcatttgggtggagttgaagctgagggtgggtgtgttggtttttaccataatgtgatggtaagggtaggcgagattctagtgtttctgatataataaggttgtctggtattatttgttgcaatatttgtttattttacttgcaaagtatctctttcgacatgtttatccttgtatcaaaatgttcttttctttattatgttaaattttcaactttccttttc

SEQ ID NO: 1124 - DNA, 857 bp, Arnica chamissonis
gttgcaggaacacaactgataaggtgttgaatgcgtagattggattgatatctgaattataaactctcgcatccaatcaatttatcctcagatcgaaaccctaaatcaaccgatcatgtcttcaacgttttccggcgacgaaactgctccgtttttcggtttccttggcgccgctgctgccctagtcttctcttgtatgggggcggcttatgggacggcgaagagtggtgttggagtggcttcgatgggagtgatgaggcctgagttggtgatgaagtcgattgtgccggtggttatggctggagttttgggtatttatggtctgattattgctgtgattattagtacagggattaaccctaaggctaagtcttattatttgtttgatggatatgctcatctttcttctggtcttgcttgtggtttggctggtctttctgctggtatggctatcggaatcgttggtgatgctggtgttagggctaacgcacaacaaccaaaactttttgttggaatgatcctgattctcatttttgctgaagctctggccctctacggtcttattgttggcatcattctttcttctcgagccggccaatccagagcagattagaagaattgcttgtgggtcccatgagtgtcctaaatcgatcgatatacttctcctcaggttagagttatggttacgtttctttggtgcaggttgtagcctagattccagtaccccttttaataaagtcctttttattatgctaatttttgccaaaagaaaaaagtcttgggacatgttaatatgtggaaatcatgggttgtgatctatttgtattgtaaaactttataataacattttttccaag

SEQ ID NO: 1125 - DNA, 916 bp, Artemisia annua
aaaaaaaatcagatccgatcataataaaaaccgcttccagatctaaatcatcatcatgtcttcaactttttccggcgatgaaacggcaccgttcttcggcttccttggtgccgctgctgctctagtcttctcctgtatgggagcggcatatggtacagcaaagagtggtgtaggagtggcgtcgatgggagtgatgaggccagaattggtgatgaagtcgattgtgccagtggttatggctggagtgttgggtatttacggtttgattattgcggttatcatcagtactggaattaatcctaaggcgaaatcatactatctgtttgatggatatgctcatttgtcatctggtcttgcttgtggtcttgctggtctttctgctggtatggctattggaattgtcggtgatgctggtgttagagccaatgcacagcaaccaaaactgtttgtcgggatgatcctcattctcattttcgctgaagctcttgctctttatggacttattgttggcatcatcctttcttctcgtgctggtcagtccagagcagactaaattgtcaaccttctaacctgaggtggtgtgtcttgctctgctattagttaagcatttggtattattatcctctctgtggttattgttgtttgttaagctgcggacatgatcaattctttggtggtgatgatatctttggtttggatggatggcctgtggctgtgcaccaacagtaggttctagaccaatttctagctttcagctaaataaaatctcttttttacgtatatttattgttatatttttggtaagtgaagttcccctttggacatgttgtatactggataattatgcagatttgtcctacaaatgctggtaactgtaatattcatggtcaataaattcagctttataaaaaaaaaa

SEQ ID NO: 1126 - DNA, 1004 bp, Artemisia annua
caacgcagtactccaacgggggccccctcgtgatccaaaaagacgtacacacacacacagagagagatccaaccatcatcatcatcaatctccgatcaaaataatgtcatcaacattcagcggtgatgaaacggcaccgtttttcggcttccttggtgccgctgctgcccttgttttctcatgtatgggagcggcatatggaacagcaaagagtggtgtaggtgtggcttctatgggtgttatgaggcctgagcttgtgatgaagtcgattgtgcctgtggttatggctggtgtgcttggtatctacggtttgattattgctgttatcatcagtactggaattaaccccaaggccaaatcttactatttgtttgatggatacgcacatctttcgtctggtttggcttgtggtcttgctggtttatctgcaggaatggcgattgggattgttggtgatgctggtgttagagccaacgcacaacagccaaagctttttgtgggtatgattcttattctcatctttgctgaagctctagccctatacggtctcattgttggtatcatcttatcttcccgtgccggtcagtccagagcagattaagaaggtgatcagaagatgaacatggagttctttcaatatttgtttgttgtctatcctgataaatcacaatcatgtttttgctttatttctaccacttttggttttccagcttttaagcaacagttattgagttactttaaattttcttggtgttctttgtgttgtcattattatttgtgtttataatgttactccaaaataagatcgttgtcttggtcaagacttgtgttaatatgtgtacttgttgtcattattgtcatgtttgaatagttaatgttggatagccttttgtattagatgttggcgcactgataagagctgaagtattgtttgacgacactgtttttgtttcacaatttaaaggaaatacaaacaggcaacctttttgtgaaagagtgcgtct

SEQ ID NO: 1127 - DNA, 960 bp, Artemisia annua
atagatatatagttatatacggatatacccgaacacatacacacacgatcaaaacacagccatacaaattaattcaactcaccacatacatacaaacaacgtcatcaccctgtagatcgtgagatccaatcaattaatcaaaaatgtcttcaactttctccggtgatgaaactgctcccttctttggctttctcggcgctgctgctgcccttgtcttctcctgtatgggcgccgcgtatgggacggcaaagagtggtgttggagtggcgtccatgggagtgatgagaccagagttggtgatgaagtctattgtaccagttgttatggctggagtgttgggtatttacggtttgattattgctgtcattatcagtactggaattaaccctaaggctaaatcttactacctttttgatggatatgctcatttgtcttcgggtcttgcttgtggtcttgctggtctttcggctggtatggctattggaatcgttggtgatgctggtgttagagccaatgcacaacaaccaaagctttttgttggaatgatcctcattctcattttcgctgaagcacttgctctatatggtcttattgtgggcatcatcctttcttctcgagctggtcagtccagagcagactagaaggttggtactcagtcgtatactcgtgtgttttacagctacaactttcacatttttggaatcacattgggtagagttgaagctttgggtgtgtcttttttcataaattgtgtgtggtaaatggtgatgatatgttggatgtgttgagggtagctatagactagtttttagtttttgccggtataataaagatgtccatgttattcgtattaattattgctacatatgttattgttgctaagatcctatttggacatgtttgtctgtatcactttgcctcagttgagtgagagttatttataatgatgtgccattttcc

SEQ ID NO: 1128 - DNA, 904 bp, Artemisia annua
acaattaattcaactcaccacacatacatacaaacaacgtcatcactgtagatcgtgagatccaatcaaacaattaatcaaaaatgtcctcaactttctccggtgatgaaactgctcccttctttggctttctcggcgctgctgctgcccttgtcttctcctgtatgggggcagcgtatggaaccgcaaagagtggtgttggagtggcatccatgggagtgatgagaccagagttggtgatgaagtctattgtgccagttgttatggccggagtgttgggtatttacggtttgattattgctgtcattatcagtactggaattaaccctaaggctaaatcttattacctttttgatggatatgctcatttgtcttcgggtcttgcttgtggtcttgctggtctttcggctggtatggctattggaattgttggtgatgcgggtgttagagccaatgcacaacaaccaaagctttttgttggaatgatcctcattctcattttcgctgaagcacttgctctatatggtcttattgtgggcatcatcctttcttctcgagctggtcaatccagagcagactagaaggttggcactcggacctatactcgtgtgttttacagctacaactttcgcatttttggaatcactttgggtagagttgaagctttgagtgtgttgttttttcataaattgtggaatggtaaatggtgatgatatgctgggtgtgttaagggtagttttagactagtttttagttttttctggtataataaagctgtccatgttactcgtattaattattgctacatatgttattgttgcaaagaccctatttggacatgttattgtttgtatcactttggctcagttgagtatgagttatttataatgaagtgccattttcc

SEQ ID NO: 1129 - DNA, 985 bp, Centaurea maculosa
  misc_feature (66)..(66): n is a, c, g, or t
  misc_feature (103)..(103): n is a, c, g, or t
  misc_feature (137)..(137): n is a, c, g, or t
  misc_feature (140)..(140): n is a, c, g, or t
  misc_feature (158)..(158): n is a, c, g, or t
  misc_feature (161)..(161): n is a, c, g, or t
  misc_feature (167)..(167): n is a, c, g, or t
  misc_feature (173)..(173): n is a, c, g, or t
  misc_feature (233)..(233): n is a, c, g, or t
  misc_feature (797)..(797): n is a, c, g, or t
  misc_feature (802)..(802): n is a, c, g, or t
  misc_feature (808)..(808): n is a, c, g, or t
  misc_feature (817)..(817): n is a, c, g, or t
  misc_feature (826)..(826): n is a, c, g, or t
  misc_feature (828)..(829): n is a, c, g, or t
  misc_feature (834)..(834): n is a, c, g, or t
atcctctgcacttcgtattttcattcatattcccttctccggcgaccaattttccggccatccaantctctttttccgatctccggcaaatacaatcggaatnaatgtcgtctactttcagcggcgatgaaaccgcnccnttcttcggcttcctcggngcngcagcngccctngttttctcctgtatgggcgctgcgtatgggacggcgaagagcggcgttggtgttgcatcnatgggagtgatgaggccggagctggtgatgaagtcgatcgtgccggttgttatggcgggagtgttaggtatttacggattgattattgctgttattattagtaccggaatcaatccaaaggccaaatcctattatctgtttgatggctatgcgcatctctcctctggtcttgcttgtggtcttgctggactttccgccggaatggccatcggaatcgttggcgatgctggtgttagggcaaatgcacagcagccaaagctttttgttggaatgattcttattctaatctttgctgaagcacttgcgttatacggactgattgttggcatcatcctgtcctcccgtgctggccaatccagggctgattaagttgtacaatttctcatccatccatccaattatatcatcttatgaggttagtttcacaagttgagaagatccagattcatcttatcaagatcttgctcctatcttccttcctgttatcaaattgtttgttagttattaaactggaagcaacttttgccctcaaataaagacttaaactagcattgtttatttacntattntgtatnatatatacntatcatgancnncatcnctatacgtacatgtttactctataccctacgttgtgtgggatatatatagggttcgttgggtttgtattatgcatacatattatgtgtacatcctacccgcagatccttccttgtgtgagatatatatagcgtgttcatttggtttgattg

SEQ ID NO: 1130 - DNA, 972 bp, Centaurea maculosa
  misc_feature (478)..(478): n is a, c, g, or t
  misc_feature (487)..(487): n is a, c, g, or t
cgcgggggattagcagtcgttgtgttgtggagtttggatagagaagagatagctgaataacaaatcctcacatccattcaaatttcttctctttcattcagatctaaaaaaccctaaatcaatcaacaccgatcgatcgatcatgtcttctaccttctccggcgatgaaacggctcccttcttcggctttctcggcgctgctgccgccctagtcttctcctgtatgggggcggcctatgggacggcgaagagtggtgttggagtggcttcaatgggagtgatgaggcctgagctggtgatgaagtcgattgtgccggtggttatggctggagttttaggtatttacggcctgattattgctgtgattattagtactgggattaaccctaaggctaagtcgtattatctctttgatggatacgctcatctttcttctggtcttgcttgtggccttgctggtctttctgctggtatggcnattggaatngttggtgatgctggtgtaagggctaatgcacaacaacccaaactctttgtcgggatgatcctcatcctcattttcgctgaagctctggctctttacggtcttattgtcggcatcatcctttcttctcgagctggtcaatccagagcagactagaacggaatgcatcggctttaaatcgagcgttattcttattcttcttattctgtggtggttagagttgcggttttttttccaaaattcttgggcggtgagaggcgggacccgctgatttctgtgtgccgagacaagattctatttgtttcttttgaataaattcgtcgtcataaatatctgccgttaagttttcattggacatgttattatttgtctatttttgtttggtcccctgcagatattaaggtctcgaaatcatgaactgttatttattttgtatcttacaactcatcatcaataacatgcttttggagcagttggaactttatttt

SEQ ID NO: 1131 - DNA, 961 bp, Chelidonium majus
gagaaaaagagatccaaaatctctcagcgtagaaaaaaaaacaaaaacactcagatccgatcgaattctccaaactcgaaaatgtcttcgacgttcagcggcgatgaaactgctccgttcttcggatttcttggtgccgcagctgccttagttttctcctgtatgggagcagcttatggaacggcaaagagcggtgttggtgtggcgtcaatgggtgtaatgaggcctgaattggtcatgaaatcgattgttccagttgttatggctggagtgttgggtatttatggattgattattgctgttatcatcagtactgggattaacccaaaggccaaatcttactacctttttgatggttatgcacatctctcatctggtcttgcttgtggtctcgctggtctttccgctggaatggcaatcgggatcgttggtgatgccggtgttagagccaatgctcaacagccaaagctcttcgtcggtatgatccttatcctcattttcgcagaagcgcttgccctgtacggactcattgttggtatcatcctgtcttcaagagctggccaatccagagctgactagaaagagggccatcctggtgttttcttgtgtggtttatcagtaccaatttttacctttaattcatctcaggcttgtaatggttcagccgtcagtgctccgaaaaattcttcactctgaacgcaattactccaccaccctcgtcgggtgatggttgtagaattaggaacaattgtctccaaaaataaaaagcttttgaagctctttctgttcattgattaattgctgtatgttgcagatataaactctagctggtctagtaaatgtggatttggaaccctcgtgtttgtacgaattatatttattactcagttctatgttggtttgccttttcttattctttatattattagaatgtaatacggagtattcaatcttgacctca

SEQ ID NO: 1132 - DNA, 1007 bp, Chelidonium majus
agttagagagagacgagagacggagagaggaatcgaaatctaaaaatctcaaatttctcagatccgatcgaagtctctgtaaatttcaagctcgaaaatgtcttctacattcagtggtgatgaaactgcccctttctttgggttccttggtgctgcagcagccctagttttctcatgtatgggagctgcttatggaactgctaagagtggtgttggtgtggcatcaatgggtgttatgaggccagaacttgtgatgaaatcaattgttccagttgttatggctggagtgttgggtatttatggattgattattgctgttattatcagtactggaattaaccctaaggctaaatcgtattaccttttcgatggttacgctcatctttcatctggtctagcttgtggtcttgctggtctttctgctggaatggccatcgggatcgttggtgatgctggtgttagagccaatgctcagcagccaaagctcttcgtcggaatgatccttatcctcattttcgctgaagccctggccctgtatggtctcattgttggtatcatcctctcttcacgagctggccaatccagagcagattaagaatgtgggatactgggatctcatgcctgggttatcttgtgttattatggctattctttaacgttggatttgtttcaggttagcaagggtagttcagcacttgcaatgacattaaatatatacctattctggatgtgatttctccaccatcctcattgggtagttggtctgtgctgcttgtagaattagaaacgagtttccttatgaaataaggctttagagagctgtttctgtgtttttctatttctatttctattttttgttctaaatattgctgtattttgcggatataaattctagctcttgcagaaactcattctgaaactggtgcttgtatgatttcttatttttcacgaacatgtcccaaatttccttgctatttgctgcttgctgttgggataaactctaatgc

SEQ ID NO: 1133 - DNA, 869 bp, Cichorium intybus
ctcgtgaggtaggagattgtacgcgtgctacatttatctgttttatattcctactccggcagtctgtggaccaaatcaccggcgacgaaatccattacgatctcccgataaatcaacagttgttgttaccaatgtcgtctactttcagcggcgatgaaaccgccccgttcttcggcttcctcggagccgcagcagctctcgttttctcttgtatgggagcggcgtacgggacggcgaagagcggcgttggtgttgcgtcgatgggagtgatgagaccggagctggtaatgaagtcgattgtgccggttgttatggcgggagtgttaggtatttacggattgattattgctgttattattagtaccggaatcaatccaaaagcgaaatcgtattacttattcgacggttacgcgcatctgtcatctggtcttgcttgtggtctcgccggactttctgccggaatggccattggaatcgtcggcgatgctggtgttagggcaaatgcacaacagccaaagctttttgttgggatgattttgattcttatctttgctgaagcacttgcattatacggtctcattgttggcatcattctatcttctcgagctggtcaatccagggctgattaagtctttttacaatttcaaatccttccattatcaggttagtttcaccagttcagaaggattcaaaattgtgctcctattttcctgttattaaattgtttgttaggtataaaactggatgcaactttttccttaaaataaagctttaaagctagcattgttaatttgcttattttgtatcatataagcttaaaggtgagactgtgtaagattatttattaagttcattgctcaaaattggac

SEQ ID NO: 1134 - DNA, 950 bp, Cirsium arvense
gttgtcttgtagagtttggatagagaagagatagctgaataacaaatcctcacatccattcaatttcttctcttttcagatctaaaaaaccctaaaatcaacaccgatcgatcatgtcttctaccttctccggcgatgaaacggctcccttcttcggctttctcggcgctgctgccgccctagtcttctcctgtatgggggcggcctatgggacggcaaagagtggtgttggagtggcttcaatgggagtgatgaggcctgagctggtaatgaagtcgattgtgccggtggttatggctggagttttaggtatttacggcctgattattgctgtgattattagtactgggattaaccctaaggctaagtcgtattatctctttgatggatacgctcatctttcttctggtcttgcttgtggccttgctggtctttctgctggtatggccatcggaatcgttggtgatgctggtgtaagggctaatgcacaacaacccaaactctttgtcgggatgatcctcatcctcattttcgctgaagctctggctctttacggtcttatcgtcggcatcatcctttcttctcgagctggtcaatccagggcagactagaacggaatgcattggctttaaagcaagcattatcttattcttcttattatgtggtggttagagttgcggttttttccaaaattcttgggcggtgagaggcgagacccgctgatttctgtgtgccgagacaagattctatttgtttcttttgaataaattcgtcgtcataaatatctgtcgttaagttttcgttggacatgttattatttgtctatttttgtttggtcccctgcagatattaaggtctcgaaatcatgaactgttatttaatttgtatcttacaactcatcatcaataacatgctttttggagcaaaaaagaaaaaagtaaccgactgcg

SEQ ID NO: 1135 - DNA, 1441 bp, Cirsium arvense
agaagaaaattcatcagatccgatcaatttttctaccgatctaagcaccaaattcaatcaccatgtcttcaacattctccggcgatgaaacggctccgttcttcggctttctcggtgccgctgccgccctagtcttctcctgtatgggggcggcatatggaacggcgaagagcggtgttggggtggcgtcaatgggagtgatgaggccggagttggtgatgaagtcgattgtgccggtggttatggctggagtgttaggtatttacggattgattattgcggtgattatcagtactgggattaacccaaaggccaaatcttattatctttttgatggatacgctcatctttcttctggtcttgcttgtggccttgctggtctttctgctggtatggctatcggaattgttggtgatgctggtgttagagcaaatgcacaacaaccaaaactatttgttgggatgatcttgattctgattttcgctgaagcacttgctctttatggtctgattgttggcatcattctttcttctcgagctggtcagtcgagagcagactaaaaggagatggaggtggtgtatcttaaactactgctattaattaagcatatatgattattatcctctatatggttttggttgttgttgttgttggttgagctgcagacatgatcaattctttggtggctggctgatggatgactatgcgtgcctacagtaggtcgtaaaccaaattctagctctctttgctataataataaaattcgtaaattattttggacatgataattttgccagatttgttctacacaattgttgttggttaactctttttggctaatgacacgttaccgactaatattgattatagtagaagttaacaccctccaatattgatctaaagttaaactcattgaacataatttcaaccatttaactccgctgttcttggtcgctttgagcaggctctgataagactacattctgacggatcgataccaagtgtagtaatgaaaacgtgaattttggccggcaaccctagattcattactgcatagtctccaattatataggtaggatcaggatcaggatcttgcaccatatcaaaataagggttatgtatcccaattaagttgacagatacttcacgtccaccgactatcgcagcctttataaatgcgctgccattgtcacaaacgattttcgtagcactatatctgtccgccatttttgaaaagacttcttgaatcaccttgcgtgctcaaagaaatctctagggtaatgaaggagctgcgaaatcaaaaaccagttgagagtaatctgtccgaggtgggggagttggtctctgggttccacatagtctgaatctcatatttcagttttggtgttgtcttaaatccacaatgagaagagacacttataattaattccgagacccccgc

SEQ ID NO: 1136 - DNA, 819 bp, Cirsium arvense
cgtgaggccacgaacacactacaaatctatctgttcaatattccttctccggcgaactattttcaggccggtcaaatctgtttgggaacaaatcaacaatcggaattaatgtcgtctactttcagcggcgatgaaaccgctccgttcttcggcttcctcggagccgcagcagcccttgttttctcctgtatgggagcggcgtatgggacggcgaagagcggcgttggtgttgcatcgatgggagtaatgaggccggagctggtaatgaagtcgattgtgcctgttgttatggcgggagtgttaggtatttacggattgattattgctgttattattagtaccggaatcaatcctaaggcaaaatcgtattacctgtttgatggctacgcacatctgtcatctggtcttgcttgtggtcttgctggactttcggctggaatggccattggaatcgttggtgatgctggagttagggcaaatgcacagcagccaaagcttttcgttggaatgattcttattctgatttttgctgaagcacttgcgttatacggtctcattgttggcatcatcctctcttcccgtgctggccaatccagagctgattgattaagttgtacaaatttctcatccatccatccatcatcaggttagtttcacgggttgagaaggtcattcatctttccaaaatcttctttccagatatcatattgtttgttagttattaaactggaagctacttttgcccttaaataaagacttaaactagcattgtttattttacttattttgtattatacatatcacggaaacagcctctat

SEQ ID NO: 1137 - DNA, 771 bp, Cirsium arvense
aaaaccctaactttaatcatcaatcatgtcttcaacgttctccggcgatgaaactgcaccgttcttcggttttcttggcgccgctgctgccctagtcttctcctgtatgggagcggcttatgggacggcgaagagcggtgttggagtggcgtcgatgggagtgatgaggccggagttggtgatgaagtctattgtaccagttgttatggctggagtgttgggtatttacggtttgattattgctgtgattatcagtaccggaattaaccctaaggctaagtcgtattaccttttcgatggctacgctcatctatcttccggtcttgcttgtggtcttgctggtctttctgctggtatggctattggaatcgttggtgatgctggtgtgagagccaatgcacaacaaccaaaacttttcgttggcatgatcctcatcctcattttcgctgaagctcttgccctctacggtctcattgttggcatcattctttcttctcgagctggtcagtccagagcagactagaaagtccgatactttacaggtaaaagttaagcattttttgatggtcgttttgggtagagttgaagctggtgtgtgtgtgtgtgttgtttttccataatttgtgggtggtaaatggtggtaggttgtagaattgtagttgtccactataataaagctgtcattgttcctggtattattattattattatttgttgctatattttgtattttttttgcaaagaatctatttggacatgtatgttatttct

SEQ ID NO: 1138 - DNA, 879 bp, Cleome gynandra
aaaccaggcagatcagattccggtgtctctcagctaagagaagagccattctcttccacataccttcgacgatctcgtccttagatccgtaaccggccgagatgtcttcgttcagtggcgatgagaccgcacctttcttcggtttccttggcgctgcggcagccctcgttttctcctgcatgggagctgcttatgggacagcaaagagtggagttggagtggcatcgatgggtgtgatgaggcctgagttggtgatgaagtctatcgtaccagttgtaatggctggtgttctgggtatctatggattgattattgctgtaatcatcagtactgggatcaaccccaaagctaaatcatactacctatttgatggatatgcccatctttcttctggtctcgcttgtggacttgctggcctttcggctggaatggccatcggaatcgtgggcgatgctggtgtcagggcaaatgctcaacagccaaagctgtttgtggggatgattctgatcctcattttcgcggaagcattggctttgtacggactcatcgtgggtatcatcttgtcttcccgagctggtcagtccagagccgactgagtgagacgccgtcccgtcttatgattctttcatcatttgtcacccagcccaagggattgcttccgccatgttttataagaacgtgtcgcctctaccaaatgaaaaacaaaaaacaccattattatgttatctgtaatattttaaaattattaatttatttctcgatgaataaatgacagaacattatttaaggttgttttgtggactgcaacatgatgtattagggaataatcatctctccattcttccttgttatgatatgtttatgaaactatatattttg

SEQ ID NO: 1139 - DNA, 910 bp, Cleome gynandra
tcaacaaacaaaattcatacggatcgctgcgaaatccaattctctctctctcttcagattccagcgacgccgtgtgagatccgagagtaattccgatatgtcttcgtttagcggcgatgagacggcacctttcttcggcttccttggcgctgcagccgcgctcgtcttctcatgtatgggagctgcctatggaactgcaaagagtggtgttggtgtggcttcaatgggagtgatgaggcctgaattggtcatgaagtcgattgtccccgtggttatggctggtgttttgggtatttatggattgatcattgctgttatcatcagtacgggaatcaaccccaaggctaaatcttactatctattcgacggctatgcacacctctcatctggtcttgcctgtggtctcgctggtctttctgctggaatggccattggaatcgttggtgatgctggtgttagggcgaacgcgcagcagcctaaactctttgtcgggatgattcttatccttatcttcgcagaagcgcttgctctatatggccttattgtaggcatcatcttatcatctcgagctggccaatcgagggctgattaagatgggaaccgagactccaggtatatcccttagacttactcccgtgtgcgtttattttctcgtgcctagtttataacatgaggaactggcattcgttgggttcttggagcattgttttggaagtaaaccgcggccgtccctttgcccttttggtggtttgctccatttgtaggattttgatgtttggtttataataaaaaaaaaaaacagaacttgtggctaaagcttttcatgttttgtattattgttgtattgttctcattttgtcttgaggaacagtgaaaaaacaattgtttgtaagaagaagctttgcttctg

SEQ ID NO: 1140 - DNA, 922 bp, Cleome gynandra
ctttttgttttcttcgactacaacagacaaaatacagcgatcactgagaaatctctctctctctctctcgattccggcgacgtctattttttagatccgacataaactccgagatgtcttcgtttagtggcgatgagacggcaccgttcttcggcttccttggcgccgcagccgcgctcgtcttctcctgtatgggagctgcctatggaaccgcaaagagcggtgttggtgttgcttcaatgggagtgatgaggcctgaattggtcatgaagtcgattgtccctgttgttatggctggtgttttgggtatttatggattgatcattgctgttatcatcagtacgggaatcaaccccaaggctaaatcttattacctcttcgatggctacgcacacctctcctctggtcttgcctgtggtcttgctgggctttcagctggaatggccattgggattgtcggtgatgctggtgtcagggcaaatgcacaacagcccaaactcttcgtcgggatgattcttatccttatcttcgcagaagcacttgctctctatggccttattgtaggcatcatcttatcatctcgagcaggccagtcaagggccgattaagaagggaacggagactccaggtatcccgcgctagacgtgcctggtatgtaacatgaggaacttgcatttgctgggttcttggagaattcttttggaagcaaaccgttggccaccactttgcccttttggtggttttctgcatttgtaggattttgttgtttggtcggtaataaaaagaagcttttggcaaaagctcttcatgttttgtattattgtattgttctcattgtcttgaggaaacattaaaacacatttatttgtaaagcaggttgcttctaaacattttgactgttatgagattaatctaatctatt

SEQ ID NO: 1141 - DNA, 775 bp, Cleome gynandra
cagaaatttacagagagaatcaagcagatcagattccggtgtctctcttcttaagatccttaagatgtcttcgttcagtggcgatgagaccgcacctttcttcggcttcctcggtgctgcagcagcgctcgtgttttcctgcatgggagctgcgtatgggacagcgaagagtggtgtaggtgtggcatctatgggtgtgatgaggcctgaattggtcatgaaatctattgtccctgttgttatggctggtgttttgggtatctatggattgattattgctgttatcatcagtactgggatcaatcccaaggcaaagtcatattacctctttgatggatatgcccatctttcgtctggtctcgcttgtggccttgctggactttcagctggaatggctattggtatcgtgggtgatgctggtgtcagggcgaatgctcaacagccaaagctttttgttgggatgattttaatcctcattttcgctgaagcattggctctgtacggtctcattgtgggtatcattttgtcatcccgagccggacagtcccgagcagattgagaggagccaagaaacagatcatggtctatttttagaatagtgagatggtggatttggttcggacaagttccttttttggaaggtgttttgttgttgttgttgtctttgtttcaccattctgttatgtttattgtaatatgaatatgaaggattcattcccttcctttttataaataaatattattatttttgttttactaattaatttaatttagt

SEQ ID NO: 1142 - DNA, 754 bp, Cleome spinosa
gccgacaacaatccgtctctctctctctctctccatattcctgcgttcccgtatcagatccgagaggcgttccgacatgtcttcgttcagcggcgatgagacagcaccgttcttcggcttccttggcgctgcagccgcgctcgtcttctcctgcatgggagcagcctatggaacagcaaagagtggtgtaggcgtggcttcaatgggagtgatgaggcctgaattggtcatgaaatcgattgtgccggtggttatggctggtgttttgggtatttatggactgatcattgcagttatcatcagtaccggaatcaacccaaaggctaaatcttactacctcttcgacggctatgcacacctctcctctggtcttgcctgtggtcttgctggtctttcagccggaatggccatcggcattgtgggtgatgctggtgtcagggcaaatgcacaacagcctaaactcttcgtcgggatgattcttatcctcatctttgcggaagcgttggctctttacggccttatcgtgggcatcatcttgtcgtctcgagctggccagtctagggctgactaaggaagggcccgagactcgagactttattggatcattgtttcggaagcagacctctgcccttttggtggtttgctccattgtaggattttgaggtttggtcggtaataaaaaaaaagtttgtggctaaagcttagctttgttttgtattttcttgtatttgtttgttcgcatatgtcatgagga

SEQ ID NO: 1143 - DNA, 872 bp, Cleome spinosa
ggaaatccacacagagaaccagcttgatcagatttcggtctctctgttaggacaatagcaaaactcttccagcaaccttctgcgatctcgtcttaatatccgagatgtcttcgttcagtggcgatgagactgcgcctttcttcggcttcctcggcgcggctgcagcgctcgttttctcatgcatgggagctgcttatgggacagccaagagtggggtcggtgtggcatctatgggtgtgatgaggcctgagctggtcatgaagtctattgtcccagttgttatggctggtgttttgggtatctatggattgattattgctgttatcatcagtaccgggatcaaccccaaggctaagtcgtactatctctttgatgggtatgcccatctttcttctggtctcgcatgtggacttgctgggctttcagctggaatggccattggaatcgtgggtgatgctggtgtcagggccaatgctcaacagccaaagctttttgtcgggatgattcttatcctcattttcgctgaagcactggcactgtacggtctcatcgtcggcatcatcttgtcttcccgagccggtcagtccagagcagactgagaggatggccggttttgaacctcaaggattctttcagcacttgccatcaagccagaccgtcgtctattaagatggtggatttgcttccgacatgtttcttaagagcgtgttggctcgatccaaaaaacaaaacactcatcagttgtcgttttcaccagttctgttatgtttgattgtttgtaatatgttcgcgaaggagattattgtctgctcaataaggacgtcatgagtgagagaccccatatttaaattatattatttttctcgttgaat

SEQ ID NO: 1144 - DNA, 853 bp, Cleome spinosa
tcggggcgtcaaagagaaccaggtaagatcagatccccggtctcgctgcttagagaataacaaaattcttacggcaaccttcggcgatctcgtcttaagatccggaaccggccagatatgtcttcgttcagtggcgatgagactgcacctttcttcggtttcctcggcgctgcggctgcgctcgttttctcctgcatgggagctgcttatgggacggcaaagagtggtgtaggtgtggcatcgatgggtgtgatgaggcctgagttggtaatgaagtcgattgtcccagtggttatggctggtgttctcggtatctatggattgattattgctgttatcatcagtaccgggatcaaccccaaggctaagtcatactacctctttgatgggtatgcccatctctcttctggtctcgcctgtggccttgctggtctttcggctggaatggccatcgggatcgtgggtgatgctggtgtcagggccaatgctcaacagccaaagctttttgtcgggatgattcttatcctcatttttgctgaagcgctggctctgtacggcctcatcgtcggtatcatcttgtcttcccgagcgggtcagtcccgagcagactgagaggagggacgggcctttgaccccccgaaggattcttttatcgcttgtcggccttgtcagcgagcgaaccatatattcatctgtttttttcaggttagtaagatggtggatttgcctccggcatgtttctcatctggtgttgtccttatcaccattctgttgtgtctgtaatatgatcgtgaaggattctctgctaaataagaactctcctgagagaccccgtatttaaattttattactt

SEQ ID NO: 1145 - DNA, 856 bp, Cucumis sativus
gcgaggcgagaaaggagtggaggaagagagagattgagagcggttcgagatctgatctaatcggagaccttcttcttcatcttcaccgttgaacccagaaaagatgtcgtcagccttcagcggcgatgaaacagcacccttcttcggcttcctcggcgccgctgcagctctcgtcttctcatgtatgggagctgcttatggaacggcgaagagcggggtgggagttgcgtctatgggagtaatgaggcctgaactggtgatgaagtcaattgttccagtggttatggctggagttttgggtatttatggtcttattattgctgtgattattagtacagggattaaccctaaggccaaatcttattacctcttcgatggctacgcacatctctcctctgggcttgcttgtggtcttgctggtctgtccgctggcatggctatcgggatcgtcggtgatgctggtgttagagccaatgcccagcagcctaagcttttcgttgggatgattcttattttaatttttgccgaagctctggcactctatggacttattgtgggcattattctctcttcccgagctggtcagtcaagagccgattaagtggatgctgtatgtggactcgaggttgtgtagtatgtctcttcttttgttttttggtcaagaattggtttttgtactctttgagtaaatgggttattattatggtttaagccgactctcaaatgttcttgtgaggtgtgattgctaataccacacgaattctgtagttgttatatatggatttggaattaattattcttctcaataaaatattaaactctgttacattactccaattttaatgatgattccctc

SEQ ID NO: 1146 - DNA, 812 bp, Cucumis sativus
aaaagtaaaaaataaaaagcttcagatctgatcggaaatcttcttcttcttcttctctctccatcggaaaaaatgtcgtcctcgttcagcggtgatgaaacggcacccttctttggctttctcggcgctgctgcggcccttgttttctcatgtatgggagctgcttacggtaccgcaaagagcggtgttggtgtggcgtcaatgggagtgatgaggccagaattggtaatgaagtctattgttccggtggttatggctggagttttgggtatttatggtttgattattgctgtgattattagtacggggattaaccctaaggctaaatcttattatcttttcgatggttacgctcatctttcctctggtcttgcttgcggcctcgccggtctctctgctggcatggctatcggtatcgtcggcgatgcgggcgtcagggccaatgcacaacaacctaagctttttgttgggatgattctcattctaattttcgccgaagcacttgctctctatggacttattgttggtattattctctcctctcgagctggtcagtcaagagctgattaagtgatgaaatgttttgcgcttggaatttatgtattaatggtctctctctttttcttttcttttcttttattatctcataaattgtttttgtagttctatgattagaaatggtcacgactaagtttttcactttcccaaatattcttgtggttttgtgatttctgtaccacatagattctgtactcataaggatttggaatcaattgttctctcaataaacataaaaacattccttccttccc

SEQ ID NO: 1147 - DNA, 758 bp, Cucurbita pepo
cagaaaagatgtcgtcaactttcagtggcgatgaaacggcacctttcttcggcttcctcggcgccgctgcggccctcgtcttctcctgtatgggagctgcttatggaacggcgaagagcggggtgggagttgcgtctatgggagtaatgaggcctgaactggtgatgaagtctattgttccggtggtcatggctggagttttgggtatttatggtcttattattgctgtgattattagtacagggattaaccccaaggccaaatcttattaccttttcgatggctacgcgcatctctcctctgggcttgcttgtggccttgctggtctgtccgctggcatggctatcgggatcgtcggcgatgctggtgttagagccaatgcccagcagcccaagcttttcgttgggatgatccttattctaatttttgctgaagcgctggcactgtatggactcatcgttggcattattctgtcttcccgagctggtcagtcgagagctgattaagtggtgggggatggtttttgtggagtggagtttgtgtagtgtatgtcctcgttttctttttgtccatccagaattgattttgtactgctgagtaaatgggttgttgttatgatttttaagcctactctcccaaatgttcttgtgaggtgtgattgctgcttgctatacctcacggaccctgtagtagcgtagctaatatggatttggggattaattattcttctcaataaaagattaaactctgttgcatcg

SEQ ID NO: 1148 - DNA, 759 bp, Cucurbita pepo
agggagagaaaaaagcttcagatctaatctgatcggagatcttgttctcagtcgaactgaaaaaaatgtcgtcaacgtttagcggtgatgaaacggcacccttctttggcttcctcggcgctgctgcggccctggttttctcctgtatgggagccgcttacggcacggcgaagagcggggttggagtggcgtcaatgggagtgatgaggccggaattggtgatgaagtcgattgttccggtggttatggcgggagttttgggtatttatggtttgattattgctgtgattattagtacggggattaacccgaaggctaaatcttattacctcttcgatggttacgcccatctctcctctggtcttgcttgcggtctcgccggtctctctgctggcatggctatcggcatcgtcggcgatgcgggcgttagggccaatgcacaacaaccaaagctctttgttgggatgattctcattctaattttcgcggaagcacttgccctttatggacttattgttggtattattctctcatcccgagctggtcagtcaagagctgattaagtgaatgttttgcgcttggaaattgtgtattatgtctcttcttgttcttatttcttgctttttgtagttctcttgattagaaatggtcatgactaagtctttctttctcaaatattcttgtttttgttgtgtgatttctgtactcaacaaggatttggaatcaattattcttctcaataaacacaaaacattgtca

SEQ ID NO: 1149 - DNA, 778 bp, Cucurbita pepo
tatttcagagggctggggagagagagagatctgatccaatcggagaccatcttcatcttcaccgtcgaacacagaaaagatgtcgtcaaccttcagcggcgatgaaacggcgcccttcttcggcttcctcggcgctgctgcggccctcgtcttctcctgtatgggagctgcttacggaacggcgaagagtggggtgggagttgcgtcgatgggagtaatgaggcctgagttggttatgaagtcgattgtgccggtggttatggctggagttttgggtatttatgggcttattattgctgtgattatcagtacggggattaaccctaaggccaaatcttattacctcttcgatggctacgcgcatctttcctctgggcttgcttgtggccttgctggtctatctgctggcatggctattgggatcgtcggcgatgctggtgttagagccaatgcacagcagcctaagcttttcgttgggatgattcttattctaattttcgccgaagcactggctctctatggacttattgttggcattattctctcctcccgagctggtcagtcgagagctgattaattggatgctttgtgcgtggactggagtttgtgtagtatgtctcctcttttgtcaagaattggttttgtactcttgagtaaatgggttactatcattaagcttgcttactctcttaattgttattgtgaggtgtgattactgtaccacacggatcttgagtagctatgtggatttggaattaattattcttctcaataaaga

SEQ ID NO: 1150 - DNA, 790 bp, Cucurbita pepo
agatctgaagagaaagctaaatcacagtgagaagaagaaaaaagagaggaaagaatcttcagatctgatctaatcggagatcctcctctttttccaaccggaaaaatgtcgtcaaccttcagcggcgatgaaacggcgcccttctttggctttctaggcgccgctgcggccctcgtcttctcctgtatgggagccgcttatgggacggcaaagagcggtgttggagttgcgtcgatgggagtgatgagaccggaattggtgatgaagtcgattgttccggtggttatggcgggagttttgggtatttatggtttgattattgctgtgattattagtactgggattaaccctaaggctaaatcttattacctcttcgatggctacgcgcatttgtcctctggtctggcttgtggtctcgccggtctctctgctggcatggctatcgggatcgtcggcgatgccggcgttagggccaatgcacaacagcctaagctttttgttgggatgattctcattctaattttcgccgaagcgcttgccctttatggacttattgtcggtattattctctcgtcccgagctggtcagtcgagagctgattaattgaacgttttgcgctttgaaaatgtgtattatgtctcttttttccttcaagatttgtttttgtagttctctgattagaaatggtcacaactcagtttactttctcaaatattcttatgttgttgtgtggttttctaccacacggatgctgtactcataaggatttggaatttattattcttctcaa

SEQ ID NO: 1151 - DNA, 717 bp, Curcuma longa
gcacgttgctctgcttcctcctccgcaggaattagggttccgtcgagactcctccgccacgatgtctagcttcagcggcgatgaaactgcccccttcttcggattcctcggcgcggccgccgccctggtcttctcctgcatgggggcggcgtacggcacggctaagagcggcgtcggggtggcgtccatgggtgtgatgcggccggagctcgtgatgaagtcgatagttcccgttgtcatggccggagttctggggatttacggtctcatcattgcggtgatcataagcaccgggatcaaccccaaggccaagtcgtactacctttttgatggctatgctcatctctcttctggcttggcttgtggccttgcaggactttcagctggtatggccattggcatcgtgggagatgctggagtcagagctaacgctcagcagccgaagctgttcgtaggtatgattctcatactcatcttcgcagaagctctcgccctctatggcctcattgtcggcatcatcctttcttctcgagctggccaatctcgagcagactaacaccgccacattttatgaccgtcagcattatttcaatcacacttatcgtatgtaaatttattcagtcgagaccgtgttgctattttacggataagtgtcgcgcgtttttgtggactcgcatcactttgctctataataattaatttggtgttgtgaacatt

SEQ ID NO: 1152 - DNA, 875 bp, Cynara scolymus
  misc_feature (505)..(505): n is a, c, g, or t
  misc_feature (514)..(514): n is a, c, g, or t
  misc_feature (803)..(803): n is a, c, g, or t
gcggggttgttgtctggtgtagtttggatagaggaggatagctgaacaataaatcctcacgtccattcaatttcttctctttcagatctaaaccctaaatcaaccgatcatgtcttcaaccttctccggcgatgaaacggctccgtttttcggcttccttggcgctgctgccgccctagtcttctcctgtatgggggcggcctatgggacggcgaagagtggtgttggagttgcttcaatgggagtgatgaggcctgaactggtaatgaagtcgattgtgccggtggttatggctggagtgttaggtatttacggcctgattattgctgtgattattagtactgggattaaccctaaggccaagtcttattatctctttgatggatacgctcatctttcttctggtcttgcttgtggccttgctggtctttctgctggtatggccattggaatcgtgggcgatgctggtgtaagggctaatgcacaacaacccaaacttttcgtnggaatgatncttatcctcattttcgctgaagctctggctctctatggtcttattgtcggtatcattctttcttctcgagctggtcaatcccgagcagactaaaatggattgtgtcactgctttaaagtgagcattattcttcttatactctggtggttagagttgcggtttgttccattgtttttgggcggtgaaccgagaccggctgattgctgtgtgctgagacaatattctacttctttcttttaataaagtcgtcattgttgtcgctatatttttgccaaaagaaacccctctntggacatgctattattcgtgtattttgtttaaggtcgttaaatccaatattatttgtatcctacaactcatc

SEQ ID NO: 1153 - DNA, 782 bp, Cynara scolymus
  misc_feature (13)..(13): n is a, c, g, or t
  misc_feature (18)..(18): n is a, c, g, or t
  misc_feature (748)..(748): n is a, c, g, or t
cactgccgttcgnatttntacgttcaatattcctgctccggcgaacaattttccggcccctcaaatctgttgagatctcccctacaattcaacaattggaattgatgtcgtctactttcagtggcgatgaaactgctccgtttttcggcttcctcggagccgcagcagcccttgttttctcctgtatgggtgcggcctatgggacggccaagagcggcgttggtgttgcatcgatgggagtgatgaggccggagctggtaatgaagtcgattgtgcctgttgttatggcgggagtgttaggtatttatggattaattattgctgttattattagtaccggaatcaatcccaaggcgaaatcatattacctgtttgacggctacgcacatctgtcatctggtcttgcttgtggtcttgctggactttcggctggaatggccattggaatcgttggcgatgctggtgttagggcaaatgcgcagcagccgaagcttttcgttggaatgattcttattctaatctttgctgaagcacttgcgttatacggtctcattgttggcatcatcctctcttcccgtgctggccaatcaagggctgattaagttgtacaatttctcatccatcatcagcaacatgttatcaggttagtttcacgagttgagaaggtccagattcatcttttcaaaatcttccttcctgttttcaaattgtttgttagttactaaactggaagcaacttttgccctcnaataaagactaaaatagcattgtttatttaccta

SEQ ID NO: 1154 - DNA, 883 bp, Cynara scolymus
  misc_feature (868)..(868): n is a, c, g, or t
ggattctggagaagaaatcctcagatccgatcaatttttttgccgatctacgcaccaaattcaatcaccatgtcttcaacattctccggcgatgaaacggctccattcttcggctttctcggtgccgcggccgccctagtcttctcttgcatgggggcggcatatggaacggcgaagagcggtgttggggtggcgtcgatgggagtgatgaggccggagttggtgatgaagtcgattgtgccggtggttatggctggagtgttaggtatttacggattgattattgcggtgattatcagtaccgggattaaccccaaggccaaatcttattatctttttgatggatacgctcatctttcttctggtcttgcttgtggccttgctggtctttctgctggtatggctatcggaattgttggtgatgccggtgttagagccaatgcacaacaaccaaaactatttgttgggatgatcctgattctgatttttgccgaagcacttgctctctatggtctcattgttggcatcattctttcttctcgagctggtcagtcaagagcggactagaaggagatgaggtggtgtatcttagtgctattaattaagcatatgattgttatcctctctgtggttgttgttgttgttggttgagctgcagacatgatcaattctttggtggtgatgataccttggcctgatggattggctggctgacgactatgcgcctacagtaggtcgttcttagaccaaattctagctctctgctataataataaaattcatcccttttacgtaaattatttttggacatgctataatgttgccagattgttgctacaattactcttttttatgttagtcaagattncatattgatggaaca

SEQ ID NO: 1155 - DNA, 876 bp, Taraxacum officinale
gcatacaattacataacgtcatcttccctctccctctctctttctctctcgatcctcagatccgatcaatttctctgcgaatttaaaccctaatcaaccgatcatgtcttcaaccttctccggcgatgaaacggctccgtttttcggctttctcggtgccgctgctgccctagtcttctcctgtatgggggcggcgtacggaacagcgaagagcggtgttggagtggcgtcgatgggagtgatgaggccagagttggtgatgaagtctattgttccagtcgttatggccggagtgttgggtatttacggtttgatcatcgctgtgatcatcagtaccggaattaaccccaaggctaaatcctattacctatttgatggctatgctcatctttcctccggtctcgcttgtggccttgctggtctttccgccggtatggctatcggaatcgtcggcgatgctggtgttagagccaatgcacaacaaccaaaactattcgttggaatgatcctcatcctcattttcgctgaagctcttgccctgtacggtctcattgttggcattattctttcttctcgtgctgggcaatccagagcagactagaaggtgttattcatcattcggtgccatgatcacgtgctctacttcttctacagctgtaacttatgcattttttgatctgtcattttggtgagagttgaagctgttgcaggtgtgtcgtttttttttcttcttcataatttgtgggtggtaaatggtgatgatgtgtgagttgagggggtagagttgaagtaggatagattgtgggttttcgttataataaagatgtctatgtactcgtattttttatttatttatgagcaaagaacatgttggat

SEQ ID NO: 1156 - DNA, 848 bp, Taraxacum officinale
cagtccgtacaacgtgcataataccatcttctcttcttcgctgtggagtttggatatctagagattaaaaaacctcagatccgatcaaattttttgcagatctacactccaaattcaatcatcatgtcttcaacattctccggcgatgaaacggctccgttcttcggcttcctcggtgccgccgcggccctagtcttctcctgcatgggggcggcatatgggacggcgaaaagcggtgttggggtggcgtcaatgggagtgatgaggccggagttggtgatgaagtcgattgtgccggtggttatggctggagtgttaggtatttacgggttgattattgcagtgattatcagtaccgggattaacccaaaggccaaatcttattatctctttgatggatacgctcatctttcttctggtcttgcttgtggccttgctggtctttctgcgggtatggctatcggaattgttggtgatgccggtgttagagcgaatgcccaacaaccaaaactatttgttgggatgattttgattctcatttttgctgaagctttggctttgtacggtctcattgttggcatcatcctttcttctagagccggtcaatccagagctgactagacgccttaatgatcaattctttggtggtgatgataaattggccctatgttttagaccaaattctagttccttataataagattcctatatttcttttatctttgtagactcgataattttggaattgtgttggtatttatttttatcttatgctcaagaattgtgccatttataaggtttgtttcataaagttgtgccatttagtgctaaatgattctaatatttac

SEQ ID NO: 1157 - DNA, 802 bp, Eschscholzia californica
gagagatccaaaatcaattatctaagcggagaagagaaaacgaactccggatcagatctatatttctctgcttctttgaaaaatgtcttcggtattcagcggcgatgaaactgctccgttcttcggcttccttggggctgctgctgccctagttttctcctgtatgggggctgcttatggaacagcaaagagtggtgttggtgtggcttcaatgggagttatgagaccagaattggtcatgaaatccattgttccagttgttatggctggagttttgggtatctatggtttgattattgctgttattatcagtactggaattaaccctaaagccaaatcttactaccttttcgatgggtacgcacatctttcatctggtctctcttgtggattggctggtctctccgctggtatggcaatcggaatcgtcggtgatgctggtgttagagctaatgctcaacaaccaaagctctttgtcggtatgattcttatcctcatctttgctgaagcgttggctttgtacgggcttatcgtcggtatcattctgtcttcaagagctggtcaatccagagcagactaggaaaagtgagccatcctggtgttattaatgtgatttgttagtatcattttgtctacttaattcatctctcatgtttctaatactttttcacttgttatttgttttctgataaattcttcattctgaacataaatttctcatctttctttcatgaggtttattttttctgtgctggttgtaatgttaggaaccgttaaaaaataaaagagcttcagaagctct

SEQ ID NO: 1158 - DNA, 1060 bp, Eucalyptus grandis
ctcaatgatcgctcgaaatcggatcgagcacgaccctgccaaatccgaagttgctgagcaatttcccttccacgagcttcttctgcggctcagaagaaaagagagaaagagaacgaaaagcgaaactccaccgggagagagagagagagagaaagaagaagaacgagaacgacgtgtcgtcaccagatccagcgaacgacgtcggagaacgaaggaagggaccgagggtagcgatgtcgtctacgttcagcggcgatgagaccgcgccgttcttcggcttcctcggcgcggcggccgcgctcgttttctcctgcatgggagctgcatatgggacagccaagagcggggtgggcgtagcatctatgggtgtgatgagacctgagctggttatgaagtccatagtgccagtggttatggcaggagtgctgggtatttatgggctgattatcgctgtcatcattagtactgggattaatcccaaggcgaaatcttactacctctttgatgggtatgcacatctttcatctggcctggcttgtggtcttgctgggctgtcagctgggatggcaattggaatcgtcggagatgcgggtgtcagagctaacgcgcagcagccaaagctttttgtcgggatgatccttatcctcattttcgctgaagcactggctctctacggccttattgttggcatcatcttgtcttctagggcaggccagtccagagcagactgaagacgaccgagtgatgcattactgaacagatcaatttgttcttcaggctctatgcagaataattatgtagtctcaatttatagcattagttggacagccctcgcaagaatctgatcttcttgttgtctttccgagatgagaaaagagcgtctctgcatgagaaaggcttgtgaagttcttctttaatttgtgtattatccattgtaaaccttgattctgtgactgatattcttgagatttcatcgtgcatctcatctggattgcatatatgttccatggcttgcaatgcaattctcttgaagaagagtgggtttcggtttggtcccaaa

SEQ ID NO: 1159 - DNA, 1215 bp, Eucalyptus grandis
cttccgctccgattacaaaaagggggaaaatcgcaaacgagaagaagcccgcaaaaccagaaggggacaaagcagagagggacacagagagagagagagagagatcagaccaggaagctgtccgcgagtgcgcagaggcctttccccaccgtcgagatccgatcgatccagccagccaatcgaccatgtcgtcgacgttcagcggcgacgagaccgcgcccttcttcggcttcctcggggccgcggccgccctcgtcttctcctgtatgggagcagcatatggaacggctaaaagtggtgtgggtgtagcatcaatgggagttatgaggccagagctggttatgaagtcaattgtccctgttgtcatggctggagtgttgggtatttacgggcttattattgctgttattataagtacagggattaatccaaaggccaagtcatattacctctttgatgggtatgcacacctttcatctggtctggcttgtggtcttgctggactttcagctggtatggcaatcggaattgttggtgatgctggtgtaagagctaatgcgcagcagccaaaactttttgttgggatgatcctcatcctcattttcgctgaagctttggccctttatggtcttattgtgggcatcatcttgtcttcccgagcaggccagtccagagcagattaaggagggaactgctgaaccaggcaggattttgtcagtatctctcatgagaaaatatatctcctgtttgccggtttgggatggtaggatggccctcgaagtgttctttgaagttcttctgtagaagtgattattctgccagtcctgtgagagttgctcttggttagtttcctgcataattattctcaccgaagaataaaagctattgaacctgtgtcttatgtcatctattggtcttattattacttgaaagtagtatttgactggtgcgaggtcatcttgtttcaactgtttatttaccttgtcttgtgttctgtacaacatgttttcagatcctcaaatatttctctcctatctgtcgtcatttgggcttgctaaagtagagagggaaaggggacattggacagttatgtatggtgggtagcacgatgattgttttgcatggcaaaggaactgagctcgaatgaaactaatcaatcatgtggatggctcaagaaacttttaaacgagtccaagaccagctgccgagcagttg

SEQ ID NO: 1160 - DNA, 933 bp, Euonymus alatus
tctctctctctctctaagatctaatcggaaaatgtcatcaacattcagcggcgacgagactgcccccttcttcggcttcctcggcgctgcagccgctctcgttttctcatgtatgggagctgcgtatggtacggcgaagagcggtgttggcgtggcttcgatgggagtgatgaggccggagctggtgatgaaatcgatagtgccagttgttatggcgggagtgttaggtatttacggtttgatcattgctgtcattattagcactggaattaaccctaaggccaaatcgtattacctgttcgatggctacgctcacctttcctctggtctcgcttgtggtcttgctggtctctctgcgggtatggctattggaattgtcggcgatgctggcgtcagggctaatgcacaacagccaaagctttttgttggaatgattctcattcttatctttgctgaggcattggctctatatggcctcatcgttgggatcatcctctcttcccgagctggtcaatccagagctgattagaatgcccactaattgtgagatcgctcccattggtcatactgaggttggtgtggctaatacgttgtgttctatgttagatcaagttattcgcgatgcgagccgcttattggatatatctttatcatgctggctgtataatttggagaaaacatttctttgaagtgaagcttgttatttatttattttctatttgctgtattcttaatattgaacaattgttgtagttttcattgcaaaacaatttgatgtgtttgtctgtcgtttagaagtttaatttatctcacctctgatcaaatatttggatgtaaaatttgaatgctctcccctaaggcccaaaccccctttatctcctgacttgttcatctttcctaaatgaaattgttctatctgtggtttttatcctc

SEQ ID NO: 1161 - DNA, 898 bp, Euonymus alatus
acactgaagcttccacgcatcttcgaatctcctcctcctcaccctcttggcctttccctctctctggctcttgctctcgggcgatcaaatccgaattctctctctctctctaagatctaatcggaaaatgtcatcaacattcagcggcgacgagactgcccccttcttcggcttcctcggcgctgcagccgctctcgttttctcatgtatgggagctgcgtatggtacggcgaagagcggtgttggcgtggcttcgatgggagtgatgaggccggagctggtgatgaaatcgatagtgccagttgttatggcgggagtgttaggtatttacggtttgatcattgctgtcattattagcactggaattaaccctaaggccaaatcgtattacctgttcgatggctacgctcacctttcctctggtctcgcttgtggtcttgctggtctctctgccggtatggctattggaattgtcggcgatgctggcgtcagggctaatgcacaacagccaaagctttttgttggaatgattctcattcttatctttgctgaggcattggctctatatggcctcatcgttgggatcatcctctcttcccgagctggtcaatccagagcagattagaatgcctactaattgtgagatcgctctctttggtcatactgaggttggtgtggctaatacgttgtgttctatgttagatcaagttattcgcgatgcgagtggcttattggatatatctttatcatgctggctgtataatttggagaaaacatttctttgaagtgaagcttgttatttatttattttctgtttgctgtatacttaatattgaacaattgttgtagttttcattgcaaaacaatttgatgtgtttgtctgtcgtttagaagttta

SEQ ID NO: 1162 - DNA, 654 bp, Euphorbia peplus
cgaaaaagcttcagatctgatcggagatcttcatcttctttgtccgaccggtaaaaatgtcgtcaacgttcagcggtgatgaaacggcacccttctttggctttctcggtgccgctgcggcccttgttttctcttgtatgggagccgcttacgggacggcaaagagcggggttggtgtggcgtcaatgggagttatgaggccggaattggtgatgaagtcgattgttccggtggttatggcaggagttttgggtatttatggtttgattattgctgtgattattagtacgggaattaaccctaaggctaaatcttattacctcttcgatggctacgcccatctctcctctggtcttgcttgcggcctcgccggtctctctgctggcatggctattggcatcgtcggcgatgcgggcgttagggccaatgcacaacaacctaagctttttgttgggatgattctcattctaattttcgccgaagcacttgctctttatggacttattgttggtattattctctcttctcgagctggtcagtcaagagctgattaagtgaatgttttgcgcttggaatttgtgtattatgtctcttttttcctttccccctctcatgaattgtttttgtagttctctaattagaaatggtcatgac

SEQ ID NO: 1163 - DNA, 892 bp, Flaveria ramosissima
ggcatgaataacaacacttgaacacgattaaacatcatctctctcgatcatacacacatataacatcatcactctcgatcgatcgatatcgaattatcgatcatcagatccgaactaccgatcatgtcttctacgttctccggcgacgaaacggccccattcttcggctttctcggagccgctgccgccctagtcttctcctgtatgggggctgcttacgggacggcgaagagcggcgttggggtggcgtcgatgggcgtcatgaggccggagttggtgatgaagtctattgtccccgttgttatggctggagttttggggatttatgggttgattattgctgtcattattagcactgggattaaccctaaggcgaaatcttattatctgtttgatgggtatgcgcatttgtcttctggtcttgcttgtggccttgctggtctttctgctggtatggctattggaatcgttggtgatgctggtgttagagccaatgcacagcaaccaaagctttttgtggggatgatcctgatacttatcttcgcagaagctcttgctctttatggtcttattgttggcatcattctttcttctagagccggtcagtcaagagcagactaaaaggttggcgattgatggatgatcctgtactcgctcgtgtgttttacggttataacttgaaggatcttttggttgttggtttgggtggagttgaaggtgtgttttttttccataatttgtgggtggtaaatggtgatgatatgtgttgagagttgatgctagattagagtgtagttttctgctataataagggtgaccctgctactggtattatttgttgcaatagcctatggtatttatttgttgataattattttatttgatttattta

SEQ ID NO: 1164 - DNA, 939 bp, Flaveria ramosissima
atacaaacatccatcgttgttgcacgattcaatttctgtggagattggatcgatatctgagaatcaaaatccccaaatcaattcaatatctcttcagatcaaatcaaaaccctaattcaatcaatctatcaatcatgtcttcaacgttctccggcgacgaaactgctccgttcttcggcttcctcggcgccgctgccgctctggtcttctcctgtatgggggcggcgtacgggacggcgaagagcggcgttggagtggcgtcgatgggggtgatgaggccggagttggtgatgaagtcgattgtgccggtggttatggcgggagtgttgggtatttatggtttgattattgcagtgattattagtacggggattaaccctaaggcgaagtcttattatctgtttgatgggtatgctcatctttcttcgggacttgcttgtggtcttgcgggtctgtctgctggtatggctattggaatcgtgggggatgctggtgttagggctaatgcacaacaaccaaaactttttgttggaatgatcctaattctcatttttgctgaagctctggccctctacggtcttattgttggcatcattctttcttctcgagctggtcaatccagagcagattagaagaattgtcgtggatcttgttcactgcgataaagtgagcatttttctttatcctctcgttagatttgtggttccttctacttgtagcctagtttctagtttccaccttcaataagattgttttcatcattatttgttgctatttattgaaaaagaagttttcagacatatggattgtgatttatttgtattgtacaacttattaataacctgcttccatgtacttgaagtttggttttctcataataaatggtaaagttgtctaataagattgttgtctgaagtgtatttaaatgcttaaaatatt

SEQ ID NO: 1165 - DNA, 879 bp, Flaveria ramosissima
tccatataacttgaacatatcatcgttccatctctgctgaggagtttggatatattatctacaacaataaatcatcagatccgatcattttttctgcagatctataatcatcatgtcttcaacattctccggtgatgaaacggctccgtttttcggatttctcggtgccgctgcagccctagttttctcctgcatgggggcggcgtacggaacggcgaagagcggtgttggagtggcgtcgatgggagtgatgaggccggaactggtgatgaagtcgattgtgccggtggttatggctggagttttgggtatttatgggttgattattgcagttatcatcagtaccgggattaaccctaaggctaaatcttattatctgtttgatggatatgctcacctctcttctggtcttgcttgtggtcttgctggtctgtccgccggtatggctatcggaatcgttggtgatgcaggtgttagggccaatgcacaacaaccaaaactgtttgttgggatgatcttgattctcatttttgctgaagctctggctctgtatggtctgatcgtgggcattattctttcttcgcgtgctggtcagtccagagctgactagaatgggttcgtgtatgaggtggtgtgtgttaatggtattgtttaaacatatgctattgtcatattgttattgtcgatttgtggatgtattcttgttggttgtgctagttgcagacatgatcaattctttggtggtgatgataccttggtctggaccaacggcctgtggctgtgcgccagctcttatggtaggttttagaccaaaccttagcccttttccataataaaactcatatttttcaactttttgctatgtttatgcaatgtgaa

SEQ ID NO: 1166 - DNA, 915 bp, Flaveria ramosissima
cgaaaacacaaaccctcagatccgatcaaattttctgcagatccacaatcaactcatcacatctcatctcatcatgtcttcaacgttctccggcgatgagacggctccgttcttcggctttctcggtgccgctgccgcccttgttttctcctgtatgggggcggcgtatgggacggcgaagagcggtgttggagtggcgtcgatgggagtgatgaggccggagttggtgatgaagtcgattgtgccggtggttatggcgggagtgttgggtatttatggattgattatagcggtgattattagtactgggattaacccgaaggctaaatcttattatctgtttgatgggtatgcacatctttcttctggtcttgcttgtggtcttgctggtctttctgctggtatggctattggaattgttggtgatgctggtgttagagccaatgcccaacagccaaaactatttgttgggatgatcttgattctcattttcgctgaagccctggctctatatggtctgattgtcggcatcatcctttcttcacgcgctggtcagtccagagctgactagacggtgttcgcgttggtggattatgttctctctgtgggtgtggtggtgttggttgagctgcagacctgatcaattctttggtggtgatgatatattggactatggctatgcttctacagtaggtttcaaaccaagctctagctctctcttataataatgtttcgcctcctttttgttagataaactttgcacattttgttccacatttgttggtaacttatttgttttatgttcaaaaattcagtttaattatatgtatcaaacccaacaagaagcacaacctgtcatggctttttggttctctcatgtttaaattttacatttatgatcataattttttatgt

SEQ ID NO: 1167 - DNA, 792 bp, Flaveria ramosissima
catacaatacaaccatacacatacaactcctctctctcgatcctctcatccgattccgatcatgtcttcaaccttctccggcgatgaaacggcaccgttcttcggcttcctaggcgccgctgccgccctagtcttctcctgtatgggggcggcgtacgggacggcgaagagtggtgttggagtggcgtcgatgggtgtgatgaggccggagttggtgatgaagtcgattgtgccggttgttatggctggagtgttggggatttatgggttgatcattgctgtgattattagtactgggattaaccctaaggccaaatcgtattatctttttgatgggtatgctcatctttcttctgggcttgcttgtggtcttgctgggctttctgctggtatggctattgggattgttggggatgctggtgttagagccaatgcacaacaaccgaaactttttgtggggatgatcctaattctcatttttgctgaagctctcgctctatatggccttattgtcggcatcattctttcttctcgagcgggtcagtccagagcggattagacgtttggcattcggtccagtaatcgtgtgttttaccactataaaaattaagcatttgggtggtgttgaagctgagggtggggtgtgctggtttttaccataatttgatgttgagggtaggttggttgtaggctagattctagttttttctgataaataaggttgtctggtattatatgttactatatttatttattttacttgaaatatatatctttggacatgtttatcct

SEQ ID NO: 1168 - DNA, 968 bp, Flaveria ramosissima
gaatcgttgttgcacgattcaatttctgtggagattggatcgatatctgaatcaaaatccccaaatccattcaacttctcttcagatcaaatcaaaaccctaaatcaatcaatcaatcaatcatgtcttcaacgttctccggcgacgaaactgctccgttcttcggcttcctcggcgccgctgccgctctggtcttctcctgtatgggggcggcgtatgggacggcgaagagcggtgttggagtggcgtcgatgggagtgatgaggccggagttggtgatgaagtcgattgtgccggttgttatggcgggagtgttgggtatttatggattgattatagcggtgattattagtactgggattaacccgaaggctaaatcttattatctgtttgatggatatgcacatctttcttctggtcttgcttgtggtcttgctggtctttctgctggtatggctattggaattgttggtgatgctggtgttagagccaatgcccaacagccaaaactatttgttgggatgatcttgattctcattttcgctgaagccctggctctatatggtctgattgtcggcatcatcctttcttctcgcgctggtcagtccagagctgactagacggtggtggtgttggtggattatgttctctctgtgggtgtggtggtgttggttgagctgcatacctgatcaattctttggtggtgatgatatattggactatggctatgcttctacagtaggttataaaccaacctctagctctcttctataataatgtttcacctcctttttgttagatcaactttgcacattttgttccacatttgttggtaacttatttgttttatggtcaaattttcagttttattatctgtatcaaacccaacaagaagcacaacctgtcatggcttttttggttctctcatgtttaaattttacatttatgatcataattttttatgtacg

SEQ ID NO: 1169 - DNA, 840 bp, Flaveria ramosissima
cggatataactcaaagtatcatcgtctcttctctgctgaggagtttggatatctggaacaataaatcatcagatccgatcaatttttctgcagatctgttatcatcatgtcttcaacattctccggtgatgaaacggctccgtttttcggctttctcggtgccgctgcagccctagttttctcctgcatgggggcggcgtacggaacggcgaagagcggtgttggagtggcgtcgatgggagtgatgaggccggaactggtgatgaagtcgattgtgccggtggttatggctggagttttgggtatttatgggttgattattgcagttatcatcagtacagggattaaccctaaggctaaatcatattatctgtttgatggatatgctcacctttcctctggtcttgcttgtggccttgctggtctgtccgccggtatggctatcggaatcgttggtgatgccggtgttagggccaatgcacaacaaccaaaactatttgttgggatgatcttgattctcatttttgctgaagctctggctctgtatggtctgatcgtgggcattattctttcttcgcgtgctggtcagtccagagctgactagaatggattcgtatatgaggtggtgtgtgttaatggtattgtttaaacatatgctattgtcatattgttatcgtcgatttgtggatgtattcttgttggttgtgctagttgcagacatgataaattctttggtggtgatgataccttggtctggaccaacggcctgtggctgtgcgccagctcctacggtaggttttagaccaaactttagccctttgctataataaaaatcgtatt

SEQ ID NO: 1170 - DNA, 785 bp, Flaveria ramosissima
tacacacatataacatcatctctctcgatcatacacacatataacatcatcactctggatcgatcgatatcgaattatcgatcatcagatccgagctaccgatcatgtcttcaacgttctccggcgacgaaacggccccattcttcggctttctcggagccgctgccgccctagtcttctcctgtatgggggctgcttacgggacggcgaagagcggcgttggggtggcgtcgatgggcgtcatgaggccggagttggtgatgaagtctattgtccccgttgttatggctggagttttggggatttatgggttgattattgctgtcattattagcactgggattaaccctaaggcgaaatcttattatctgtttgatgggtatgcgcatttgtcttctggtcttgcttgtggccttgctggtctttctgctggtatggctattggaatcgttggtgatgctggtgttagagctaatgcacagcaaccaaagctttttgtggggatgatcctgatacttatctttgcggaagctcttgctctttatggtcttattgttggcatcattctttcttctagagctggtcagtcgagagcagactaaaaggttggcgattgatggatgatcctgtactcgttcgtgtgttttacggtataacttgaaggatcttttagttgttggttcggtggagttgaggtgtgttgtttttcaaaattgtgggggtaatggtgatgatatgtgttgagagttggtgctagactagagtgtagtttctgctataataag

SEQ ID NO: 1171 - DNA, 619 bp, Flaveria ramosissima
aaactcatctctctcgatactcacatccgattccgatcatgtcttcaaccttctccggcgatgaaacggcaccgttcttcggcttcctcggcgccgctgccgccctagtcttctcctgtatgggggcggcgtacgggacggcgaagagcggcgttggtgtggcgtcgatgggagtgatgaggccggagctggtgatgaagtcgattgtgccggttgttatggctggagttttggggatttatgggttgattattgctgtgattattagtactgggattaaccctaaggccaaatcgtattatctttttgatgggtatgctcatctttcttctgggcttgcttgtggtcttgctgggctttctgctggtatggctattgggattgttggtgatgctggtgttagagccaatgcacaacagccgaaactttttgtggggatgatcctaattcttatttttgctgaagctctcgctctatatggtcttattgtcggcatcattctttcttctcgagcgggtcagtccagagcagattagacgtttggcgttcggtccattaatcgtgtgttttaccactataaatattaagcatttgggtggtgttgaagctgagggtgggt

SEQ ID NO: 1172 - DNA, 654 bp, Flaveria ramosissima
tcaatcaatcatgtcttcaacgttctccggcgacgaaactgctccgttcttcggcttcctcggcgccgctgccgctctggtcttctcctgtatgggggcggcgtatgggacggcgaagagcggtgttggagtggcgtcgatgggagtgatgaggccggagttggtgatgaagtcgattgtgccggtggttatggcgggagtgttgggtatatatggtttgattattgctgtgattattagtacggggattaaccctaaggcgaagtcttattatctgtttgatggatatgctcatctttcttctggacttgcttgtggtcttgcgggtctttctgctggtatggccattggaatcgtgggggatgctggtgttagggctaatgcacaacaaccaaagcttttcgttggaatgatcctaattctcattttcgctgaagctctggccctctacggtcttattgttggcatcattctttcttctcgagctggtcaatccagagcagattaaaagaattgcttgtggatcctgttcactgcgataaagtgagcatttttctttatcctctcgttagatttgtggttcgttctacttgtagactagtttctagttcccaccttcaataagattgttttcatcattatttgttgctattt

SEQ ID NO: 1173 - DNA, 814 bp, Flaveria ramosissima
gccatacaatacaagcagacacatacaactcatctctctcgatcctcacatccgattccgatcatgtcttcaactttctccggcgatgaaacggcaccgttctttggcttcctcggcgccgctgccgccctagtcttctcctgtatgggagcggcgtacgggacggcgaagagtggtgttggagtggcgtcgatgggtgtgatgaggccggagctggtgatgaaatcgattgtgccggttgttatggctggagtgttgggtatttatgggttgattattgctgtgattattagtactgggattaaccctaaggcgaaatcgtattatctttttgatggatatgctcatctttcatctgggcttgcttgtggtcttgctgggctttctgctggtatggctattggaattgttggtgatgctggtgttagagccaatgcacaacaaccaaaactttttgtggggatgatcctaattctcatttttgccgaagctctcgctctatacggtcttattgtcggcatcattctttcttctcgagcgggtcagtccagagcagactagacttttggcgttcggtccggtaatcttgtgttttacagctataaaaattaagcatttgggtggagttgaagctgagggtgggtgtgctggtttttacaataatgtgatgttgagggtaggttgggtgttggccagattctagttttcctgatataataaggctgtctggtattatatgttactatatttatttattttacctgcaaagtatatctttggacatgtttatccttgtatcgaaatgttgtttatt

SEQ ID NO: 1174 - DNA, 874 bp, Flaveria ramosissima
atccatcgttgttgcacgattcaatttctgtggagattggatcgatatctgaatcaaaatccccaaatccattcaatttctcttcagatcaaatcaaaaccctaaatcaatcaatcaatcatgtcttcaacgttctccggcgacgaaactgctcctttcttcggcttccttggcgccgctgccgctctggtcttctcctgtatgggggcggcgtacgggacggcgaagagcggcgttggagtggcgtcgatgggggtgatgaggccggagttggtgatgaagtcgatcgtgccggtggttatggcgggagtgttgggtatttatggtttgattattgctgtgattattagcacggggattaaccctaaggctaagtcttattatctgtttgatggatatgctcatctttcttctggtcttgcttgtggtcttgctggtctgtctgctggtatggccattggaatcgtgggggatgctggtgttagggctaatgcacaacaaccaaaactttttgttggaatgatcctaattctcatttttgctgaagctctggccctatacggtcttattgttggcatcattctttcttctcgtgctggtcaatccagagcagattagaagatttgtctgtggatcctgttcactgcgataaagtgagctattttccttatcctcttgttagatttgtggttcgttctacttctagcctagtttctagttcccaccttcaataagattgtttttatcattatttgttgtcttatttttaggaaaaaaagttttcaagacatatagattgtgatttatatgtattgtacaacttattaataacctgtctttccatgcacttgaagtttggtttcttataataaat

SEQ ID NO: 1175 - DNA, 975 bp, Flaveria ramosissima
catataactagaataagtatcatcgtgtcttctctgcttgaggagcttggatatctacaacaataaatcgtcagatctgatcaatctttctacagatctataatcatcatgtcttcaacattctccggcgatgaaacggctccgttcttcggctttctcggtgccgctgccgccctagttttctcctgcatgggggcggcgtacgggacggcgaagagcggtgttggagtggcgtcgatgggagtgatgaggccggaactggtgatgaagtcgattgtgccggtggttatggctggagttttaggtatctacgggttgattattgcagttatcatcagtacagggattaaccccaaggctaaatcttattatctatttgatggatatgctcacctctcttctggtcttgcttgtggccttgctggtctgtctgccggtatggctatcggaatcgttggtgatgccggtgttagagccaatgcacaacaaccaaaactgtttgttgggatgatcttgattctcatttttgctgaagctctggctctgtatggtctgatcgtgggcattattctttcttctcgtgctggtcagtccagagctgattagaatgggctcgtatctgaggtggtgtgtgttactggtattgtttaagcatatgatattgttattgtcgatatgcggctgtattcttgttggttgtggtagttgcagacatgatcaattctttggtggcgatgataccttggtctggagcaatggcctgtggctgcgtgccagctcctacggtaggtcgtagaccaaactctagctcttcgctataataaattcgtatttttctactttttgatatatatatttgcaatgtgaagaacctctttggacatgttatatgggtttaatttgcacacttgtctcacgattggaatttctttttatctttatcgtcaaagattcatttttattatagtgtgtatc

SEQ ID NO: 1176 - DNA, 783 bp, Flaveria ramosissima
acaatacaagcatagacatacaagtatacaactcatctctctcgatcctcacatccgattccgatcatgtcttcaaccttctccggcgatgaaacggcaccgttcttcggcttcctcggcgccgctgccgccctagtcttctcctgtatgggggcggcgtacgggacggcgaagagtggtgttggtgtggcgtcgatgggagtgatgaggccggagctggtgatgaagtcgattgtgccggttgttatggctggagtgttggggatttatgggttgattattgctgtgattattagtactgggattaaccctaaggctaaatcgtattatctttttgatgggtatgctcatctttcttctgggcttgcttgtggtcttgctgggctttctgctggtatggctattgggattgttggtgatgctggtgttagagccaatgcacaacaaccgaagctttttgtggggatgatcctaattctcatttttgctgaagctctcgctctatatggtcttattgtcggcatcattctttcttctcgagcgggtcagtccagagcagattagacgtttggcgtccggtccagtaatcgtgtgttttaccactataaaaattaagcatttgggtggtgttgaagctgagggtgggtgtgctggtttttaccataatgtgatgttgagggtaggttggttgtaggcctgattctagtttttctgataaataaggttgtctggtattatatgttactatatttatttattttacttgaaatatatatctttgga

SEQ ID NO: 1177 - DNA, 893 bp, Flaveria ramosissima
tatcgttccatctctgctgaggagtttggatatctacaacaataaatcatcagatccgatcaatatttctgcagatctgtaatcatcatgtcgtcaacattctccggtgatgaaacggctccgttttttggctttctcggtgccgctgcagccctagttttctcctgcatgggggcggcgtacgggacggcgaagagcggtgttggagtggcgtcgatgggagtgatgaggccggaactggtgatgaagtcgattgtgccggtggttatggctggagttttgggtatctatgggttgattattgcagttatcatcagcacagggattaaccctaaggctaagtcttattatctctttgatggatatgctcacctctcttctggtcttgcttgtggtcttgctggtctgtccgccggtatggctatcggaatcgttggtgatgccggtgttagggccaatgcacaacaaccaaaactgtttgttgggatgatcttgattctcatttttgctgaagctctggctctgtatggtctgatcgtgggcattattctgtcttcgcgtgctggtcagtccagagctgactagaatgggttcgtatatgaggtggtgtgtgttaatggtattgtttaaacatatgctattgtcatattgttatcgtcgatttgtggatgtattcttgttggttgtgctagttgcagacatgatcaattctttggtggtgatgataccttggtctggaccaacggcctgtggctgtgcgccagctcctacggtaggttttagaccaaactttagccctttttataataaaattcgtatttttcaactttttgctatgttaatgcaatgtgaagaacctccttggacatgttatatggttgatttgcacattt

SEQ ID NO: 1178 - DNA, 921 bp, Flaveria ramosissima
aacacttgaacacgattaaacaaggccaaccatacaattcaaatcatacacatataacatcatctctctcgatcgatcgatagatatcgatcatcagatccgagcatccgatcatgtcttcaacgttctccggcgacgaaacggccccattcttcggctttctcggagccgctgccgccctagtcttctcctgtatgggcgctgcttacgggacggcgaagagcggcgttggggtggcgtcgatgggtgtcatgaggccggagttggtgatgaagtctattgtccccgttgttatggctggagttttggggatttatgggttgattattgctgtcattattagcactgggattaaccctaaggcgaaatcttattatttgtttgatgggtatgcgcatttgtcttctggtcttgcttgtggccttgctggtctttctgctggtatggctattggaatcgttggtgatgctggtgtcagagccaatgcacagcaaccaaagctttttgtggggatgatcctgatacttatctttgcggaagctcttgctctttatggtcttattgttggcatcattctttcttctagagctggtcagtcgagagcagactaaaaggttggcgattgatggatgatcctgtactcgttcgtgtgttttatggtagttataacttgaaggatcttttggttgttggtttggtggagttgaaggtgtgttgtttattccatatttgtgggtggtaaatggtgatgatatgtgttgagagttggtgctagactagagtgtagttttctgctataataagctactggtattatttgttgcaatatttatttggttattatttttgttttttttatttaagtttcgtttacttcgttatattactttaaacttaattactttacgaaggaaagttacg

SEQ ID NO: 1179 - DNA, 692 bp, Flaveria ramosissima
acaattcaagtcatacatacatcataacatcatctctctcgaactctctttcgatcaacatcgatcttcagatccgagctaccgatatgtcttcaacgttctccggcgacgaaacggccccattcttcggctttctaggagccgctgccgccctagtcttctcctgtatgggggcggcgtacgggacggcgaagagcggcgttggagtggcgtcgatgggagtgatgaggcctgagttggtgatgaagtctattgtccccgttgttatggctggagttttggggatttatgggttgattattgctgtgattattagcactgggattaaccctaaggcgaaatcgtattatctttttgatgggtatgcccatttgtcttctggtcttgcttgtggtctcgctggtctttctgctggtatggctattggaatcgtcggtgatgccggtgttagagccaatgcacaacaaccaaaactttttgtggggatgatcctgatcctcatcttcgctgaagcccttgctctctacggtcttattgttggcatcattctttcttctcgagctggtcagtcaagagcagactagaaggttcacaactgatggatgatcctgtactcgctcgtgtgttttacagctataacttgaaggatgttttggtcgtctgtttgggtggtgttgaagctgtgttgtttt

SEQ ID NO: 1180 - DNA, 920 bp, Setaria italica
gcgagcgagagaggccagagacaggcaggcagatcgagcaggatcatcgtggcctgaccccgtccatcctccctccctccgatcctctcaggcgagatctcctccggtccttcccctccacccccatggcggtcgccaccttcagcggcgacgagaccgctcccttcttcggcttcctcggcgccgccgccgcgctcgtcttctcatgcatgggcgccgcctacgggacggccaagagcggcgtcggcgtcgcctcgatgggggtcatgcgccccgagctcgtcatgaagtccatcgtccccgtcgtcatggccggagtcctcggcatctacggcctcatcatcgccgtcatcatatccaccgggatcaaccccaaggccaagccctacttcctcttcgacggctacgcgcacctctcctccggactcgcctgcggcctcgccgggctcgccgccggaatggccatcggcatcgtcggagacgcgggtgtcagggcaaatgcacagcagccaaagttgtttgtgggcatgatcctcatcctcatcttcgcggaagctcttgctctgtacggtctcatcgtcggtatcatcctctcctctcgcgctggccaatctcgtgccgattagagagggggtcagagaagcgcacacgactcatgcatcattgtattcaaagtgttccttttctcggtgaacattgtgcaggatcatgttgagcctgttccaccctttgtaatattattattattattatgccaagacaatcctagctagcacttgtagttcgtgctgttgtatttatttgaaataataggcagcaagcccccggatgtgatgaataaatacgcaagctgcactagtttttgttcattcaatgccttttgatttcgttatgcctgtagtgttttcagtgatttgttt

SEQ ID NO: 1181 - DNA, 985 bp, Fraxinus spp
ttcacgggcttacttgaactctagacaatccttccacttcccaatcaaattcccgtatattcggacagtcacgattcacgagtattttaaggtcccctaaatcgaacgtctctctctctctcttgcgtagttattcgcaaaagaagaaatcttcagatccgatctctgcagatccacgcaagaaaagatgtcatcggcattcagcggcgatgaaacggcaccgttcttcggcttcctcggtgccgcggctgccctagttttctcctgtatgggtgcggcatatggcacggcgaagagtggcgtcggtgtggcgtctatgggtgtgatgcgaccggagctggtgatgaaatcgatagttccagttgttatggctggtgttttgggtatttatggattgattattgctgtcatcatcagtactggaatcaaccctaaggccaagtcatactacttgtttgatggctatgctcacctttcttctggcctcgcttgtggccttgctggcctttctgctggtatggccattggaattgttggggatgctggtgttagagccaatgcacagcagccaaagctctttgttgggatgattcttattctcatttttgctgaagcactggctctttatggtcttattgttggcatcatcctctcttctcgtgctggtcagtctagagcagactagaagaggacatttggcttggcagctgcagtttggactatctatactatgttcctggttagaaatattagtttggtcagcaatgtttttaggctcaatctttatctttatgtggctattgcttggcctaaagagaggacacgctttatttgtgatgatggtagatagaagttctggacttttggttttccctaaataaagttctccattaatttatatgttctgtatgttgcaagacaatgtttgatttgtgtgtaacttgtattattttgtggtaactatctattcttttttatctaatta

SEQ ID NO: 1182 - DNA, 858 bp, Zingiber officinale
  misc_feature (6)..(6): n is a, c, g, or t
  misc_feature (9)..(10): n is a, c, g, or t
  misc_feature (46)..(46): n is a, c, g, or t
  misc_feature (645)..(645): n is a, c, g, or t
  misc_feature (706)..(706): n is a, c, g, or t
  misc_feature (720)..(720): n is a, c, g, or t
gcacgnggnnctttcctccctcgataacgcgagctcaatctccacnttgaggaagaaatcgcgatcggaaggtcaaattttcgcaggattcggagggtttctttgttcttcccggcggagccatgtcatccttcagcggcgacgagacagctccgttcttcggtttcctcggggccgcagccgccctcgttttctcctgcatgggagcggcgtacgggacggcgaagagcggcgtcggtgtggcgtcgatgggcgtgatgcggccggaactggtcatgaagtcgatcgtgcctgtggtcatggcaggagtgctcgggatctacgggttgatcatcgctgtgatcatcagcaccgggatcaaccctaaggctaagtcgtactacctctttgatggatacgctcatctctcttccgggctcgcttgcggtcttgctggtttgtctgcgggcatggcgatcgggatcgtcggcgatgctggcgtccgggccaatgcacagcagccaaagttgttcgttggcatgattcttattctcatttttgccgaagcgctggcactctatggcctcattgttggtatcattctttcctcgcgtgccggtcaatccagggcagattagtcacctaagctgctacttattgcatctncgtatgacttgtgctccttgcacttgcggccttttcttgattttgcatccattctgatggntatgtttgtaccantataacttttcacaaactacatattttgagagattgttttggttaccatgcaaatctgtgatgtagatttgctaatatcatctctgatggataaataattgttattattcctatacgagatccactcaaagatgctac

SEQ ID NO: 1183 - DNA, 819 bp, Zingiber officinale
  misc_feature (45)..(46): n is a, c, g, or t
  misc_feature (54)..(54): n is a, c, g, or t
  misc_feature (60)..(60): n is a, c, g, or t
  misc_feature (759)..(759): n is a, c, g, or t
  misc_feature (763)..(763): n is a, c, g, or t
  misc_feature (789)..(789): n is a, c, g, or t
  misc_feature (793)..(793): n is a, c, g, or t
  misc_feature (802)..(802): n is a, c, g, or t
gcaccttgtctgcctccgcccttccctacctcctccgaagaaacnngggtttcntcgacnccgccctgccccgatgtctagcttcagcggcgatgaaactgcccctttcttcggattcctcggcgcggccgcggcgctcgtcttctcttgcatgggggcggcgtacggaactgcgaagagcggcgtcggtgttgcttccatgggtgtgatgcgcccggagctcgtgatgaagtcgatagttcccgttgtcatggccggagttttggggatctacggtctcatcattgcggtgataataagcaccgggatcaaccccaaggccaagtcgtactacctcttcgatgggtacgcgcacctctcttccgggctggcttgtggcctcgcaggactttcagctggcatggcgattggaatcgtaggagatgctggagtcagggccaacgcccagcagccaaagctctttgtgggaatgattctgatactcatcttcgccgaagctcttgccctctatggccttattgtcggcatcatcctttcctctcgagctggtcaatctcgagcagattaaagaactgcaggagatggtccatttttttgcgctatcttttgttgttacaatgtaatttatttatttaacttttgctacagataagagtcaggcggactcattaaatgctcaataatttgaacttacaagcttgtaatctttgttggctctgtaagttttcggttgccgcaaaaactatactttgcagcaanaacnaaaagattttgattgctttcttcaangatngaatgattngaatgcgagattttctc

SEQ ID NO: 1184 - DNA, 737 bp, Zingiber officinale
tttccttgttctttcaagcggaatcatgtcttccttcagcggcgacgagacagctccattcttcggtttcctcggcgccgcagccgccctcgttttctcctgcatgggagcggcgtacgggacggcgaagagcggcgtcggcgtggcgtccatgggtgtgatgcggccagaactggttatgaagtcgatcgtgcccgtggtcatggcaggagtgctcgggatctatgggttgattattgcagtaatcattagcaccgggatcaaccccaaggcaaagtcgtactacctcttcgacggttacgcgcatctctcttccgggctcgcttgcggtcttgccggtttgtctgcaggcatggcgatcgggatcgtcggcgatgctggtgtccgggccaatgcacagcagccaaagttgtttgtcggcatgattcttattcttattttcgccgaagcactggcactctacggcctcattgtcggtatcattctttcctctcgtgctggtcaatccagagcagactagtcacccaaacggctgcaccttgcacttgtggctttttcttgatggctatgtctgtaccaagataactttttacaaactgtatattccgaccgatcttgtttcggttaatatgtgcaaatctctgttgtaggcttgactacttccgaatttgctacataatccgtgatggattagtaaatggtttctattgttatgagattcattcaaaacctcgtgc

SEQ ID NO: 1185 - DNA, 826 bp, Zingiber officinale
  misc_feature (733)..(733): n is a, c, g, or t
cgtcttctccctcaggaagttagggattcaaacgacctacagacccgccatgtcgagcttcagcggcgacgagaccgcccccttcttcggtttcctcggagccgccgcggccctcgtcttctcatgcatgggtgcggcttatgggacggcgaagagcggcgtcggcgtggcgtcgatgggcgtgatgcggccggagctcgtgatgaaatcgatcgtgcccgtcgtcatggccggagtcctcgggatctatggcctgatcattgcggtgatcattagcacgggcataaaccccaaggccaagtcgtactacctcttcgatgggtacgcccacctttcctcaggcctcgcttgcggcctcgccggactttccgccggaatggcgattgggatcgtcggagatgctggagtcagggcaaatgctcaacagccaaagttatttgtgggcatgattctgattctcattttcgcggaagctctagctctctacggtctcattgtcgggatcatcctctcttctcgagctggtcaatctcgtgcagattaggaaaagaggagtagatgctgtgatctccaaggaaatggagagatgtttatttttgaagtttgttgtgcttttatttagtcgatacaaggaaattttattactcgacccaagattaaaccctagggtttatagtgtgttgcttggatcttgtagatcaagcagaggaccctttttccaccaataacattnccatcgtgggggcaaactgtgaaggacctggatttgtgtagttattaaataaatttcagttgaatgaattgactcagaatgtataaatttggc

SEQ ID NO: 1186 - DNA, 646 bp, Guizotia abyssinica
gatcgatcgatcttcacatccgattaaccgatcatgtcttcaacattctccggcgatgaaacggcaccgttctttggctttctcggcgccgctgccgcactagtcttctcctgtatgggggcggcgtatgggacggcaaagagcggtgttggagtggcgtcaatgggagtgatgaggccggagttggtgatgaaatcaattgtgccagttgttatggctggagtgttaggtatttacggtttgattattgctgtgattatcagtaccggaattaaccctaaggcgaaatcgtattacctttttgatggatacgctcatctgtcttccggtcttgcttgtggccttgctgggctctctgctggtatggccattggaattgttggtgatgcaggtgttagggccaatgcacaacaaccaaaactttttgtggggatgatcctaattctcatttttgctgaagctcttgctctatacggtcttattgtcggcatcattctttcttctcgagcgggtcagtccagagcagactagcggttcagcattcggtccggtaatagtgtgttttacagctacaaaattaagcattgggtggagttgaagtaagggtgcagattgattgttgtaagctaaattctatttttctgat

SEQ ID NO: 1187 - DNA, 941 bp, Carpinus betulus
acttttggtgtagagaacaaaattggacacgcgcacacagagggagagatccgaagctccgaagctccctgaaacactaacaaaaacgctcagatcccaacgacgtcgtcgtagatccacgatccagaatgtcttcattcagcggcgatgaaacggcaccgttcttcggcttcctcggcgctgccgcggccctcgttttctcctgtatgggagctgcttatgggacagcaaagagtggggttggcgtggcttcaatgggtgtgatgaggccggagctggtgatgaaatccattgttcctgttgttatggctggagtgttgggtatctacggccttattattgccgttatcatcagtactgggatcaacccaaaagccaagtcatattaccttttcgacggttatgcacacctctcgtctggtcttgcttgtggtcttgctgggctctctgctggtatggcgattggtattgttggcgatgctggagttagagccaatgcacagcagccaaaactttttgttggaatgattctcattctcatcttcgctgaagcacttgccctctatggccttattgtcggcattatcttgtcttctcgagctggccagtccagagcagactaagaatggtgttgttaccaaatattcttttactacttatttgtccacctgatagtaatggctggatcgcacttggagtgttctctagaattgtttatgtggaagtaacttgcgatctacccagcaatttggtggtattgtgctcgtagaagtaggatcgagtttctctgcctaataatagcttgtgaagctgtactctcgttttatttatctattgatgtattttttccgttacaactatcaactggtataggatttatggtcatggaactggcgcatgtatgattttgtttaactatttcaaatgtctgtctttatctg

SEQ ID NO: 1188 - DNA, 890 bp, Actinidia deliciosa
ctctctctctctctctctctctcagcaaatccgaagaatttcccagatctgatcgatttccctgcaaatcgaaacgcgcaaaagcagataacaatgtcttcaacgttcagcggcgatgaaacggcgccattcttcggcttcctcggcgccgcagctgccttagtcttctcctgtatgggagctgcgtatgggacggcgaagagcggggttggagtggcgtcgatgggggtgatgaggccggagctggtgatgaagtcgatcgtgccggtggttatggctggtgtgctcggtatctacggattgattattgctgtgatcatcagtactgggattaaccctaaggccaagtcgtattacctttttgatggctacgcgcacctgtcgtctggtcttgcttgtggcctagctgggctttctgctggtatggctattggtatcgtaggcgatgccggtgttagagccaatgctcagcagcctaaactttttgttgggatgatcctcattctcatctttgccgaagcgcttgctctctatggcctcattgtcggtattatcctctcttctcgagctggtcaatcgagggcagactaaaacagggcatttggttggaggtggttactcgttaaaattattttgatgttctatctggttagaaatcgtaatttggctgaggacgtgtcttttgcttcagaattcttctatttgatttgccattgcttggtccggtggattgggtggttgctatgtgttaatggtggaatgtagattagtggctgggtctttcaataatatactgtaatgtttatttttctataataatttccggtattgtttcttcagaccccttgatatcaagttctcccctcccagagtagtaagatttctggtaa

SEQ ID NO: 1189 - DNA, 992 bp, Actinidia deliciosa
  misc_feature (777)..(778): n is a, c, g, or t
  misc_feature (842)..(842): n is a, c, g, or t
  misc_feature (869)..(869): n is a, c, g, or t
  misc_feature (894)..(894): n is a, c, g, or t
aactgaggacagcaatcaaacaatctccagacctctccctctgtctctctctctgagcaaacccgaagaatttcccagatcggatcgatttccctgcaaatcgaaaccctcgaaagcagtcaacaatgtcttcaacgttcagcggcgatgaaacggcgccgttcttcggcttcctcggcgccgcagctgccttagtcttctcctgtatgggggccgcgtatgggacggcgaagagcggggtcggagtggcgtcgatgggtgtgatgaggccggagctggtgatgaagtcgatcgtgccggtggttatggctggtgtgctcggtatctatggattgattattgctgtgatcatcagtaccgggattaaccctaaggccaagtcgtattacctttttgatggatacgcgcacctgtcgtctggtcttgcgtgtggcctggctgggctttcggctggtatggctattggtatcgtaggggatgccggtgttagagccaatgctcagcagcctaaactttttgttgggatgatcctcattctcatctttgctgaagcgcttgccctctatggcctcattgtcggtattatcctctcttctcgggctggtcaatcgagggcagactaaaacagggcatttagttggagatggctactcgttaaaattatttcgatgttctatctggttagaaatcgtaatttggctgaggacgtgtcttctgcttcagaattcttctatgtgatttgccattgcttggtcccgtggattgggtggatgcttnntgtggaatgtagattagtggctagttatttcaataatatactgtaatgtttatttttatataanaatttccggtattgtttcttcagaccnttgatatcaggatctccccttccanagaagcaagatttctggtaattcttggttcacttcaagtaattgtggaatacttgaatataacgtcgtctgatcattcttgggacgcaaaaaaaaaaa

SEQ ID NO: 1190 - DNA, 896 bp, Actinidia deliciosa
acagaacagagggcgagagatctgatcggagactcgaacaatctctctctctctctctacatatttttcactgaattttccgaaatccaaacaacgtttcatcgcaagaaaaaccaaaatgtcttcgacattcagcggagatgaaacagctcctttcttcggctttctcggcgctgccgctgccctcgtcttctcatgtatgggagcggcctatgggacggcgaagagcggcgttggtgtggcgtcgatgggagtgatgaggccagaactggtgatgaagtcgattgtgccggtggttatggcgggtgtgttgggtatttatggcctgatcattgctgttatcatcagtactgggattaaccctaaggccaagtcttattacctgtttgatgggtatgcccacctttcctctggtctcgcttgtggtctcgctgggctctctgctggaatggccatcgggatcgtgggtgatgccggtgttagagctaatgcacagcaaccaaaactttttgttggaatgatcctcattctcatctttgccgaagcgctggcgctctacgggctcattgttggtatcattttgtcttctcgagctggtcaatcgcgagcagactgaggacgagggtttgaaaagatctttaaatcttcttatgtgagttcctcaaattcttcagtttaaaagtaccctaatatattaattttgtggttgctcggtgctgtttgtagagtaggatttgagttttatctgcagaataaaagctcatgaagcttcctgtttggtttatctattcatgtactctttgcctttacaacttcagacatagacatgtgtagagactattatttgggaactagtgtgtgtattatttgttatttatgaactcagggttccacta

SEQ ID NO: 1191 - DNA, 838 bp, Actinidia deliciosa
ctctctcaaacacacatattttccactgaattttcttgagatccagacaacgtttcatcgcaaggaaatccaaaatgtcttcgacattcagcggagatgaaacagctcctttctttggctttcttggcgctgctgctgccctcgtcttctcatgtatgggtgcggcctatgggacggcgaagagcggcgttggggtggcgtcgatgggcgtgatgagacctgaattggtgatgaagtcgattgtgccggtggttatggccggtgtgttgggtatatatggcttgattatagctgttatcatcagtactgggattaaccctaaggccaagtcttattacctgtttgatggttatgcccacctttcctctggtctcgcttgtggtctcgctgggctctctgctggaatggccatcgggatcgttggtgatgctggtgttagagctaacgcacagcaaccaaaactttttgttggaatgatcctcattctcatctttgccgaagccctggcgctctacggcctcattgttggtatcattttgtcttctcgagctggtcaatcgcgagcagactgaggacaaggaaaaaatctttaaatcttcttatatcagttcctcaaattcttcagtttaaaaatgccccaatatatttatgttgtggttgctcggtgctgtttgtagagtagtatttgagttttatctgcagaataaaagctcctgaagcttcctgttggttttatctattcatgtaactttgccattacaatttcggacctgtctagacactattatttgggaactggtgtgtgtattatttgttatttatgaactcagggttccac

SEQ ID NO: 1192 - DNA, 928 bp, Actinidia deliciosa
  misc_feature (461)..(461): n is a, c, g, or t
cttttatcaatttgtgaacagcatagatagacagaacggagggcgagaggcctgatctgagactctctctctctctcacgcatattttccactgaattttcttgagatccagacaacgtttcatcgcaaggaaatccaaaatgtcttcgacattcagcggagatgaaacagctcctttctttggctttcttggcgctgctgctgccctcgtcttctcatgtatgggtgcggcctatgggacggcgaagagcggcgttggggtggcgtcgatgggcgtgatgaggcctgaactggtgatgaagtcgattgttccggtggttatggccggtgtgttgggtatatatggcttgattatagctgttatcatcagtactgggattaaccctaaggccaagtcttattacctgtttgatggttatgcccacctttcctctggtctcgcttgtggtctcgctgggctntctgctggaatggccatcgggatcgttggtgatgctggtgttagagctaacgcacagcaaccaaaactttttgttggaatgatcctcattctcatctttgccgaagccctggcgctctacggcctcattgttgggatcattttgtcttctcgagctggtcaatcgcgagcagactgaggacgatgaaaaaatctttaaagcttcttatgtcagttcctcaaattcttcagtttaaaaatgccctaatatatttattttgtggttactcggtgctgtttgtagagtaggatttgagttttatctgcagaataaaggctcctgaagcttcctgtttggttttatctgttcatgtaactctgccattattacaatttcggacctgtctagagactattatttgggaactggtgtgtgtattatttattatttatgaactcagggttccactactgcgttaaaaaaaaaaa

SEQ ID NO: 1193 - DNA, 1236 bp, Actinidia deliciosa
tctctgcaacagtcataccgatcgaaacctcctatcttccctaatctctctctgtgaacgaaggaaaatgtcgtctacgttcagtggcgatgaaactgctccgttcttcggcttcctcggcgcagcagctgccctcgttttctcctgtatgggagctgcctatggaacagcgaagagtggtgtaggtgtggcctcaatgggtgtcatgagaccagagcttgtgatgaagtcaattgtgcccgttgttatggctggtgtgttgggtatttacggtttgattatcgctgtgatcatcagtactggaattaacccaaaggccaagtcctattacctcttcgatggatatgcacacttgtcgtctggtcttgcttgtggtctcgctgggctttcagccggaatggctattggaattgttggtgatgctggcgttagagctaatgcacaacagcctaagctttttgttggaatgattctcattctcatctttgccgaggcactggcattgtatggtctcattgttggcatcatcctctcttcccgtgctggacaatcacgagcagattagagaattataacctcaatgattctttgtattctcaggtcagtgatgctagtttggaaagtgcaatgtttcttcttgatattatggtgcactcaatttctgtgttgtaatttatgctgattgtattattgggaacattttcctccctgaaataaggctgtgaaagctagtttcttccatttgcattttgttgtgctagtattgatggaggcactattcatctttgtgatatccgtttctatggtagaaggttgttttttcagattttaaaaatcaacccgtctctcccatcacagccatatctccccccaaattaaacccctctctctctctctctcagttctaatttgttgtttgaacgtccaggccagctcctcaaccacggctaggccaggccaggccagctcttcgcattcgacaacggagaacgtccaggccaactcctcaaccacgttggccggccgaccaccgctggacctaacagagttctgctccgacggagtcccaaagcaagaatcgacgactcactgtaatttgctacggcgggaagcgacccaccaaaaccatatcttttaccgaggtgcttggaactttggtttctgggtcttgggtctcgagtgcgtggcactaatgtgttgcttgcacgcatctattccacaatctcactcttttga

SEQ ID NO: 1194 - DNA, 738 bp, Actinidia deliciosa
  misc_feature (685)..(685): n is a, c, g, or t
gaacagagggcgagagatctgatcggagactcgaacaatctctctctctccatatttttcactgaattttccgaaatccgaacgacgtttcatcgctccaaaatgtcttcgacattcagcggagatgaaacagctcctttcttcggctttctcggcgctgctgctgccctcgtcttctcatgtatgggagcggcctatgggacggcgaagagcggcgttggtgtggcgtcgatgggcgtgatgaggccagaactggtgatgaagtcgattgtgccggtggttatggcgggtgtgttgggtatttatggcctcatcattgctgttatcatcagtactgggattaaccctaaggccaagtcttattacctgtttgatggttatgcccacctttcctcgggtctcgcttgtggtctcgctgggctttctgctggaatggccatcgggatcgtcggtgatgccggtgttagagctaatgcacaacaaccaaaactttttgttggaatgatcctcattctcatctttgccgaagccctggcactctacgggctcattgttggtatcattttgtcttcacgagctggtcaatcgcgagcagactgaggacgagggtttgaaaagatctttaaatcttcttacgtgagttccccaaattcttcagtttaaaagtaccctaatatattaattntgtggttgctcggtgctgtttgtagagtaggatttgagttttatctgcagaat

SEQ ID NO: 1195 - DNA, 930 bp, Lactuca sativa
gcggggatcattcactaacatatataacgtcatctcccctttcgctctttctctccctctctcgatcctcagatccgatcaatttctctgcaaaatataaaccctaaacttgatcgtaatcaaccgatcatgtcttcaacattctccggcgatgaaacggctccgttcttcggctttctcggtgccgctgccgcgttagtcttctcctgtatgggggcggcgtacgggacggcgaagagcggtgttggagtggcgtctatgggagtgatgaggccagagctcgtgatgaagtctattgtgccagttgttatggctggagtgttgggtatttacggtttgattatcgctgtgattatcagtactggaattaaccctaaggctaaatcctattaccttttcgatgggtatgctcatctttcctccggtcttgcttgtggccttgctggtctttctgctggtatggctatcggaatcgtcggtgatgctggtgttagagccaatgcacaacaaccaaaactatttgttgggatgatcctgatcctcatttttgctgaagctcttgctctgtatggtctcattgttggcatcattctttcttctcgtgctggtcaatccagagcagattagaaggtattcattcagtggcataatcgtgtgttctacagctataacttatgtgtttttttgatctttcattttgaggagagttgaagctgtagttatgtcgttttttcataatttgtgggtggtaaatggtgatgatatgtgtgttgagggggtagggtgtagggtagattgtgggttttcactataataaagatgtctcatactctcattactcgtattatttatttatttgcaaacaacatgttgggatatgtatgctttcgttgtatttgatttgcttgattttgaaaaagatattcataa

SEQ ID NO: 1196 - DNA, 921 bp, Lactuca sativa
gccgtacaacgtgtataaataccatcatctcttcttctctgtggagtttggatatctagaaaacaaaatcctcagatccgatcaatttttctgcagatctacactccaaattcaatcatcatgtcttcaacattctccggcgatgaaacggctccgttcttcggcttcctcggtgccgcggcagccctggtcttctcctgcatgggggcggcatacgggacagcgaaaagcggcgttggtgtggcgtcgatgggagtgatgaggccggagttggtgatgaagtcgattgtgccggtggttatggctggagtgttaggtatttacgggttgattattgctgtgattatcagtaccgggattaacccaaaggccaaatcttattatctctttgatggatacgctcatctttcctctggtcttgcttgtggccttgctggtctttctgctggtatggctatcggaattgttggtgatgctggtgttagggcaaatgcacaacaaccaaaactctttgttgggatgattttgattttgatttttgctgaagctttggctttgtatggtcttattgttggcatcatcctttcttctagagctggccaatcaagagcagactagaaggatatacagaggtggtgtgtctgtgtttccattattattaattaattaaaagcaagcatatgattattatccactttgtaattgttggttttgctacaaacaaaactaattctttggtgcctgtcgtaggttttagaccaaattctagctctcttgttataataagattcgtctctttttcgtatattatttttcgattttggacatgaaatagataattttggagatttatcccacatttgtaaattggtgggaactctttttttatcatatggtcaagattttggttttgttgcactt

SEQ ID NO: 1197 - DNA, 879 bp, Lactuca sativa
atattcatactccggcgaccaattcaccggaaaacgaaatccattacgatctctcccgcagatcaaaagttgtaattcatgtcgtctactttcagcggcgatgaaactgctccgttcttcggcttcctcggagccgcagcagccctcgttttctcctgtatgggagcggcgtatgggacggcgaagagcggcgttggtgttgcctcgatgggagtgatgaggccggagctggtaatgaagtcgattgtgccggttgttatggcgggagtgttaggtatttacggattgatcattgctgttattattagtaccggaatcaatccaaaggcgaaatcgtattacttgtttgatggttacgctcatctgtcatctggtcttgcttgtggtcttgccggactttccgccggaatggccattggaatcgtcggcgatgctggtgttagggcaaatgcacagcagccaaagctttttgttggaatgattttgattcttatctttgctgaagcacttgcattatatggtctcattgttggcatcattctctcttcgcgtgctggtcagtccagggccgattaagtctttttacactttcttatccttccattatcaggttagtttcaccagtgttcagaaggattcaaaatcatgcttttatctttgtgttgttaaattgtttgttagttattaaactggatgacacttttgcccttgaataaagccttaaagctaccattgtttattttcttattttgtatcataaatacatgaaggtgaaacggtgtatgattatttatttattaagctcattgttaggtgttgcacaataaaaaaaacaatgcacaaatcaaaaatcaaaatgaaaccgagacggccgacaag

SEQ ID NO: 1198 - DNA, 794 bp, Lactuca sativa
atattcatactccggcgaccaattcaccggcaaacgaaatccattacgatctctaccacagatcaatagttgcaaatgtcgtctactttcagcggcgatgaaactgctccgttcttcggcttcctcggagccgcagcggccctcgttttctcctgtatgggagcggcgtatgggacggcgaagagcggcgttggtgttgcatcgatgggagtgatgagaccggagctggtaatgaaatcgattgtgccggttgttatggcgggagtgttaggtatttatggattgatcattgctgttattattagtaccggaatcaatccaaaggcgaaatcgtattacttgtttgatggttacgcacatctctcatctggtcttgcttgtggtcttgccggactttccgccggaatggccattggaatcgtcggcgatgctggtgttagggcaaatgcacagcagccaaagctttttgttggaatgattttgattcttatctttgctgaagcacttgcattatacggtctcattgttggcatcattctctcttcgcgtgctggtcagtccagggccgattaagtctttttacaatttctcatccttccataatcaggttagtttcaccagtgttcagaaggattccaaatcgtgcttttatctttatgttgttaatttgtttgttagttattaaactggatacacttttgcccttgaataaagcctcaaagctaccattattgtttatttgcttattttgtatcataaatacgtgaaggtgaaacagtgtatggttatttatt

SEQ ID NO: 1199 - DNA, 671 bp, Liriodendron tulipifera
  misc_feature (18)..(18): n is a, c, g, or t
  misc_feature (60)..(60): n is a, c, g, or t
agagagagagagagaganagagagagcaaatcaaaaccctagatttgcagcagaaaaagnaaggagaagatgtcttctactttcagcggcgatgaaactgctcccttcttcggcttcctcggcgccgctgctgccctcgtcttctcctgcatgggggccgcctatggcacggcgaagagcggtgtcggcgtcgcgtcgatgggtgtgatgcgcccggagctcgtcatgaaatcgatcgtgcccgtcgtcatggctggggtccttggaatctacggcctgatcatcgccgttattataagcactgggatcaacccgaaagcgaaatcatattatcttttcgatgggtatgcgcacctctcatcggggcttgcttgcgggcttgctggtttgtctgctggtatggcgattgggatcgtcggtgacgctggtgtccgggccaatgctcagcagccgaagctgttcgtgggtatgattcttatactcatctttgcagaagcgctcgctctctacggtctgattgttggtattattctctcgtctcgagctggccaatctcgagcggattgaaaatcaagccccatggctttttggaaacccttggtatgtctacatagaacatcgaacagcactgaacttgcaattacttttagttttctgaatctcttggtgat

SEQ ID NO: 1200 - DNA, 927 bp, Liriodendron tulipifera
  misc_feature (772)..(772): n is a, c, g, or t
gagagagagagagaagcgaaattccacggctatttccccgatcaacccacagaagaagaattcctagatccgatcacttcctctctcgctctctcaatcaaaaccctagaaatgtcttctactttcagcggcgatgaaacggccccgttcttcggcttcctcggtgccgcagcagccctcgtcttctcctgcatgggggccgcttatgggaccgccaagagtggggtcggtgtggcctcgatgggcgtcatgaggcctgaactcgtgatgaaatcgatcgtccccgtcgttatggctggtgtgttgggtatctacggtttgattatcgctgtcatcatcagcaccgggattaaccctaaggcgaaatcgtattatctgttcgacgggtatgctcacctttcgtctggtcttgcttgtggcctcgctggcctctcggctggaatggctatcggcattgtcggagatgccggcgtcagagccaatgcacagcagccaaaactttttgttggaatgatcctcatcctcatctttgccgaagcgctggcattgtatggcctcattgtgggcatcattctgtcttctcgagcaggccaatcaagggctgactgagggagcaaaagagagagatacaggcatgtctggtaactctcatgtggtttgtctgttccctttcaaccttcatttcttctaaggttactagttcagtacaaaatgtattctcataaattttcatcatggacacagtcatgctggtttaatgtccctcctttantgagccatttgtagcagtagcagtggtttttttttttttggttgtggaaataaggcttgggaaggtatttaagtttggaagctgtattttgcagatgtaagttttagatatttgcagaactgtcacttttgttagtgccggactttgttattttc

SEQ ID NO: 1201 - DNA, 889 bp, Zea mays
tttagtccacagaaagacgaaagaagaaacggggcgactcgcagatccaagcggagaagctgcgtcgtggcctgaccctgtccgtcctctccggtcggcgagagcaagaagagatcccgcgccgtcctcttctccacctccacctccacccatggcggcctccaccttcagcggcgacgagacggcgcccttcttcggcttcctcggcgccgccgccgcgctcgtcttctcctgcatgggcgccgcctacgggacggccaagagcggcgtcggcgtcgcctccatgggcgtcatgcgccccgagctcgtcatgaagtccatcgtccccgtcgtcatggcgggagtactcggcatctacggcctcatcatcgccgtcatcatctccaccgggatcaaccccaaggccaagccctacttcctcttcgacggctacgcgcacctctcctccggactcgcctgcggcctcgctggcctcgctgccggcatggccatcggcatcgtcggagacgccggagttagggcgaatgcacagcagccaaagttgtttgtgggcatgattctgatccttatcttcgcagaagctcttgctctgtacggtctcatcgtcggtatcattctctcatcccgtgcaggccaatctcgcgccgattagaaggcttgatatacgccacactgagtcatctgccattgtattcaaagtgttcttttctcggtgaacaatgtgagggatcatgttgagcctgttccacctttgtaacattatattgctattatgtgaagacaaacctagctagctgttgcagttatgctgttgtacttgtatttgtttgaaaataataggcagcgagccccggatgtgatgaataataagcaagctggactagttgtt

SEQ ID NO: 1202 - DNA, 904 bp, Cucumis melo
cgattattcgaagataacgtggagagattttttatagaataaaaggcttggaagagcgaaaaacataaaatttgagtatccgaaggaaaaacgcagaatcagagagtaaagaaaaagaaaagaaaaaacttcagatctgatctgatcggagatcctttcttctctctctatcggaaaatatgtcgtcaaccttcagcggtgatgaaacggcacccttctttggctttctcggcgctgctgcggcccttgttttctcctgtatgggagctgcttacgggaccgcaaagagcggtgttggtgtggcgtcaatgggagtgatgaggccggaattggtaatgaagtctattgttccggtggttatggctggagttttgggtatttatggtttgattattgctgtgattattagtacggggattaaccctaaagctaaatcttattaccttttcgatggttacgctcatctttcctctggtcttgcttgcggcctcgccggtctatctgctggcatggctatcggaatcgtcggcgatgcgggcgtcagggccaatgcacaacaacctaagctttttgttgggatgattctcattctaattttcgccgaagcacttgctctttatggacttattgttggtattattctctcctctcgagctggtcagtcaagagctgattaagtgatgaaatgttttgagcttggaatttgtgtattggtctctctttttttctttcttttatctcatgaattgtttttgtagttctatgattagaaatggtcatgactaagttttttactttctcaaatattcttgtggtcgtgtgatttctgtaccacatatattctgtactcataaggatttggaatcaattgttctctcaataaacacaaaaacattgcttccaa

SEQ ID NO: 1203 - DNA, 836 bp, Cucumis melo
aaggagtggaggaagagagagattgagagcggttccgttcaacccagaaaagatgtcgtccaccttcagcggcgatgaaacggcaccctttttcggcttcctaggcgccgctgcagctctcgtcttctcctgtatgggagctgcttatggaactgcgaagagcggggtgggagttgcgtctatgggagtaatgaggcctgaacttgtgatgaagtcaattgttccggtggttatggctggagttttgggtatttatggtcttattattgctgtgattattagtacagggattaaccctaaggccaaatcttattacctcttcgatggttacgcacatctctcctctgggcttgcttgtggacttgccggtctgtccgctggcatggctatcgggatcgttggtgatgctggtgttagagccaatgcacagcagcctaagctttttgtagggatgattcttattttaatttttgccgaagctttggcactctatggacttattgtgggcatcattctctcttcccgagctggtcagtcaagagccgattgagtggatgctgtatgtggactcgagtttgtgtagtatatgtctcttcttttgttttttggtcaagaattggtttttgtactctttaagtaaatgggttattattatggtttaagcctactgtcaaatgtcttgtgaggtgtgattgctaataccacacgaatcctatagttgttatatatggatttggaattaattattcttctcaataaaatattaaactctattacttttaacattactccaattttaatgaagcttccctccctctaagtctgggtgtttgagg

SEQ ID NO: 1204 - DNA, 869 bp, Momordica charantia
gagaggagacgacgaagtggcctgtgggcatatttgcagaagagcttgagatctgatctaatcggagaccttcgtcttcaccggcggacccagaaagatgtcgtcaaccttcagcggcgatgaaacggctcccttcttcggcttcctcggcgccgctgcggcactcgttttctcctgtatgggagctgcttacgggacggcgaagagcggggtcggagtggcgtctatgggagtaatgaggcctgaattggtgatgaagtcgattgttccggtggttatggctggagttttgggtatatatgggcttattattgctgtgattattagtactgggattaaccctaaagccaaatcttattacctcttcgatggctacgcgcatctctcctctggtcttgcttgtggccttgccggtctgtccgctggcatggctatcgggatcgtcggcgatgcgggtgttagagccaacgcacagcagcctaagcttttcgtcgggatgattcttattctaattttcgccgaagcgcttgcactctatggacttatcgtggggattattctctcttctcgagctggtcagtcaagagctgattaagtggatgctttgtgtgtggagtttgtgtagtatgtctctcctcttttttgtcaagaattggttttgtactctgagtaaaatgggttaccgtgattaagcctactttctcaaatcacaaatgttcttatgaggtgtgatttctataccgcacggattctgtagctgttgtatggatttggaattaattattcttctcaataaagattaaactttgtttcctctgtttctgcacctaacagtttgattaatgacaattcaaatatagcttgtcaac

SEQ ID NO: 1205 - DNA, 977 bp, Mimulus guttatus
ttttattatataaaaggccttaattaatccaacaaaaagactgtttattaatctctctgcgcctgtggattctcgctcttaaacagaagatactttcggatccgatctctgcagaaaaccaagtcggaaaaaaagatgtcgtcaaccttcagcggcgatgaaacagctccctttttcggcttcctcggcgccgccgccgctctagtcttctcctgtatgggagcggcgtacggcacggcgaagagcggcgtcggagttgcttcgatgggtgtgatgaggccggagctggtgatgaaatctattgttccggtggttatggccggagtgttgggtatttacggtctgattatcgctgtgattatcagtactggtattaaccctaaggcaaagtcttactacctatttgatggatatgctcacctttcttctggtctctcttgtggtctcgccggccttgctgctggtatggccatcggaattgttggcgatgccggtgtcagagccaatgcacaacaaccaaagcttttcgtagggatgattcttatccttatttttgctgaagccttggctctttacggtctcatcgttggcatcatcctctcttctcgtgctggacagtcgagagcagactaagaagtacttctcactcgattgtagttgagatttttggcttgaagtttatgtttggggatgtagagaagtttgatttctcgtgaataaaagctcttctcgtatttttatggcaaggaccatatttgatctgtataaaccaattcatttaatattttgtttgttgaaatttcatactttatttttcctgagctttatgatgaattttggtgatatgaactgctggttaattttctgtctccagtattaggtactgtgaaattgctgtgtgagattcaccttgtgaaccttacatattttattctacaatgctgattttagagataaaatcagcaaataattctttt

SEQ ID NO: 1206 - DNA, 1030 bp, Mimulus guttatus
ttttattatataaaaggccttaattaatccaacaaaaagactgtttattaatctctctgcgcctgtggattctcgctcttaaacagaagatactttcggatccgatctctgcagaaaaccaagtcggaaaaaaagatgtcgtcaaccttcagcggcgatgaaacagctccctttttcggcttcctcggcgccgccgccgctctagtcttctcctgtatgggagcggcgtacggcacggcgaagagcggcgtcggagttgcttcgatgggtgtgatgaggccggagctggtgatgaaatctattgttccggtggttatggccggagtgttgggtatttacggtctgattatcgctgtgattatcagtactggtattaaccctaaggcaaagtcttactacctatttgatggatatgctcacctttcttctggtctctcttgtggtctcgccggccttgctgctggtatggccatcggaattgttggcgatgccggtgtcagagccaatgcacaacaaccaaagcttttcgtagggatgattcttatccttatttttgctgaagccttggctctttacggtctcatcgttggcatcatcctctcttctcgtgctggacagtcgagagcagactaagaagtacttctcactcgattgtagttgagatttttggcttgaagtttatgtttggggatgtagagaagtttgatttctcgtgaataaaagctcttctcgtatttttatggcaaggaccatatttgatctgtataaaccaattcatttaatattttgtttgttgaaatttcatactttatttttcctgagctttatgatgaattttggtgatatgaactgctggttaattttctgtctccagtattaggtactgtgaaattgctgtgtgagattcaccttgtgaaccttacatattttattctacaatgctgattttagagataaaatcagcaaataattctttttttctttcttttttcttttggcatcttgcaaataattctacaagattaaattt

SEQ ID NO: 1207 - DNA, 1168 bp, Mimulus guttatus
tcatccaactactcaactccttcttcaccactctctctctctctatctctctctctctaccacttctcgcctcagatccgatcttctcagaaatccaaatcgatcaaacatgtcgtcaaccttcagcggcgatgagacggcgcccttctttggtttcctcggcgccgccgcggcactcgtcttctcctgtatgggagcggcgtacggcacggcgaagagcggcgtcggcgtggcgtccatgggtgtgatgaggccggagctggtgatgaaatccatcgtacccgtggttatggctggtgtgttgggtatttatggcctgattattgctgttattattagtaccggtattaaccctaaggccaagtcttactacctcttcgatggatacgctcacctttcttctggactctcttgtggtctcgccggccttgctgccggtatggccatcggaatcgtcggagatgccggtgtcagagccaacgcacaacagccgaagctcttcgtgggtatgattcttatccttattttcgctgaagccttggctctatacggtctcattgtaggcatcatcctttcttctcgtgccggtcagtctagagctgactagagagaggatcacacatctctcaagaattgttgcagtttcttgctatttattaagtaagaattttttattttcacgttcccccctgtctagcatagtagtattgtctgtggcggtgttttttaggttcgagcgtgttatatttgtgcgtgtggcaattgcttggcctgaagaatttgagcatttgatgtccgtggcggtagattgtagatgagaaaaattgatttttccctgaataatgttttttctttcgtatttgcctgtggtgctttattttgcaagaaacctatttgatctgtgtaaaacaatagcattgtattattttggtgaaactccaatcgattttttcttttttaatatttaaactccaataattatggtggttccattttcagcattaggccttatcgaagggaaggtaaggtgtgactctcttaactattggtttagtaggtaattttcctgcttgcaatgtgagtatgcagaattgtgaagattttatgtcgtcgggacaattgttgtttatccggacgagtaaaactgattcgatcatattttttcgac

SEQ ID NO: 1208 - DNA, 1194 bp, Mimulus guttatus
tcatccaactactcaactccttcttcaccactctctctctctctatctctctctctctaccacttctcgcctcagatccgatcttctcagaaatccaaatcgatcaaacatgtcgtcaaccttcagcggcgatgagacggcgcccttctttggtttcctcggcgccgccgcggcactcgtcttctcctgtatgggagcggcgtacggcacggcgaagagcggcgtcggcgtggcgtccatgggtgtgatgaggccggagctggtgatgaaatccatcgtacccgtggttatggctggtgtgttgggtatttatggcctgattattgctgttattattagtaccggtattaaccctaaggccaagtcttactacctcttcgatggatacgctcacctttcttctggactctcttgtggtctcgccggccttgctgccggtatggccatcggaatcgtcggagatgccggtgtcagagccaacgcacaacagccgaagctcttcgtgggtatgattcttatccttattttcgctgaagccttggctctatacggtctcattgtaggcatcatcctttcttctcgtgccggtcagtctagagctgactagagagaggatcacacatctctcaagaattgttgcagtttcttgctatttattaagtaagaattttttattttcacgttcccccctgtctagcatagtagtattgtctgtggcggtgttttttaggttcgagcgtgttatatttgtgcgtgtggcaattgcttggcctgaagaatttgagcatttgatgtccgtggcggtagattgtagatgagaaaaattgatttttccctgaataatgttttttctttcgtatttgcctgtggtgctttattttgcaagaaacctatttgatctgtgtaaaacaatagcattgtattattttggtgaaactccaatcgattttttcttttttaatatttaaactccaataattatggtggttccattttcagcattaggccttatcgaagggaaggtaaggtgtgactctcttaactattggtttagtaggtaattttcctgcttgcaatgtgagtatgcagaattgtgaagattttatgtcgtcgggacaattgttgtttatccggacgagtaaaactgattcgatcatattttttcgacaacattgtctccttaattttctttca

SEQ ID NO: 1209 - DNA, 976 bp, Mimulus guttatus
acacaaacacacgtagagagagagagaggagagagagaagagagagagagagagatctaaaatccgaaccctaacagaagactgaataaatcgaaattcagaagtaatttcgatcggaaataatgtcttcgaccttcagcggcgatgaaactgcccctttcttcggcttcctcggcgccgccgcggccctcgtcttctcctgcatgggtgcggcttacgggacagcaaagagtggcgtcggtgtggcgtcgatgggggtaatgaggccggagctcgttatgaagtcgattgtgccagttgtcatggctggtgttttgggtatttacggtttgattattgctgtaattatcagcacgggtattaaccctaaagccaaatcttattaccttttcgatggttacgcacatctctcgtctggcttgtcttgtggccttgctggacttgctgctggaatggctattgggattgtcggagatgctggtgttagggctaatgctcagcaaccaaagctatttgtcgggatgattcttattctcatttttgctgaagctttggcgctctatggtcttattgtcggaattattttatcttcacgagctggccagtccagagctgactaggaaaaaaagccagtaattaaatttcatttcagaatggtaagaaatttcaattgtggctgtttttagtgaccatgttgtactatgattattcttcaacattgacgtttttttacgttttattgttttcacactgaatccctcgtaccttgtgctatattttatagaattagatttttttttcttgctaaataagagcttatggagccgtgagcttattggctattcgattttgtgtattttcgaagccgtgaacttgaacatgaattgtgttttcatcaaatattcatttcttttgtcctgacattagtcgtttactcgtattatatagtaccctgtgaattgttgtaccgaatggg

SEQ ID NO: 1210 - DNA, 1043 bp, Mimulus guttatus
acacaaacacacgtagagagagagagaggagagagagaagagagagagagagagatctaaaatccgaaccctaacagaagactgaataaatcgaaattcagaagtaatttcgatcggaaataatgtcttcgaccttcagcggcgatgaaactgcccctttcttcggcttcctcggcgccgccgcggccctcgtcttctcctgcatgggtgcggcttacgggacagcaaagagtggcgtcggtgtggcgtcgatgggggtaatgaggccggagctcgttatgaagtcgattgtgccagttgtcatggctggtgttttgggtatttacggtttgattattgctgtaattatcagcacgggtattaaccctaaagccaaatcttattaccttttcgatggttacgcacatctctcgtctggcttgtcttgtggccttgctggacttgctgctggaatggctattgggattgtcggagatgctggtgttagggctaatgctcagcaaccaaagctatttgtcgggatgattcttattctcatttttgctgaagctttggcgctctatggtcttattgtcggaattattttatcttcacgagctggccagtccagagctgactaggaaaaaaagccagtaattaaatttcatttcagaatggtaagaaatttcaattgtggctgtttttagtgaccatgttgtactatgattattcttcaacattgacgtttttttacgttttattgttttcacactgaatccctcgtaccttgtgctatattttatagaattagatttttttttcttgctaaataagagcttatggagccgtgagcttattggctattcgattttgtgtattttcgaagccgtgaacttgaacatgaattgtgttttcatcaaatattcatttcttttgtcctgacattagtcgtttactcgtattatatagtaccctgtgaattgttgtaccgaatgggaagttttggctctgttatttagaaaaaatttcctagtatagtaaaagctatacagtccagtgttttc

SEQ ID NO: 1211 - DNA, 871 bp, Avena sativa
gatcgtcgtgccgtcgtgttctcttccccaccccatcgtctcctccccgacccgaacctgattacctgacacgaaaacaccagttctccctcctcgatcgaacgcctaggcttctccaagggaaggaggaggccaaggaagccggatttagccaagccatggccacctccacgttcagcggcgacgagacggcgcccttcttcgggttcctgggtgcggcggcggcgctggtcttctcgtgcatgggcgcggcgtacggcacggccaagagcggcgtcggggtggcctcaatgggcgtcatgcggccggagctggtcatgaagtcgatcgtgcccgtcgtcatggcgggagtgctcggcatctacggtctcatcatcgccgtcatcatcagtaccgggatcaaccccaaggccaagccctacttcctcttcgacggatacgcgcacctctcctccggactcgcgtgcggcctcgccggactcgccgctggaatggccatcggtatcgtcggcgacgctggtgtcagggcgaacgctcagcagccaaaattgtttgtgggcatgatcctcatcctcatctttgctgaagcgcttgcactgtacggcctcattgtcggtatcatcttgtcatctcgtgctggtcaatcccgagcagactagactgggttatgatcccttccgttgtataatggataacacacgagtgtccagtgtgttgttccgatgtatcattgtggtttatttctgctgttcagaatatgttttcttcttgttttcttggcagtattatgatgaataacttgtactattgcacacctagtacattggttgctcgagaacatggaagatttggtgaataaaccaggattttt

SEQ ID NO: 1212 - DNA, 924 bp, Elaeis guineensis
cgatccctaatcttgtcctctcttgttctccgctcctcttccagccccttcggaagggaaaagaaaagagaagcgtctccagatcggttcaccgcctctcagccccgtcgcgttcgaagatgtccagcttcagcggtgacgagactgccccgttctttggcttcctcggcgccgcggctgccctcgtcttctcctgtatgggggcggcgtacgggacggcgaagagcggggtgggggtggcgtcgatgggggtgatgaggccggagctggtgatgaagtcgattgtgccggtggtgatggcgggagtgctggggatatacggcctcatcatcgccgtcatcatcagcaccgggatcaaccctaaggccaagtcctactacctcttcgatggttacgcccacctttcctccggcctcgcctgcggcctcgccggactttccgccggcatggctatcggcatcgtcggcgatgccggcgtcagagccaatgcacaacagcccaaactttttgttggaatgatccttatcctcatctttgccgaggcgttggccctgtatggcctcattgttggcatcattctgtcatctcgtgcaggccaatcaagagcagactaggcatcagtaaaaagaggacagactcatgctttgtagatgtttgacatgttagatccagatctgcctccaaatcatacgaggtttacaattcattattgtgcttgtactcgtgaaattttggtccggtcatgtaccgattactgttttagcattataggatggatatgtatgcaaataaagatcgcatagctgtcacatattggctgcagcatttgaattagtgcttcagctgttgtgaaaactaccaatgtaaacttggtctgtttttttctcaggacttcgatgacctaaataacttttctgtttcatc

SEQ ID NO: 1213 - DNA, 860 bp, Olea europaea
ctaatcaaataataaagcgccgtgaccgtcccgaatttcataatacaagcgtcttaatcaaacggctcatctgtctctcccccacgcaaaaaatcattcagatccgatctttttatatccgatccaaagatgtcgtcaacgtttagcggcgatgaaacggcaccgttcttcggtttccttggcgctgcggccgccctagtattctcctgtatgggggcggcttacggtacggcgaagagcggcgttggagtggcgtcgatgggagtgatgcgtccggagctggtgatgaagtccattgtgccggtggttatggctggtgttttaggtatttatggattgattattgctgtgatcattagtaccggaattaaccctaaagccaagtcttattacttgtttgatggctacgctcacctttcgtccggtctggcttgtggcctcgctggtctgtctgccggcatggccatcggaattgtgggggatgctggtgttagagccaacgcacaacagccaaagctctttgttgggatgattcttattctcatttttgcggaagctttggctctttatggtcttattgttggcattattctctcttctcgtgctggtcagtcaagagcagactaggcgagggcatttagctcgagactacggtttgtttcttggtacgaaatggtcgttggactacggcagattttcttagtttcgagctttatatgtgtgtggcaattgccaggccataagttggcagttgatatgtactgatgatagatgtagatgtattctagttctccctccctcccctaataaagttgtttttgagtactatattaatgtggcgtcttgctagaaccagattt

SEQ ID NO: 1214 - DNA, 974 bp, Olea europaea
aagcaaatttatcaaattttataaaaattcaacctccttttatccaattttctaatcaaataataaagcgccgtgaccgtcccgaatttcataatacaagcgtcttaatcaaacggctcatctgtctctcccccacgcaaaaaatcattcagatccgatctttttatatccgatccaaagatgtcgtcaacgtttagcggcgatgaaacggcaccgttcttcggtttccttggcgctgcggccgccctagtattctcctgtatgggggcggcttacggtacggcgaagagcggcgttggagtggcgtcgatgggagtgatgcgtccggagctggtgatgaagtccattgtgccggtggttatggctggtgttttaggtatttatggattgattattgctgtgatcattagtaccggaattaaccctaaagccaagtcttattacttgtttgatggctacgctcacctttcgtccggtctggcttgtggcctcgctggtctgtctgccggcatggccatcggaattgtgggggatgctggtgttagagccaacgcacaacagccaaagctctttgttgggatgattcttattctcatttttgcggaagctttggctctttatggtcttattgttggcattattctctcttctcgtgctggtcagtcaagagcagactaggcgagggcatttagctcgagactacggtttgtttcttggtacgaaatggtcgttggactacggcagattttcttagtttcgagctttatatgtgtgtggcaattgccaggccataagttggcagttgatatgtactgatgatagatgtagatgtattctagttctccctccctcccctaataaagttgtttttgagtactatattaatgtggcgtcttgctagaaccagatttgatttgtgtaaaaccactgtattttgcttttgcaagttcaatccacattagtggtattttgtt

SEQ ID NO: 1215 - DNA, 928 bp, Citrus sinensis
cacaccggaaacttccttgtgctatcactgcgtccatctctctccctcgaatccaattcaccttcaaaattcccaaattcctgtaaaccgatcggtacattttaggaggaattgaaatgtcatccgcattcagtggcgatgaaacggcgccttttttcggcttcctcggcgccgctgccgcccttgttttctcctgcatgggagcagcgtatgggacggcgaagagtggagtgggcgtagcatcgatgggagtgatgaggccagagcttgtaatgaaatcgattgtgccagttgtgatggcgggagtgttaggtatttatggtttaattattgctgttattattagtactggcattaacccaaaggccaaatcatattatctattcgatggctacgctcatttgtcttcgggtctcgcttgcggcctcgctggtctctctgctggtatggctattggcatcgttggtgatgctggtgtcagagctaatgcacagcaaccaaagctttttgttggaatgattctcattctcatttttgctgaggcattggcgttgtatggtctcattgttggcattattctctcttcccgagctggccaatccagagcagattaggatgcgtggttcagaacataggtttctcaaaattatttggtcatgctcacgtagatgatgctaggacaccatgggaaatgttgagttggttgtcaatatcccactagattattaagtagctccattctgtctgtaccattaagggcaagattttccccttaaaataatgctcgagttctcagcttgtattgttgtatttttactgtgaaatcagacatatgaaagaaccatccttacgcattatggtttgttttacttgttggcttttggggtttacaaatttctgtgctcaaattgattgtgtggttatgtct

SEQ ID NO: 1216 - DNA, 1061 bp, Citrus sinensis
aaaaaagaaaaaaacaaaacaaaaccagagagatcgaaactctgtgtcccaaaaaagatcacagatccaagaaacagttcaacgccgatctaaagcgacaccgtttcagatctacaatccacaatgtcttcatcattcagcggcgatgaaacggcaccgttcttcggcttcctcggcgctgctgccgcccttgtcttctcctgtatgggagctgcatatggaacagccaagagtggtgttggtgtggcgtcaatgggtgttatgaggcctgagctggtgatgaagtcgattgtgccagttgttatggctggtgttttgggtatatatggtttgattattgctgttattatcagtactgggattaaccccaaggccaagtcatattacctttttgatggctatgctcatctctcctccggtttggcttgtggtcttgccgggctttctgctggaatggctattggaatcgttggtgacgcaggtgtcagagccaatgcacagcagccaaaactctttgttgggatgatccttatcctcattttcgctgaagcccttgcactgtatggccttattgttggtatcatcttgtcttcacgtgcgggtcagtccagagcagattaagaagggaatttgtattgctaagtattcttttataacttgtcactctgggggagcgagattttttttaaaattattctcaggttcaagtggatagcacttgctcaaactttcttgtggaagttgccgttctgcgagtcatttgtatgttactccatgtttctggtagtaggattgagtttcttcaaacaataaagtttgcaaagctgtccatgcacttttgcagaactttaaactgtcagaaaggaattttattcggtaatctagtgcatgtattatcttattatctattcaacgtttttttcttctccacatagtaccctaagtttaatgatggtagctgccatcaacatttgtctgcaaatttctgtgttatctttgtttattttgatgggtatttggaatttatttttctcgtttgatatcaaatgattgttatttgt

SEQ ID NO: 1217 - DNA, 976 bp, Orobanche aegyptiaca
gttggtcagcggcgactcagcagacccttagagggcagattcgtaattttcttcgaatctaattcatggacgcctgagcaaaatgtggtgacccttgaaaggcctttttaatccaacaaattcatttcattctctttctcgatccgatctccgcagaaatccaaatcgataaaagatgtcgtcaactttcagcggcgatgaaacggcaccgttcttcggcttcctcggcgccgctgctgccctcgtcttctcctgtatgggagcagcctacggcacggcgaagagtggtgtcggtgtggcgtcgatgggtgtgatgcggccggagctggtgatgaaatcaattgtgccggtggtcatggctggtgttttgggtatttatggtttgattattgctgtgattattagtaccggtatcaatcctaaggccaagtcctactacttgtttgatggttatgctcatctttcttctggactctcttgtggtctcgccggccttgctgctggtatggccattggaatcgtcggagatgctggtgttagagcgaatgcgcaacaaccaaagctctttgtcgggatgattcttatacttatctttgctgaagccttggctctatacggtctcattgttggcataatcctttcgtcccgtgcgggtcagtctagagctgattagaagagtacatttcacacgctcagatcgtcgagtttcttgatatcaagtacaatcgtaatattatgttctccctcgttagcactgtagtaaggccataggacagtatcttcaggttatttttttttttttttgtgcgtgtggaaattgtttggccacaagaattgaacaagaatgatgtgtatggcatcagattgtagatgagaagtttcatttatccaggaataatgtctcagatattttattggtgatgtacttgcaagtaactcatttgatttgtgtaagaccatattatgtatttttttt

SEQ ID NO: 1218 - DNA, 907 bp, Orobanche aegyptiaca
acacaacacagagaaagggtacagatctaaatccgaaaggtccaaaccctagccaaaaaaaccaacattctctgaattcacaagtaatctagatcggaaatatgtcttcgacttttagcggcgatgaaactgctccattcttcggattccttggcgccgctgccgccctcgtattctcctgtatgggtgcggcttatggtacagcaaagagtggtgtaggcgtggcatcaatgggggtgatgaggcctgaactagtcatgaagtctatagtgccagtagtcatggctggtgttttgggtatttacggtttgattattgctgtaattatcagcactggcattaaccctaaagccaagtcttattacctttttgatggttatgcgcatctctcttcgggcctctcctgtgggctcgctgggcttgctgctggaatggctattgggattgtgggagatgctggtgttagggctaatgcacaacaaccgaagctgttcgttgggatgatccttattctcatttttgccgaagctttggctctctatggtcttatcgttggaattattttgtcttcacgagctggtcagtccagagccgactagaaaatgaaccattaattaaaattttatttcagaacatattttatctcctgcaagtcaggcgtgggaagaattgagaccggcatgtctggtttggccatgttgtactatgattattaagttaccattgaagttcttttatattccttcccactgagatttttattatcttcttgttatttgtagatttacatttgttttctgctaaacaagagacagagctctgtattttggagtactcgatttttgtgtattttgatatataaacattgtagagggcatatattgtacctcagcattatcatgttcaa

SEQ ID NO: 1219 - DNA, 712 bp, Parthenium argentatum
gtttagattagatatccagaaaacataaccctcagatccaatcaaattttcaacagatctacaatcatcatgtcttcaacattctccggcgatgaaacggcaccgttttttggctttctcggagccgcagctgcccttgttttctcatgcatgggggcggcatatgggacagccaagagtggtgttggagtggcatcaatgggagtgatgaggccggaattggtgatgaagtcgattgtgccagtggttatggctggagtgttaggtatttacgggttgattatagcggttattatcagtaccgggattaaccctaaggccaaatcttattatctctttgatggatacgcacatctttcttccggtcttgcttgtggtcttgctggtctttctgctggtatggctatcggaattgttggcgatgctggtgttagagccaatgcacaacaaccaaaactatttgttgggatgatcctgattctcatttttgctgaagctctggctctctatggtctaattgttggcatcatcctttcttctcgtgccggtcaatcccgagctgactagaagggcggcagcctaggcggactatcctgtctctgtggtcttggtggtgttagttgagctgcagacatgatcaaatctttggtggtgatgatattggcctatggctctgctcctccagtaggttttagaccaaactctagctcta

SEQ ID NO: 1220 - DNA, 710 bp, Parthenium argentatum
cgtagacgatcaatcaatcaaacaagtttctgtttctctgaagattacataaataaatatctgaacaacaaaaatacctaaatctaatcaatttctgttcagatccaaaccctaaatcaaccgatcatgtcttctacgttctccggcgacgaaaccgctccgtttttcggcttcctcggtgctgctgctgcactcgtgttttcctgtatgggggcggcatatgggacggcgaagagtggtgttggagtggcgtcgatgggggtcatgaggccggagttggtgatgaagtcgattgtgccagtggttatggctggagtgttgggtatttacggtttgattattgctgtgattattagtaccgggattaaccctaaggctaagtcttattatctgtttgatggatatgctcatctttcttctggtttggcttgtggtcttgctggtctttctgctggtatggctattggaattgtgggggatgctggcgttagggctaatgcgcaacaaccaaaactttttgttggaatgatcctaattctcatttttgccgaagctctggccctgtacgggcttattgttggcatcatcctttcttctcgagcgggtcaatccagagcagattagaagacttgcttgtgggtcctgtttatcatgataaagtgagcatttttcttcatcctctcattagagttgtggtttggtctacttgt

SEQ ID NO: 1221 - DNA, 611 bp, Parthenium argentatum
gatccaatcaaccaatcaccgatcatgtcttcaaccttctccggcgatgaaacggcaccgtttttcggatttctcggagctgctgctgcactagtcttctcctgtatgggtgctgcgtatgggacggcgaagagtggtgttggagtggcgtcgatgggagtgatgaggccggagttggtgatgaagtcgattgtgccggttgttatggctggagtgttggggatttacggtttgattattgctgtgattattagtactggtataaaccctaaggctaagtcgtattacttgtttgatgggtacgcgcatctttcgtctggtttagcttgtggtcttgctggtttgtctgctggtatggctattggaattgttggtgatgctggtgttagagccaatgcacaacaaccaaagcttttcgtggggatgatcctgatcctcattttcgcagaagctcttgctctctacggtcttattgtcggcatcatcctatcttctcgggctggtcagtcgagagcagactagaaggttggcaattgatggatgatcctgtacccactcgtgtgctttgcagctataacttgaatcattttttcttgggtgtgcgtttggag

SEQ ID NO: 1222 - DNA, 1017 bp, Lippia dulcis
ctcagcgatattcgctctttccacgctaatctaccacacacacgaacacgcacacacatacagagtaagatctagaaatccaaaccctagcaaaaagatcaacgattgtttggatttagaagtaatttcgatcggggaactatggcttcgaccttcagcggcgatgaaactgctccgttcttcggctttcttggcgccgctgccgccctcgtcttctcctgtatgggtgcggcatatgggacagcaaagagtggtgtaggtgtggcgtcaatgggagtgatgagacctgagcttgtgatgaaatctattgtgcctgttgtcatggctggtgttttgggtatttatggtttgattattgctgtgattatcagcactggtattaaccctaaggccaagtcgtattatctttttgatgggtatgcccatctgtcatctggccttgcctgtggcctggctggtcttgctgctggaatggctattggcattgtgggagatgctggtgttagggctaatgcacagcaaccaaaactatttgtgggtatgatccttatcctcattttcgccgaagctttggcactctacggtctcattgtcggcattattttgtcttcccgagctggtcaatccagagccgattaagggactagcgagccttaaattatatttcccatcagaacataccatgtctcctggaaatcatagtaggcagggagaaaaattaccaccttgtggtaggctttgattgtccatgttgtaccacgatcattcgtcaccattgatgttatttatgtttatctttgacattgaattcatcgttgttgatggctttatagaattagatttcttttctgctgctaataagagatctatctatgttggattactctgtttttgtgtattttggagtgtgaacaatgtagaaagccaaggatatgaatcagtttaccatgttttctcttctttaattaccaaatttaagtaattattttcctaattggagattatataaaaagtagt

SEQ ID NO: 1223 - DNA, 987 bp, Papaver somniferum
aaaaacaaaaaacgcagaaaattcagatccgatctcctgtaaatcaaaatgtcttcaacattcagcggtgatgaaactgctccattcttcggattccttggggctgcagctgcccttgttttctcatgtatgggagctgcttatggaacggctaagagcggtgttggtgtagcttcaatgggtgtaatgagaccagaattagttatgaaatcaattgttccagttgttatggctggagtattgggtatttatggtttgattattgcggttattatcagtactggaattaaccctaaggctaaatcttattatctatttgatggttacgcacatctttcatctggtcttgcttgtggtcttgctggtctttctgctggtatggccatcgggattgttggtgatgctggtgttagagccaatgctcagcagccaaagctcttcgttgggatgatccttatcctcattttcgctgaagcccttgcgttgtacggactcattgttggtatcatcttgtcttcaagagctggtcaatctagagcagactagaaagagagagaccattctggcacttatcttgtgtggttatcagtgtattattttgtctgtttttattcatcttcaggtttgtaatggttgttcaatcctcacagtgctctgaaaaattcttcattctgaacacaattacaccatcacccttgcacaggggtgattggtcagttatcggcggcttaaattaggaacaaattgattggaaaataaagcttaagctcttttctttcttttctctgttcatggattaatttatgtacgtttgcagatattagctctgtctggtctagttactgggtgttgtctggatctagaacctgattattttgtatgtgttatatttattgctcatttctttaattgtttactttgatttttttctgttcactctactatgatgtgagcagaagtctgaaggcaatatatctaaattgcaaa

SEQ ID NO: 1224 - DNA, 964 bp, Papaver somniferum
agagagaacgagagattgggagaagaaattgatatctaaaaagtttcatcaaattattccagatctgatctcactctctctgcaaattcaacttacaatcatcgaagatgtcatcaacatttagtggagatgaaactgctcccttctttggatttcttggagctgcagctgctttggttttctcctgtatgggagcagcatatggaactgcaaagagtggtgttggtgtggcatcaatgggtgtgatgagaccagagcttgtaatgaaatccattgttccagttgttatggctggagttttaggtatttatgggttgattattgctgttattatcagtactggaattaaccccaaggctaaatcatactacctattcgatggttacgctcatctttcatctggtcttgcttgtggtcttgccggactttccgctggaatggctatcggtatcgttggtgatgctggtgttagggccaatgcacaacagccaaagctcttcgttgggatgatccttatcctcatttttgccgaagctctggctctttatggacttattgttggtatcatcctttcttcaagggctggccaatcgagagctgactaagcgacaagagtttgttgtgtcatgcttggggtttcttgagtggttcgtgggctatttttcacttttgatctaccgattagcaaggagtagttacagctctgcattgtcttcaaatgttatcttttcctggatgcacaattcttcaccaccatcctcgcaatcattggatatatatattcagcatttgctggttgtagctttagagattgagcttttttctgaaaataagatctgttgccgttttcacctttcctattttgcagatgtaaaattctagctggtgacataaactcaatctgaaactatggcttgtataagtttttttaaacattaaattaactacttttatgtttattgag

SEQ ID NO: 1225 - DNA, 1027 bp, Papaver somniferum
caaagaaaaaacaaaaaacacagaaaattcagatccgatctcctgtaaatcaaaatgtcttcatcattcagcggtgatgaaactgctccattcttcggattccttggggctgcagctgcccttgttttctcatgtatgggagctgcttatggaacagctaagagcggtgttggtgtagcttcaatgggtgtaatgagaccagaattagttatgaaatcaattgttccagttgttatggctggagtgttgggtatctatggtttgattattgctgttatcataagtactggaattaaccctaaggctaaatcttattatctattcgatggttacgcacatctttcatctggtcttgcttgtggtcttgctggtctttctgctggtatggccatcgggattgttggtgatgctggtgttagagccaatgctcagcagccaaagctcttcgttggaatgatccttatcctcattttcgctgaagcccttgctttgtatggactcattgttggtatcatcttgtcttcaagagctggtcaatctagagcagactagaaagagagagaccatttctggcgcttttcttggtgtggttatcagtatattattttgtctgtttttattcatcttcaggtttgtaatggttgttcagccctcacagtgctctgaaaaattcttcattctgaacacaattactccatcacccttgcacaggggtgattgttcagttatcggcttaaattaggaacaaattgattggaaaataaagcttaagctcttttctttcttttctctgttcatggattaatttatgtacgctgcagatattagctctatctggtctagttactgggtgttgtctggatctagaacctgattattttgtatgtgttgtatttattgctcattttttgtcttaattgttttgtttgatatttttttaactctactatgatgtgaacagaacgcgatatatctaaatcgcaaatgcaaataaccacagcataagaaactagataatcttaaactt

SEQ ID NO: 1226 - DNA, 999 bp, Papaver somniferum
gagaactccgccaggaccagtaccaccatctattacctgacaacccttcgtaattatgagtatactaaaggttagtatcgtaacttgaatcatcaccttgtagagagagtctaatcaccaatttattatcagtcccgatcttcccctttactcttctccttcgtcttcacaaagagagatagagagaatttccaactgaaataggcttttttctcagatctctcttcgaaaatgtcttcaagcttctctggagatgaaaccgctcccttcttcggcttccttggagccgctgctgctctcgtcttctcatgtatgggagctgcatatggaacagcaaagagtggtgtaggagttgcatctatgggtgtgatgagacctgaacttgttatgaaatctattgttccagttgttatggctggagtgttgggaatctacggtttaattatcgctgttattatcagtactggtattaatcctaaggcaaaatcatactacttgtttgatggatatgctcatttatcatctggtcttgcttgtggtcttgctggtctttctgctggtatggctattggaattgttggtgatgcaggtgtcagagccaacgcacaacagccaaaactatttgtcgggatgatcttgattcttatctttgctgaagcactcgccttgtatggtctcattgttggtattattctctcatcgcgagctggtcaatctcgagcagattagaagatggcgaagtgagggtttgggattctgtgctatagttttccaatataaccagtgacttgaattgaagcctatatcatgatattattatcatttgcttttgattcgattacgacttatttgtaaatgttttggagtgcgacttcgtgcaccccttttatccggggatgcacatttctccccttgttattagttattttcttcactctctagttatttgttgaattttataatcataaaactgcatttgcaaatgggagaataactttt

SEQ ID NO: 1227 - DNA, 888 bp, Papaver somniferum
attcagatccgatctctctaaaatcaaaatgtcttcaacattcagcggtgatgaaactgctccattcttcggattccttggagctgcagctgcccttgttttctcatgtatgggagctgcttatggaacggctaagagcggtgttggtgtagcttctatgggtgtaatgagaccagaattagttatgaaatcaattgttccagttgttatggctggagtgttgggtatttatggtttaattattgcggttatcatcagtactggaattaaccctaaggctaaatcttattatctgtttgatggttacgcacatctttcatctggtcttgcttgtggtcttgctggtctttctgctggtatggccatcgggattgttggtgatgctggtgttagagccaatgctcagcagccaaagctcttcgttggaatgatccttatcctcattttcgctgaagcccttgctttgtacggactcattgttggtatcatcttgtcttcaagagctggtcaatctagagcagactagaaagagagagagcattctggtgcttttcttgtgtggttatcagtatattattgtctgtttttattcatcttcaggtttgtaatggttgttcggccctcacagtgctctgaaaaattcttcattctgaacacaattactccatcacccttgcacagggtgattgttcagttatcggcttaaattaggaacaaattgattggaaaataaagcttaagctcttttctttcttttctctgttcatggattaatttatgtacgttgcagatattagctctatctggtctagttactactgggtgttgtctggatctagaacctgattattttgtatgtgttatatttattgctcatttctttaaaaa

SEQ ID NO: 1228 - DNA, 943 bp, Papaver somniferum
cacctaagtatgaagagacgaagagtagtagagagaaataatagtatataactaaaaaaatttcatcaaattgttccagatctaatctcactctctctgcaaatttaacttacaatcatcgaagatgtcatcaacatttagtggagatgaaactgctcccttctttggatttcttggagctgcagctgctttggttttctcctgtatgggagcagcatatggaactgcaaagagtggtgttggtgtagcatcaatgggtgtgatgagaccagagcttgtaatgaaatcaattgttccagttgttatggctggagttttaggtatttatgggttgattattgctgttattatcagtactggaattaacccaaaggctaaatcatactacctattcgacggttacgctcatctttcatctggtcttgcttgtggtcttgctggactttccgctggaatggctatcggcatcgttggtgatgctggtgttagggccaatgcacaacagccaaagctcttcgttgggatgatccttatcctcatttttgccgaagctctggctctttatggacttattgttggtatcatcctctcttcaagggctggccaatccagagctgactaagcgaacaagagtttgttgtgtcatgcttgaggtttcttgagtggtttgtgggctattttttcactttggatctactgattaacaggggtagttacagctctgcattgccttcaaatgttatctattcctggacgcacaattcttcaccaccatcctcgcaatcattggacgtataaattcagcattttctggttgtagcattagagattaagcgtctttctgaaaataaagcttagagatctgttacccttttctatttatttatttatgtattttgcagatatgaaattctatccagtgacaaactcaatctgaaaccat

SEQ ID NO: 1229 - DNA, 900 bp, Oryza sativa
aagagagcaagtaaatataaatgaagtgaggtccacacacgttgacgaggcaacgagatacggcaccaataccaatctctgactcctccggcctccggcggccggcgagagagatcccaccctcaccgacgacggcgagcgaccaccatgtcctcctccaccttcagcggcgatgagaccgcccctttcttcggcttcctcggcgccgcctccgccctcgtattctcctgcatgggcgccgcctacggcaccgccaagagcggcgtgggcgtggcgtccatgggggtgatgcgcccggaactggtgatgaagtccatcgtccccgtcgtcatggccggagtgctcggtatctacggcctcatcatcgccgtcatcatctccaccggcatcaaccccaaggccaagccctacttcctcttcgacggttacgcccacctctcctccggtctcgcctgcggcctcgccggtctcgccgccggcatggccatcggcatcgtcggcgacgccggagtcagggccaatgcgcagcagccaaagttgttcgtgggcatgatcctcatccttatctttgcagaagctcttgctctgtatggcctgattgttggtatcatcctctcgtctcgtgcgggccaatctcgagcggattagagggttttggaagaacaagacacggttcaccattgtattctattccaagtgttaatttcttcttatagactgcttggtcttgtctgtgtttatactcattgtctgtattcaagctattgtgggttgttgtatttattatttgaatttttgaagtaataatcggtaccaggccgtccgagatgtgattaataatgaatgaataaataaataagcaaacaaacaagctagacttagttttaagtctgttctgat

SEQ ID NO: 1230 - DNA, 795 bp, Rosa hybrid cultivar
gctcctgcggaagaagcacaaacaaaacaatcagtgagggagagaagagatcagagagatccaagatccagacgacgtcgttgcagatccactccccacgatgtcttctaccttcagcggcgatgagacggcgcccttcttcggcttcctcggcgccgctgcggccctcgttttctcctgtatgggagctgcctatggcacagcaaagagtggggtaggtgttgcatctatgggagtcatgaggcctgagctggtcatgaaatccattgttcctgttgttatggctggagttttgggtatttatgggcttattattgctgttatcatcagtaccgggattaatcccaaggcaaagtcatattacctctttgatggttatgcacatctctcctctggtcttgcttgcggtcttgcggggctctccgctggaatggcaattggtattgttggtgatgctggtgtgagagctaatgcacagcagccaaaactctttgtcgggatgatcctcattctcatttttgctgaagcattggcactgtatggcctcattgttggaatcatcttgtcctcccgagctggccaatccagagcagactaagaagtggctgtgcagtctaatattctttaattgcaatatgcacttagctggggaattttttggctgctctcaggttgctgattggttatgcttgcagattcctaaagattatgtttgtgtacgtacctgcctcgtcttgtaggattgaatttttttaacagaataagctctaaaagctgtctatgttttttttttta

SEQ ID NO: 1231 - DNA, 806 bp, Secale cereale
cttcagcggcgacgagaccgcccccttcttcggcttcctcggcgccgccgccgccctcgtcttctcctgcatgggcgcggcgtacgggacggccaagagcggggtgggggtggcgtcgatgggggtgatgcggccggagctggtgatgaagtcgatcgtgcccgtcgtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaatgcacagcagcccaagctgttcgtcggaatgatcctcatcctcatctttgccgaagcgcttgccctgtacggcctcatcgtcggcatcatcctctcctcgcgtgccggccagtcccgcgccgactagaacaaagcggttgcaagcaaggagcatacggcccatcattgtattctgtttgaaagggtttgtttcttcttagagacttgtttggcattacactgtggttctacttctgtgttcatgctcctcgacggatcaatcaaggaacataatgtggtttgggatcatatggatttccacgccctccatctgtaattttattctgctcggcaatgcaaagctacctgtatctactcgtacctagcacctgttgtatttattgtttggagtaataatcggcgatgagcctcttgggacgtggtgaatgaataagcaaagctagacc

SEQ ID NO: 1232 - DNA, 809 bp, Secale cereale
cttcagcggcgacgagaccgcccccttcttcggcttcctcggcgccgccgccgccctcgtcttctcctgcatgggagcggcgtacgggacggccaagagcggggtgggggtggcgtcgatgggggtgatgcggccggagctggtgatgaagtcgatcgtgcccgtcgtcatggcgggggtcctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaatgcacagcagcccaagctgttcgtcggaatgatcctcatcctcatctttgccgaagcgcttgccctgtacggcctcatcgtcggcatcatcctctcctcgcgtgccggccagtcccgcgccgactagaacaaagcggttgcaagcaaggagcatacggcccatcattgtattctgtttgaaagggtttatttcttcttagagacttgtttggcattacactgtggttctacttctgtgttcatgctcctcgacagatcaatcaaggaacataatgtggtttgggatcatatggatttccacgccctccatctgtaattttattctgttcggcaatgcaaagctacctgtatctactcgtacctagcacctgttgtatttattgtttggagtaataatcggcgatgagccgcgtgggacgtgggtgaatgaaagagagaagacgaggagc

SEQ ID NO: 1233 - DNA, 879 bp, Carthamus tinctorius
atctcttcttctctgtgaagtttggatatctggagaagaaatcctcagatccgatcaatttctccatcgatctattcaaccaccatgtcttcaacattctccggcgatgaaacggctcccttcttcggctttctcggtgccgcggccgccctagtcttctcctgcatgggggcggcatatggaacggcgaagagcggtgttggtgtggcgtcgatgggagtgatgaggccggagttggtgatgaagtcgattgtgccggtggttatggctggagtgttaggtatttacggattgattattgcggttatcattagtaccgggattaaccctaaggccaaatcttattatctctttgatggatacgctcatctttcttctggtcttgcttgtggccttgctggtctttctgctggtatggctatcggaatcgttggtgatgccggtgttagagccaatgcacaacaaccaaaactctttgttgggatgatcctgatcctcattttcgctgaagcacttgctctgtatggtcttattgttggcatcattctttcttctcgagctggtcagtcgagagcagactagaaggagacgaggttgtgtcttactgctattaattaagcatatgattattatcctctctgtggttgttgttgttggttgagcttcagacatgatgaattctttggtggtgatgataccttggcctgatggattggctggctgatgactatgctcctacagtaggttgtagaccaaattctatctctctgctataataataaaattctgtctcttttacgtaaattatttttggacatgctatatgcgggataattttgccagatttgttctacaatttgtggttactcttttatgtta

SEQ ID NO: 1234 - DNA, 827 bp, Carthamus tinctorius
  misc_feature (23)..(23): n is a, c, g, or t
  misc_feature (722)..(722): n is a, c, g, or t
gggccataaattcacatcatccntctctctctctctcgatcctcagatccgatcaatttctctgcaaattaaaaccctagatcatgtcttcaacgttctccggcgatgaaacggctcccttcttcggttttcttggcgccgctgctgccctagtcttctcctgtatgggagcggcgtatgggacggcgaagagcggcgtcggagtggcgtcgatgggagtgatgaggccggagttggtgatgaagtcgattgtaccggttgttatggctggagtgttgggtatttacggtttaattattgctgtcatcatcagtaccggaattaaccccaaggctaagtcctattaccttttcgatggctacgctcatctttcctccggtcttgcttgtggtcttgccggtctctctgctggtatggccattggtatcgtcggtgatgctggtgtcagagccaatgcacaacaaccaaaactttttgttggcatgatcctcatcctcattttcgctgaagctcttgccctctacggtctcattgttggcatcatcctttcttctcgagctggtcagtccagagcagactagaacattggcattcaatccagtactcggtgtgttttacaggtataagttaagcattttttgatggttgttttgggtagagttgaagctggtgtgggtgtgtcgttttttccataatttgtgaatggtggggtggaggggggntatttgtgctgaggctgagggtaggttgtaaattagattgtagttgttcactataataaagttgtcattgttgctcgtattatttggtgctatattttgattttt

SEQ ID NO: 1235 - DNA, 773 bp, Carthamus tinctorius
  misc_feature (19)..(19): n is a, c, g, or t
  misc_feature (43)..(43): n is a, c, g, or t
  misc_feature (49)..(50): n is a, c, g, or t
  misc_feature (760)..(760): n is a, c, g, or t
gctgataacaatcctcacntccattcaatttcttctctttcanatctannaaccctaaatcaaaaccgatcatgtcttctaccttctccggcgatgaaacggctccgttcttcggctttctcggcgctgctgccgccctagtcttctcctgtatgggggcggcctatgggacggcgaagagtggtgttggagtggcttccatgggagtgatgaggcctgagctggtaatgaagtcgattgtgccggtggttatggctggagttttaggtatttacggcctgattattgctgtgattattagtactgggattaaccctaaggctaagtcgtattatctctttgatggatacgctcatctttcttctggccttgcttgtggccttgctggtctttctgctggtatggccatcggaatcgttggtgatgctggtgtaagggctaatgcacaacaaccgaaactctttgtcgggatgatccttatcctcattttcgctgaagctctggcgctttacggtcttatcgtcggtatcatcctttcttctcgagctggtcaatccagagcagactagaatcgattggattggctttaaagcaagcgttattcttattcttattatgtggtggttagagttgcggttttttttccaaaatccttgggcggtgaggcgagacccgctgattctgtgtgccaagacgagattctatttctttcttttcataaattcgttgtcataaatatctgtcgttaagttttcattgnacatgttattctt

SEQ ID NO: 1236 - DNA, 794 bp, Carthamus tinctorius
  misc_feature (24)..(24): n is a, c, g, or t
agagactctgcgacttttgtattntctattcatattcccttctccggcgaccaattttccggcaatccaaatctctattccggcaaatacaattggaatcaatgtcgtctactttcagtggcgatgaaaccgctcccttctttggcttcctcggagccgcagcagcccttgttttctcctgtatgggcgctgcctacgggacggcgaagagcggcgttggtgttgcatccatgggagtgatgaggccggagctggtcatgaagtcgatcgtccccgttgttatggcgggagtgttaggtatttacggattgattatcgctgttattattagtaccggaatcaatcccaaggccaaatcgtattacctgtttgatggctacgcgcatctctcatctggtcttgcttgtggccttgctggactttccgctggaatggccattggaatcgttggcgatgctggtgttagggcaaatgcgcagcagccaaagcttttcgttggtatgattcttattctaatctttgctgaagcacttgcgttatacggtctgattgtcggcatcatcctgtcctcccgtgctggccaatccagggctgattaagttgtacaatttctcatccatccatccaattttatcatcttatgaggttagtttcacgagttgagaaggtccacacatcttttcaaatcttgctcctatcttccttcctgttatcaaattgtttgttagttattgttgaactggaagcgacttttgcactcaaataaaaacttaaactagcattgtttattaaaa

SEQ ID NO: 1237 - DNA, 878 bp, Sarracenia psittacina
ctgggcaagtacaatcgacatcttcccaatctctctctgtctctccaggcgacgatcgtgtaccgactgaaccaaataatttgatttgcaatagatcaatcggagagagaaaacaaaaatgtcgtctacgttcagcggcgacgaaactgctcctttcttcggcttcctcggcgccgcagcggccctcgttttctcctgtatgggagctgcctatggaacggcgaagagcggtgtaggcgtggcgtcaatgggggtaatgagaccagagcttgtgatgaagtcaattgtccccgtcgttatggccggcgtattaggtatttacggtttgattatcgccgtgatcatcagtaccgggattaaccctaaggcgaaatcctattacctcttcgacggatatgcacacctgtcgtctggtcttgcttgtggtctggccggactttcagccggaatggctattggaatcgttggtgatgccggtgtcagagctaatgcacaacagcctaagctttttgttggaatgattctcattctcatctttgccgaggcattggcactgtatggcctcattgtcgggatcatcctctcttctcgtgctggccaatctagagcagattagagagaattctatcctcactggttcttttgtgtcatttgttggcatcacctaactctcaggttagtgatgctagtttcgaacatgcaatgttccttcttgttattatgctctgcactcaattacttatcatgtgtactttatattgattgtaatattgtattattgggatcattttcctctctgaaataaagctgtataaaactagttcttccatttgctatcttcctgtaatttatggaagttttgaagagcatactgttac

SEQ ID NO: 1238 - DNA, 929 bp, Sarracenia psittacina
tttcagtggggttgcaggtatttagaagatccgggaatcgtgatgaatcctgttccttcttagcgtagagataggaacggacacatctcttcccagatagaaaaccagaagaatttcaaatcagatagatcttcctgcaaatcaaaaccctcaaaaccagaagaagaaatatgtcttcaacgttcagcggcgatgaaacggcgccgttcttcggcttcctcggcgctgcagctgccttggtcttctcctgtatgggagcggcgtatgggacggcgaagagtggggtcggagtggcgtcgatgggcgtgatgaggccggagctggtgatgaagtcgatcgtgccggtggttatggcgggagttttgggaatctatggattgattattgctgtgatcatcagtactgggattaaccctaaggccaagtcttattatctttttgacggatacgctcatctgtcgtctggtcttgcttgtggcctcgctggcctttctgctggtatggcaattggcatcgtcggcgatgccggtgttagagccaatgctcagcagccaaaactttttgttgggatgatcctcattctcatatttgctgaagcccttgctctctatggcctcatcgtcggcattatcctctcttctcgagctggtcaatcaagagcagactaaaacaggtgattctgcttggtgctggtggtgattgttactatttattaagaattatcatgatgttcactggtagaaatggtaattcagctgtggagacgtcttctcctacaaatttcttctttattatttaccattgctcggtctggtgagttgggtggtatctctgtgggctaatggtagagtgtatatttactgcgacttctctccttgaataatatccatctgctgctttctttttacagatgcactgtttcccaatcc

SEQ ID NO: 1239 - DNA, 880 bp, Sarracenia psittacina
aaaactctcttctgtgaatattttcctcacaattctctcgcgatccaaccaacgattcgtcgcaggaaattccatcatgtcttcgacattcagtggagatgaaactgctcctttcttcgggtttctcggcgctgctgctgccctcgtcttctcctgtatgggagctgcctatgggacggcgaagagtggtgttggtgtggcgtcgatgggtgtgatgaggccagaactggtgatgaagtcaattgttccggttgttatggccggtgtgttgggtatttatggcttgatcattgctgttatcatcagtactgggattaaccccaaagccaagtcatattatttgtttgatggttatgcacatctttcttctggactcgcttgtggtctcgctgggctttctgctggaatggcgattgggattgttggtgatgccggtgttagagctaatgcgcagcagccaaaactttttgttggaatgatactcattctcatctttgctgaagccctggcgctctatggcctcattgtcggtatcatattgtcttctcgagctggtcaatccagagcagactgagaagagggtttgacgaaattgttaaatcttcttacgggcggaacagcactttcgtggttcttcaaattcttcagtcttaaaagtaattaccctatccctaatacatttattttgtcgctgctcagtgctgtttttagcgtaggcttttaagtatatctggaggctaaaaagctcatgatacttcctgtttggttttatctattcattcaatctgccattagaacttcaaaaactgtgtagagattcttatcttggaactagtgtgtattattattatttatgaattatggattccacttctccttc

SEQ ID NO: 1240 - DNA, 982 bp, Scabiosa columbaria
gcagggccacatcaaacaaacaaacattactctctctctctggagaaagaggtgacaatcgaaatttctcagatccaatccattcattcatcaacagagatctaaaagttccaccatgtcttcaactttcagtggcgatgagacggcaccgttcttcggtttcctcggcgccgcagctgccctcgtcttctcctgtatgggtgctgcgtacgggacagccaagagcggagttggagtcgcctcaatgggagtgatgaggccggagttggtcatgaaatcgatcgttccggtggttatggctggagttttgggtatttatggtttgatcattgctgttattattagtactggaatcaaccccaaggcaaagtcttattacctatttgatggatatgctcacctttcttctggtcttgcttgtggtcttgctggtctctctgctggtatggctattggtattgttggtgatgccggtgttagagccaatgcacaacaaccaaaacttttcgtaggaatgatcctcattctcatttttgctgaagctctggctctctatggtcttattgttggtattatcctctcctctcgtgctggtcaatccagagcagattaaacgtgaaggtgaattttgcaaagttatgatttgtgggtttattgctatttataaagaacattgttgctattactatttttccatcaccacttgaaaacttgtaggtccaactgagggctttcttgtacttaaaaacggttatatttgttcgtttccaagaggatttgggtgatagatgatggtaagaggtagattttgttttttagtgttccgtttgcctgaataaagtcttcgtgtcttcccgaaattgtttggaccggtcataacgtgtattattttgccagattgttatttgaactccgtattttctacttcctcttttgctagaatgtattcagtatcattgtccatactatttatgttcttttc

SEQ ID NO: 1241 - DNA, 875 bp, Scabiosa columbaria
cagggccacatcaaacaaacaaacattactctctctccctggagaaagaggtgaaaatcgaaatttctcagatccaatccattcattcatcaacagagatctaaaagttccaccatgtcttcaactttcagtggcgatgagacggcaccgttcttcggtttcctcggcgccgcagctgccctcgtcttctcctgtatgggtgctgcgtacgggacagccaagagcggagttggagtcgcctcaatgggagtgatgaggccggagttggtcatgaaatcgatcgttccggtggttatggctggagttttgggtatttatggtttgatcattgctgttattattagtactggaatcaaccccaaggcaaagtcttattacctttttgatggatatgctcacctttcttctggtcttgcttgtggtcttgctggtctctctgctggtatggctattggtattgttggtgatgccggtgttagagccaacgcacaacaaccaaagcttttcgtaggaatgatcctcattctcatttttgctgaagctctggctctctatggtcttattgttggtattatcctctcctctcgtgccggtcaatccagagcagattaaacgtgaaggtgaattttgcaatgttatgatttgtgggtttgttgctatttataaagaacattgttgctattactattatgtcatcaccacttgaaaacttgtacgtccaactgagggcattcttgtacttaaaaaacggttatatttgttcttttccaagaggatttgggtgatagatgatggtaagaggtagattttatttttttagtgttccgtttgtctgaataaagtctgtgtcttcccgaaattgtttggacctgtca

SEQ ID NO: 1242 - DNA, 841 bp, Scabiosa columbaria
aaacactcaccaaccaaacaaaacagatcaaagcaaaactcataatagaatagaattctctcgcttaaattatcatccaaattctcagatctcatcgatcactttacaaatccaaaccctaaaaatcgaagataatcatgtcttcaaccttcagcggcgatgagacggcaccgtttttcggtttcctcggcgctgcggctgcgttggtcttttcatgtatgggagctgcgtacggaaccgcgaagagtggagttggagttgcatctatgggagtgatgaggccggagctggtgatgaagtctattgttccggtggttatggctggtgtgttaggtatttatggattgattattgctgtgattatcagtaccggaattaatcctaaggccaagtcctattacttgtttgatggttacgctcacctttcttctggtttggcttgtggtctcgctggtctctccgctggtatggccatcggaattgttggtgatgccggagttagagccaatgcccagcagccaaagcttttcgttggaatgatccttattctaatttttgctgaagcactggctctctatggccttattgtcggtatcatcctctcttctagagctggtcagtctagagcagactagatgatggtcatttgtatgtaatttttttcagttttagtaagttattacgattaattatctttgcttcttgtttctattatttagcaagaaatatcacgatgttacgtgtgttgcttcattttccttttttgatggctactgttagggaatgctggatgttttcttcttccattcaaataaatcagtgcttgtttctgtcattcact

SEQ ID NO: 1243 - DNA, 898 bp, Scabiosa columbaria
agcagggccacatcaaacaaaaattactctctctccttctatctctctggagaaagaggtgaaaatcgaaatttctcagatccaatccattcattcatcaacagagatctaaaagttccaccatgtcttcaactttcagtggcgatgagacggcaccgttcttcggtttcctcggcgccgcagctgccctcgtcttctcctgtatgggtgctgcgtacgggacagccaagagcggagttggagtcgcctcaatgggagtgatgaggccggagttggtcatgaaatcgatcgttccggtggttatggctggagttttgggtatttatggtttgattattgctgttattattagtactggaatcaaccccaaggcaaagtcttattacctttttgatggatatgctcacctttcttctggtcttgcttgtggtcttgctggtctctctgccggtatggctattggtattgttggtgatgccggtgttagagccaacgcacaacaaccaaagcttttcgtaggaatgatcctcattctcatttttgctgaagctctggctctctatggtcttattgttggtattatcctctcctctcgtgccggtcaatccagagcagattaaacgtgaaggtgaattttgcatttgtgggtttgttgctatttataaagaacattgttgctattactagttatgccatcaccgcttgaaaacttgtaggtccaactgagggtctttcttgtacttaaaaaacggttatatttgttcttttccaagaggatttgggtggtagatgatagtaagaggtagattttatttttttagtgttccgtttgtctgaataaagtctgcgtgtcttcccgaaattgtttggaccggtcataacgtgtattattttagtc

SEQ ID NO: 1244 - DNA, 644 bp, Scabiosa columbaria
gatcaccatgtcttcaaccttcagcggcgatgaaacggcaccgtttttcggtttcctcggcgctgcagctgccttggtcttttcatgtatgggagctgcgtatggaaccgcgaagagtggagtcggagttgcatcaatgggagtgatgaggccggagctggtgatgaagtccattgttccggtggttatggctggtgtgttaggtatttatggattgattatcgctgtgatcattagtaccggaattaatcccaaggccaagtcttattacttgtttgatggctatgctcacctttcttctggcctggcttgtggtctcgctggcctctccgccggaatggctatcggaattgttggcgatgccggagtcagagccaacgcccagcagccaaagcttttcgttgggatgattctcattttaatttttgctgaagcactggctctctatggtcttattgtcggtatcattctttcttctagagctggtcagtccagagcagactagatgatgatcgtcttcgtggcagatccgtatggtttatttgctttttagtaaggttttacaattacattcgtctttttgtttctattatttagcaagaaatatcattatgtacgtggttattagaaccagtagcaacgtt

SEQ ID NO: 1245 - DNA, 869 bp, Senecio madagascariensis
gtcatctctttcgatccgatcaacaaatcatgtcttcaaccttttccggcgatgaaacggctccgttcttcggctttctcggcgctgctgccgccctagtcttctcatgtatgggagctgcatatgggacggcgaagagtggggttggagtggcgtcaatgggagtgatgaggccagaattggtgatgaaatcaattgtgccagttgttatggctggagtcttggggatttatggtttgattattgctgttattattagtactgggattaacccgaaagcgaaatcgtattatttgtttgatggttatgctcatctttcgtccggtcttgcttgtggtcttgctggtctttctgctggtatggctattggtattgttggtgatgccggtgttagagccaatgcacaacaaccaaagctttttgttgggatgattctcatcctcattttcgctgaagctcttgctctatacggtcttattgtcggcatcatcctttcttctcgagctggtcagtcaagagctgactagaaggttgggacgcggtcccatactctgtattctttcagatatttcaagcattttttggctgtcatcgtgcttatagttaaagctgcgaggttgtgtcgttttattcataatttgtgggtggtaaatggtgatgaactatatctgttgagggtaggttgtagactagtttgtagtagtattctgctataataaggttgtccatgttattggtctgatttgttgctatattttttctttttatttctgcaaagaaccattttggacatgtttttattatcccttgtatcactttgcttgattgtgcaaagagttattcaaaatattgtgcaatgttattatgtt

SEQ ID NO: 1246 - DNA, 903 bp, Helianthus annuus
tcattctcgagagccatactcgtcccaccgtgtagccttccatttttaatcactgaaaacaacgtgaatcacacttcgagatacacccgatcacgatcaaccaaaacccaccatacaattcaacttatacaccaatctctctctctctctctctctctctctctcatcagatccgatcatgtcttcaacgttctccggcgatgaaacggcaccattcttcggattcctcggagccgctgccgcacttgtcttctcctgtatgggggcggcgtacgggacagcgaagagcggcgttggagtggcgtcgatgggagttatgaggccagagttggtgatgaagtcgattgtgccggttgttatggctggagtgttggggatttacggtttgattattgctgtgattatcagcactggtatcaaccctaaggcgaaatcgtattacttgtttgatggatacgcccatctttcatctggtttggcttgtggtcttgctggtctttctgctggtatggctattggaattgttggtgatgctggtgtcagagccaatgcacaacaacctaaactttttgtggggatgatcctgatcctcattttcgcagaagcccttgctctctacggtcttattgttggcatcattctttcttctcgagctggtcagtcgagggcggactagaattattggatgatccagctgtgttctaccgccataacttgaagcagttttaaactttagtcttttgggtggaattgaagctgtgtgctgtttatttcataatttgtgggtggtaaatggtgatggtatgttttgatggttggttgtggactagagtgtagttctctggcaataataagggtgtcctgttactggtattatctgttgctatatttatttgtttattt

SEQ ID NO: 1247 - DNA, 834 bp, Helianthus annuus
cggcgggggatgagtttaggtacatacatccagaaagcataaccctcatcagatccgatcaacttttcgtcagatctgcaatcatcatgtcttcaacattctccggcgatgagacggctccgttctttggctttctcggtgccgcagctgctctagttttctcctgcatgggggcggcatatggaacggccaagagtggtgttggagtggcgtcaatgggagtgatgaggccggaattggtgatgaagtcgattgtgcccgtggttatggctggagtgttaggtatctacgggttgattatagcagttattatcagtaccgggattaaccccaaggccaaatcttattatctctttgatggatacgctcatctttcttccggtcttgcttgtggccttgctggtctttctgctggcatggccattggaatcgttggtgatgctggtgtcagggccaatgcacaacaaccaaaactatttgttgggatgatcctgattctcatttttgccgaagctttggctctctacggtctaatcgttggcatcatcctttcttctcgtgcgggtcagtcccgagccgactagaagagcagcggtcttggtggactatcctgtctctgtggtggtgtcggttgagttgcagacatgatcaattctttggtggtgatgataccttggcctatggctacgctcttccagtaggttttagaccaagctctagctctcctttataataaattcacctcttttattgtatactggataattatttttgcacattttctccacatttgttggtaactatttattttatggtcaagaactcagtttcata

SEQ ID NO: 1248 - DNA, 751 bp, Helianthus annuus
acaaccgacgatgtcttcgacgttctccggcgacgaaactgctccgtttttcggcttcctcggcgccgctgctgcgttggtcttctcttgtatgggagcagcctatgggacggcaaagagtggcgttggagtggcttcaatgggagtgatgaggccagagttggtaatgaagtcaattgtgccggtggttatggctggagtgttgggtatttacggtctgattattgccgtgattattagtactgggattaaccctaaggccaagtcttattatctgtttgacggatacgctcatctttcttctggtcttgcttgtggtctggctggtctttctgctggtatggccattggaatcgtcggtgatgctggtgttagggctaatgcacaacaacctaaacttttcgttggaatgatcttgattctcatttttgctgaagctttggccctctacggtcttattgttggcatcattctttcttctcgagctggtcaatccagagcggattagaatcgttgatcgtgggtctcacgagtgccttaaattgatcaatattcttctcctcttgttagaggtatggtttgttttacctttctttggtgtagcttgtagactagattcttgtactcccttcaataaagtcattttgatgcttttttttttttttgcaaaaataagtcttgggacatgtcaagatctggaaatcatggattgtgatttatttgtattgtacaagttataataacatttttt

SEQ ID NO: 1249 - DNA, 881 bp, Helianthus annuus
cgggggtgatgagttcgatcatacatccagaaagcataaccctcatcagatccgatcaacttttcgtcagatctgcaatcatcatgtcttcaacattctccggcgatgagacggctccgttctttggctttctcggtgccgcagctgctctagttttctcctgcatgggggcggcatatggaacagccaagagtggtgttggagtggcgtcaatgggagtgatgaggccggaattggtgatgaagtcgattgtgcccgtggttatggctggagtgttaggtatctacgggttgattatagcagttattatcagtaccgggattaaccccaaggccaaatcttattatctctttgatggatacgctcatctttcttccggtcttgcttgtggccttgctggtctttcggctggcatggccattggaatcgttggtgatgctggtgtcagggccaatgcacaacaaccaaaactatttgttgggatgatcctgattctcatttttgcggaagctctggctctctacggtctaattgttggcatcatcctttcttctcgtgcgggtcagtcccgagccgactagaagagcagcggtcttggtggactatcctgtctctgtggtggtgtcggttgagttgcagacatgatcaattctttggtggtgatgataccttggcctatggctacgctcttccagtaggttttagaccaagctctagctctcctttataataaattcaccccttttattgtatactggataattatttttgcacattttctccacatttgttggtaactatttattttatggtcaagaactcagtttcctactttcatcacatgtatgaatacccaacaacgggacgttgctttttttggt

SEQ ID NO: 1250 - DNA, 792 bp, Helianthus annuus
ccccgatcacgatcaaccaaaacccaccatacaatacaccaatctctctctctctctcatcagatccgatcatgtcttcaacgttctccggcgatgaaacggcaccgttcttcggattcctcggagccgctgccgcacttgtcttctcctgtatgggggcggcgtacgggacagcgaagagcggcgttggagtggcgtcgatgggagtgatgaggccggagttggtgatgaagtcgattgtgccggttgttatggctggagtgttggggatttacggtttgattattgctgtgattatcagcactgggatcaaccctaaggcgaaatcgtattacttgtttgatggatacgcacatctttcatctggtttggcttgtggtcttgctggtctttctgctggtatggctattggaattgttggtgatgctggtgttagagccaatgcacaacaacctaaactttttgtggggatgatcctgatcctcattttcgcagaagcccttgctctctacggtcttattgttggcatcatcctttcttctcgagctggtcagtcgagggcggactagaattattggatgatccagctgtgttctaccgccataactcgaagcagtttttggttgtcttttgggtggaattgaagctgtgtgctgtttatttcataatttgtgggtggtaaatggtgatggtatgtgttgagggttggttgtggactagagtgtagttctctgcaataataagggtgtcctgttactcgtattatctgttgctatatttatttgtttattt

SEQ ID NO: 1251 - DNA, 811 bp, Helianthus annuus
gatgagttagatacatacatccagaaagcataaccctcatcagatccgatcaacttttcgtcagatctgcaatcatcatgtcttcaacattctccggcgatgagacggctccgttctttggctttctcggtgccgcagctgctctagttttctcctgcatgggggctgcctatggaacggccaagagtggtgttggagtggcgtcaatgggagtgatgaggccggaattggtgatgaagtcgattgtgcccgtggttatggctggagtgttaggtatctacgggttgattatagcagttattatcagtaccgggattaaccccaaggccaaatcttattatctctttgatggatacgctcatctttcttccggtctcgcttgtggccttgctggtctttctgctggcatggccattggaatcgttggtgatgctggtgtccgggccaatgcacaacaaccaaaactatttgttgggatgatcctgattctcatttttgcggaagctctggctctctacggtctaatcgttggcatcatcctttcttctcgtgcgggtcagtcccgagccgactagaagagcagcggtcttggtggactatcctgtctctgtggtggtgtcggttgagttgcagacatgatcaattctttggtggtgataataccttggcctatggctacgctcttccagcaggttttactgttttagaccaagctctagctctcctttataataaattcacctcttttattgtatactggataattatttttgcacattttggtaactatttattttatggtcaagaactc

SEQ ID NO: 1252 - DNA, 1243 bp, Panicum virgatum
tcattcgactcaagtcaactgtccaggactccaggtacccggctggagtcaacggtgctgcccctctccggtcgcatgggcaaaaccgtccacatcacaaatctccccattcccacctcgcacacagcgccgtggccctctcgtctttcttccccacgaccccaccccacccacgagctcctcagatcagatcggcgacgcccaaatccgaagcagaggagcgaaatctcgagcgctcgtgccggcgacgaccacgacaaggaggccgcggcgcgagagctccccagggatctatttctcttcgcagcaccagcggcagcagcagcaagaggaagatgccgtcggcgttcagcggcgatgagaccgcccccttcttcggcttcctcggcgccgccgccgcgctaatcttctcatgcatgggggcggcgtacgggacggccaagagtggcgtcggcgtggcgtccatgggtgtcatgcgcccggagctcgtcatgaagtccatcgtgcccgtggtcatggctggtgtgctcggtatctacggcctcatcattgccgtcatcatcagtactgggatcaaccccaaggccaagccatactacctcttcgacggctatgcccacctgtcgtctggccttgcctgtggtcttgctgggcttgctgccggcatggccattggcattgtcggtgatgctggtgtcagggccaacgctcagcaacctaagctgttcgtgggcatgatcctcatcctcatttttgccgaagcactcgccctctacggtctcatcgtaggcatcatcctctcatcccgcgccgggcagtcccgtgcagactaggcgcgttccagatgtcaataccatgtctggccctggcagggccctgttttatattcatgagacaagaaggcggagctctttagaggcttattttcatactgtctagttttcgttcttctgtttgggtctgaaacatgtgcaaccaagggaggtgggacttccctttgtggtgccgatgccattctttatccgtcgtggtggtggtgggctgtggtcgatgctcattatttatgcacagcttttctgttggggtgtggtacggctggacggcgttgtaatgtggtgaataagaataagcaaggacatgcaacacgacgagtgtcgaggacaccttttgttcatctgtttcgttcttatattatgatggtgatgttatgactagcgctggggcaaattatacattcgtggca

SEQ ID NO: 1253 - DNA, 1082 bp, Panicum virgatum
ccacgcgtccgcggacgcgtggggccctctcgtctttcttccccacgaccccaccccacccacgagctcctcagatcagatcggcgacgcccaaatccgaagcagaggagcgaaatctcgagcgctcgtgccggcgacgaccacgacaaggaggccgcggcgcgagagctccccagggatctatttctcttcgcagcaccagcggcagcagcagcaagaggaagatgccgtcggcgttcagcggcgatgagaccgcccccttcttcggcttcctcggcgccgccgccgcgctaatcttctcatgcatgggggcggcgtacgggacggccaagagtggcgtcggcgtggcgtccatgggtgtcatgcgcccggagctcgtcatgaagtccatcgtgcccgtggtcatggctggtgtgctcggtatctacggcctcatcattgccgtcatcatcagtactgggatcaaccccaaggccaagccatactacctcttcgacggctatgcccacctgtcgtctggccttgcctgtggtcttgctgggcttgctgccggcatggccattggcattgtcggtgatgctggtgtcagggccaacgctcagcaacctaagctgttcgtgggcatgatcctcatcctcatttttgccgaagcactcgccctctacggtctcatcgtaggcatcatcctctcatcccgcgccgggcagtcccgtgcagactaggcgcgttccagatgtcgataccatgtctggccctggcagggccctgttttatattcatgagacaagaaggcggagctctttagaggcttattttcatactgtctagttttcgttcttctgtttgggtctgaaacatgtgcagccaagggaggtgggacttccctttgtggtgccgatgccattctttatccgtcgtggtggtggtgggctgtggtcgatgctcattatttatgcacagtttttctgttggggtgtggtacggctggacggcgttgtaatgtggtgaataagaataagcaaggacatgcaacacgacgagtgtcgaggacaccttttgttcatctgtttcgttcttatatt

SEQ ID NO: 1254 - DNA, 852 bp, Tragopogon dubius
taaacaaaatcctcagatccgatcaacttttctgcagatctacactccaaattcaatcatcatgtcttcaacattctccggcgatgaaacggctccgttcttcggttttctcggtgccgcagcagccctagtcttctcttgcatgggggcggcatatgggacggcgaaaagtggtgttggtgtggcgtcgatgggagttatgaggccggagttggtgatgaagtcgattgtgccggtggttatggctggagtgttaggtatttacggattgattattgctgtgattatcagtaccggaattaacccgaaggctaaatcttattatctttttgatggatacgctcatctatcctctggccttgcttgtggccttgctggtctttctgctggtatggccatcggaattgttggtgatgctggtgttagagcgaatgcacaacaaccaaagctatttgtggggatgattttgatattgatttttgctgaagctctggctttatacggtcttattgtgggcatcattctctcttctcgagctggtcaatccagagctgactgatatgttattatcctttctcttattctatcagacatgatgaattctttggtgatggtgatggtgatgataccttgggctaggccactttctacaccaaattctagctgttgctgtaataagctttgtctcttttacgtatgttatatactggataattttgcagatttgttgttttatgttcaagatttctgttttttcatccatactctttcaagatacctttatcaggaaagacgaaatattttcaaaatctactacacaatggatgtaatgaagttgcataaattagaagt

SEQ ID NO: 1255 - DNA, 860 bp, Tragopogon dubius
aaccagggccatacaattcaactaacatatataacgtcatctcccctctctctcattctctctctcgatagcctcagatccgcgatcaatttctctgcaaatttaaaccctaacttaatcttgatcaaccgatcatgtcttcgacattctccggcgatgagacggctccgttcttcggctttctcggcgccgctgccgccctagtcttctcctgtatgggggcggcgtatggtacggcgaagagcggtgttggagtggcgtcgatgggagtgatgaggccggagttggtgatgaagtctattgtcccagttgttatggctggagtgttgggtatttacggtttgattatcgctgtgatcatcagtaccgggattaaccctaaggctaagtcctattaccttttcgatggctatgctcatctttcttccggtcttgcttgtggacttgccggtctttctgctggtatggctattggaatcgtcggtgatgccggtgttagagcaaatgcacaacaaccaaaactttttgttgggatgattttgattctcattttcgctgaagctcttgctctctacggtcttattgttggcatcattctttcttcccgagctggtcaatccagagcagactagaaaggtcagactcatgtgttcttcagctataacttctgcatttttttgaactttcattttgggggtagggttgaagctttgtgggtgtgtggtttttcataatttgtgggtgatgatatgtgttttgagggggtagttgtagggtagattgtgggttttcggtataataaagatgtctctgtactcgtattatttatttattttgcaaagaacctgtttattcttagt

SEQ ID NO: 1256 - DNA, 982 bp, Triphysaria pusilla
gaaattccgccattacggacggagaagtgttccacttcctaatcaatcgaagcagatattgtgcactccccaaacacaaaaacataataaaagagcctctattaaatccaactcattcaaccccctctttctcatctctctagatccgatccgatcaccgcagaaatccaaatcgatcaaatatgtcgtcaaccttcagcggcgatgaaacggcaccgttcttcggcttcctcggcgccgctgccgccctcgtcttttcctgtatgggagcggcctatggcacggcgaagagtggcgtcggcgtggcgtcgatgggtgtgatgcggccggagctggtgatgaagtctattgtgcccgtggtcatggctggtgttttgggtatttatggtttaattattgctgtgatcattagtacaggtattaaccctaaggccaagtcatactacttgtttgatggttacgctcatctttcttccggactctcttgtggtctcgccggccttgctgctggtatggctatcggaatagttggagatgctggtgttagggccaatgcacaacaaccaaagctctttgtcgggatgattcttatccttatttttgctgaagccttggctctctacggtctcattgttggcatcatcctttcttcgcgtgctggtcagtctagggctgattagaagtgtacacatttcaggcacggattgttgagtttcttgctatcaagtaagaatatcataattatgttctccctcgttagcatggtagtatggccatgacagaatcttcaagttcaaaaatgtttttgtttttgtgtgtggaaattgtttggccataagaattgagcgtttgatgtgtatgtcattagattgtttatgttgatgagaagtttcatttaccctgaataaaaaatatttttattggtgatttatctttcgaggacctcatttgatttgtgtaagaccaatattcgtgtattgtt

SEQ ID NO: 1257 - DNA, 1812 bp, Triphysaria pusilla
caccgcagaaacccaaaccgatcaaatatgtcttcaaccttcagcggcgatgaaacggcaccgttcttcggcttcctcggcgccgctgccgccctcgtcttttcctgtatgggagcggcctacggaacggcgaagagtggcgtcggtgtggcgtcgatgggtgtgatgcggccggagctggtgatgaagtctattgtgcccgtggtcatggctggtgttttgggtatttatggtttaattattgctgtgatcattagtacaggtattaaccctaaggccaagtcatactacttgtttgatggttacgctcatctttcttctgggctctcttgtggtctggccggccttgctgctggtatggccatcggaatagttggagatgctggtgttagggccaacgcacaacaaccaaagctctttgtcgggatgattcttatccttattttcgctgaagccttggctctatacggtctcattgttggcatcatcctttcttcgcgtgctggtcagtcgagggccgattagaagagtacacaacatcttagaaaaaaaataacgcaaatacaacatatacccaccccccagcccacccctgtctgcacagattagaaaaactacaaatgtattgtgatttgttctacagacgctgctaaaacttatatgattacatggctatgatcaatttaagcattgaacaaaatcagatattaaattggacaacaaggattaaatattttctgtggagaaaaggcgagcaaactaactccaaacaaaatgcactgtttgaaatccgtgtacaaaaatctgagctcgacctcctatttgccgcctttaaatgctgaaagagagaagaatgacctcgttgctttggttgtggtcacagaagctgaaacgtgacccggctgaaactgctgtgataaactctgagcattgtgtttgctaacatttgctggatgttcataatcagaggttccacttttctggtgaccattgttcatcgaatgaagggttgatttcctcagtaaattctcaccgcttcttttactcgtaagtttcaaatcatcagcatcatcctctccttcagaaaacacaggcgggctcgaccagtcagtcgtgtttgcctcgtttttactcttccgagcgaattttaacagcctcttcaatcctttgggcacttctttctggtagaccatcggcaaaggattctcagcatttccccattcgaaaaaatcaggctcactgctctcctcaagaagcatttgtgagagagagtgacgaactcgaggactcgacacttctactggggctatatgaatatcggacggtggtaaacccacgctatggtcaacagaggtaatcgagcgatcttcattttcctcgatttccacccaagctctgggtgaaatggtcaattcttcttcagcctcaggttctaactctggcaaaatcagtaggtcagtgccattatcatcagtaacagggctaatttgactaaacccgttgttttcacacttctcaggggttctaggtgtgggccccggttccataactgagtcattattcaactcttctgtttttttcgtttctcgatgaataactggatcagcagagacggaagttgttacattatcttgagtcggggcccgatctttggactttctcaacgggtcctgaggaagagatgtttttttcgtaacggtcggatttacaccagacatagttttagagacttttcgaagagatggctttgattcgattggaacgatactactcttcttggttgccttgctatgcatgttagatttcgtcgag

SEQ ID NO: 1258 - DNA, 1074 bp, Triphysaria pusilla
acccacagccaactcctccacatctactcagtaattatagaaggcctaaattattccatcggcagatcaagtctcccgcaaaaacaaggcaatcctttcagatccgatcaccgcagaaatccaaagtccaccgaaaatgtcttcaactttcagcggagatgaaacggcaccattttttggcttcctcggcgccgccgccgctctagtcttctcctgcatgggagcggcgtacggtaccgctaagagtggcgtcggagtagcgtcgatgggtgtgatgaggccggagctggtgatgaagtctattgttccggtggtcatggctggtgtgttgggtatttatggtttgattattgctgtgattattagtactggtattaaccctaaggctaagtcttactacttgtttgatggatatgctcacctctcttctggactctcttgtggtctcgccggccttgctgctggtatggccattggaatcgtcggagatgctggtgttagagcgaatgcacaacaaccaaagctctttgtcgggatgattcttatcctcattttcgctgaggccttggctctgtacggtctaattgttggcatcatcctctcttctcgtgctggtcagtccagagcagattagacgactactcatctcttgacactagttgaattactctctgccgagaaaggattatacgctttttccctggttagcatcgcagtttggccatggcattttttcaagcttaagttttcagttgtgcatgacaaattgcttggccaaaatattcgagagggtattttggtggggtgtagagaaggttgttttattcgtgaataaagccgtattattttcatggctgcgtatctcgcaaggaccatatttgatttgtgtaaactgttagttgtattatgttttcggaattatacttttttccgtttccgttgttgactaacatattttttctttcgttttatagactccattcttattgggatatataatgttatagaaataattaattagatagtgtatcagatatatttgagaaagctgtattgttgaaagggaatattatt

SEQ ID NO: 1259 - DNA, 842 bp, Triphysaria pusilla
aaatcgaaacctcatcagaaatcaaatcatcatctccgtgtgatttttttcttatcaatattcaatcgaattcgaaaatgtcttcaaccttcagcggagatgaaacagctccattcttcggatttctcggcgccgctgccgccctcgtcttctcctgcatgggtgcggcatatggaacagcaaagagtggagttggggtggcatcgatgggtgtgatgaggccggagcttgtgatgaaatcgattgtgccagttgttatggctggtgttttgggtatctatggattgattattgctgtgattatcagcactggtattaaccctaaagctaagtcttattaccttttcgatggatatgcgcatctctcttcgggcttgtcctgtggccttgctgggcttgctgctggaatggctattgggattgtaggagatgctggtgttagggctaatgcacagcagcctaagctttttgttggaatgattctcattctcattttcgctgaagccttggcactctatggtctgattgttggaatcatattgtcttcacgagccggccagtccagagctgactagatgtgatcgatctctggtaattttattatactcgtgtataatttattttacgtcctggaaaatgaaatccgggagtttgaatttctatttgttacatacataattcttcaccgttacgaagcactggtaatttccctctatattcatttaatgatagtgtgtgctatttgtggtattagacaaggatcttataactcttgttttgttgaataagtgcttgaacagctatttgaattggataattcaggtttcctcaaaaaaaaaaaa

SEQ ID NO: 1260 - DNA, 825 bp, Triphysaria pusilla
tacagatctaaagtcgaaacctcatcacatatcatcgactctgcgtgtttataattttctgtcaataaatccgatcaaaaataaaaaatgtcttcgaccttcagcggagatgaaactgctcctttcttcggctttctcggcgccgcggccgccctcgtcttctcctgcatgggtgcagcttatggaacagcaaagagtggagttggcgtggcatcgatgggtgtgatgaggcccgagcttgtgatgaaatcgatcgtgccagttgttatggctggtgttttgggtatatatggattgattattgctgtgattattagcactggtatcaaccctaaggcaaagtcatattacctttttgatggctatgctcatctctcttcgggcttgtcgtgtggacttgctgggcttgctgctggaatggctattgggattgtaggagatgctggtgttagggctaatgcacagcagcctaagctttttgttggaatgatcctgattctcattttcgctgaagctttggcactctatggtctgattgttggaatcatattgtcttcaagagccggccagtccagagctgactaagtgtaatcgcaggtaatttaattatgctcgtgtataatttattctatgccttggaaaatgaagtgtgcgagtttgaatttctatttgttacttacattattcttcacccccaaggtacactagtgatttccctctatattcatttaattgtagtttgtgctatttgtgggattagacgagggtctcatgactcttgttttatcgaataagtgcttgaacagctatatgtattggttaatt

SEQ ID NO: 1261 - DNA, 761 bp, Triphysaria pusilla
atcaacacacagagagacaagggcgagatctaaatccgagaagtccaaaccctagcaacaatcaatcttccaaaatcaatttagatcggaagaaagtatgtcttcgacttttagcggcgatgaaactgctcctttcttcggatttctcggcgccgccgctgccctcgtcttttcctgtatgggtgcggcttatgggacagctaagagtggtgtaggtgtggcatccatgggggtgatgaggccggagctggtgatgaaatcgattgtgccagtggtcatggctggtgttttgggtatttacggtttgattattgctgtcattatcagcactggtatcaaccctaaagccaagtcttattacctttttgatggttatgcccatctatcttctggcctctcgtgtggccttgccgggcttgctgctggaatggctattgggattgtgggagatgctggtgttagggccaatgcacagcaaccaaaactatttgttgggatgatccttattctcatttttgctgaagctttggcgctctatggtcttattgttggaattattttgtcttcacgagctggccagtctagagctgactaagaaactgggcgactaagaagctgggcgactgattaaatttcatttccggaaatatatatcgactcctgggccgagagtggagtgaaatttcagttgtggcatgtttgggtgatcatgtatttgactagtagtcactatcgaaattatatattaattttcacttcac

SEQ ID NO: 1262 - DNA, 919 bp, Utricularia gibba
atctgaggcgaacggactcacaattttgttggattcttcaatcgaagtgatctcaatcggaaagaaataatgtcttcgacgtttagcggggatgaaactgctccattcttcggcttccttggcgccgcggctgccctagtcttctcctgtatgggtgcggcctatggcacagcgaaaagtggtgtgggtgttgcctcaatgggtgtgatgaggccggagcttgtcatgaaatcaattgtcccagtggtcatggctggtgttcttggaatttatggtttaattattgctgtgatcatcagcacgggaattaatcctaaagccaagtcttattacctttttgatggttatgctcatctatcttctggccttgcttgtggcctcgctggtctcgcagctggaatggctattggcattgtcggagatgctggcgtcagggcaaatgcacagcaaccgaagctctttgtcgggatgattcttattctcatttttgccgaagctttggcactttatggtcttattgttggaattatcttgtcttcgcgtgctggccagtccagagcggagtaggtattcagggctccctttagaagctttagtaacaggtgggaagaaatcactctatatggaaattggttccagatcctgtatttctcctcgttttgcatgtgaattcttggttcaatgtgatgtcatttctgcagaataagggctgcattggagcttccactgtcactgctcattcatgtttccactttcattgtgcgaacattcacatagtttccttgatatatggtccgcgtcgtctatttattccgtggtcgcttgatatttgattgtgattgttctcccgtgtttgtgttgttcaaattcgagcctgttgaacagcccgagtatttatatagacttggagagcagcatt

SEQ ID NO: 1263 - DNA, 942 bp, Valeriana officinalis
ctcaataaactgattcgccgatcttggtttgccatcatcatctacctttgatgacaaaactattggttctcgtgaaagaggtgattatcaaaaattatcagatccgatcagatctattcctcttcacagatctaaaatccccagctagttcagctctacaatcatgtcttcaactttcagcggcgatgaaacggcaccgttcttcggctttctcggcgctgcagctgctctcgtcttctcctgtatgggagctgcttatggaacggctaagagcggtgtaggagttgcctccatgggagtgatgaggcctgagctggtgatgaaatcgattgttccggtggttatggctggagttttaggtatttatggtttgattatagctgttatcatcagtaccggaattaaccccaaggctaagtcatactacctctttgatggatatgctcacctttcttccggtcttgcttgtggtcttgccggtctctctgctggtatggctatcggtattgttggtgatgccggtgttagagcaaatgcacaacagccaaagctttttgttgggatgatcttgattctcatctttgcagaggctctggctctgtacggtcttattgtcggtattatcctctcatcgcgtgctggtcaatccagagcagattgaagaaggtgattttgaagagatacgagtgtttgtttgttgctatttataaacaactattactattattgcccgttcactaagttgtaggttcaattgagaactttaaacttaattggcaatgtttcttctttgttcaaaacggatttggggaagttaattttttttgtctggttggggatagtttaaggatttagggtttcgttctcctgaataaaaatgtttgtgttccatttttcttcttttctattcatcggtatttttttccagattgttatttcatc

SEQ ID NO: 1264 - DNA, 989 bp, Valeriana officinalis
tcatcaaacaaatcactagtcttctctttcgcgtggaagaggtgattgattatcagatctctgtaatttgtcttcacagatctagaatcaccagcagctgcttcaccccaaccaacaatcatgtcttcaacattcagcggcgatgaaactgcaccgttctttgggtttctcggagctgcagctgctctcgtcttctcctgtatgggagctgcttatggaaccgcaaagagcggggtaggagttgcgtccatgggagtgatgaggcctgagctggtgatgaaatcgattgttccggtggttatggctggagttttaggtatttatggtttgattatagctgttatcatcagtaccggaattaaccccaaggctaagtcatactacctcttcgatggatatgctcacctttcttccggtcttgcttgtggccttgccggtctctctgctggtatggctattggcattgttggtgatgccggtgttagagcaaatgcgcaacaaccaaagctttttgttgggatgatcttgattctcatctttgcggaggcactggctctgtacggtcttattgtcggtattattttgtcatcacgtgccggtcagtccagagcagattgaagaaggtgaatttgagtcgttatatctgttggtttgttgctatttataaacaactattactctttgcggtctaaatttatgccgggaacttgtatgtaaatggcgatgtttctcttttgccaaatgtatttgggggatttctttttggtgctattaggcggtaaattttaggttttagtgttcattgccaaaataaagttgtttctggttcttgtttctctgtttttatttatgggtattttgcaaattgggcaatgtcataacatgcactgtacttatatttggcagattatttaccttatgttgacactttgttgatactgctgtgctatttacttgggctttgttcatagccatgtacttgtaccaaa

SEQ ID NO: 1265 - DNA, 974 bp, Vinca minor
ggaacgaaacagaagagtcagagttaacaccatcatcatcatcgtttcgcagagttcttggatcaattttcccgatcgatctctcaaaatcttcaatccaaaagagagatcttaaagatgtcttcggttttcagtggagatgaaactgctccgttctttggcttccttggcgctgctgctgctctcgttttctcctgtatgggagctgcatatggaacagcgaagagtggggtaggagttgcgtcgatgggagtaatgaggccggagctggtgatgaaatctattgttccagttgttatggctggtgttttgggtatttatggtttgattattgctgtgattattagtactggaatcaaccctaagaccaaagcctattatctctttgatggatatgcacatctttcttctggcttggcttgtggtcttgctggcctttcagctggaatggctattggcattgtcggcgatgccggtgtcagagcaaatgcacaacaaccaaagctttttgttggcatgattctcatcctcatctttgctgaggctttggctctttatggactaattgttggcatcatcctttcttcccgtgctggtcaatccagagctgattaatcaagtaagatctttcgtcttcttacttgtttagagatgagtcatgctagtcgtgaggcacactctcttgtggttatattttctatttcttcactctattatttagtggttttatgctgcttttaaatctggagaaaccttctcccatgaataaagattggttttgctggttttgctctttattctcattgctgtacttttcccggtgagaaaatgtaaactatttatggtacttagtgccactgtaataggattttttgtttttgttcatttttaattgtaaaactgggaaggattgtaactaaatttatttatgtgctgttgaataatgagttggtaaattcgttgaaaacttgttt

SEQ ID NO: 1266 - DNA, 897 bp, Vinca minor
taataataccaaatccacggagttcttcgatcaattttctaatcgatctctcaaaatctttcaattccaaagagagatcttaaagatgtcttcggttttcagtggcgatgaaaccgctccattcttcggcttcctcggcgctgctgctgctctcgttttctcctgtatgggagctgcatatggaacagccaagagtggggtaggagttgcgtcgatgggagtaatgaggccggagctggtgatgaaatctattgttccagttgttatggctggtgttttgggtatttacggtttgattattgctgtgattattagtactggaattaaccccaagaccaaagcatattatctctttgatggatatgcacatctttcttctggcttggcttgtggtcttgctggcctttcagctggaatggctatcggaattgtcggcgatgctggtgtcagagcaaatgcacaacaaccaaagcttttcgttggtatgattctcatcctcatctttgctgaggctttggctctttatggactaattgttggcatcatcctttcatcccgtgctggtcaatccagagctgattaaacaggtaagatctttcatcttcttacttgtttagaggtgagtaatgcctagtcatgaggtgcattctcttgtgcttatacactaattcttcgatctattatttagtgattttatgctgcttgtaaatctggagaaaccttctccttgaataaaagattggtttcgttgttctgctctttattctcgttgctctacttttctcagtgagaaaacgaaatctgtttatggtaattagtgtcactgtaataggatattttttgttcatttcttattgtaaaactggtaagaattgtaactaaacttatttatgtgct

SEQ ID NO: 1267 - DNA, 1305 bp, Vinca minor
gattgatctctgaaaatcctctcaattcataagagagatactaaaagatgtcttcggttttcagtggcgatgaaactgctccattcttcggattccttggcgctgctgctgctctcgttttctcctgtatgggagctgcatatggaaccgccaagagtggggtaggagttgcgtcgatgggagtgatgaggccggagctggtgatgaaatctattgttccagttgttatggctggtgttttgggtatttatggtttgattattgctgtgattattagtactggaattaaccctaagacgaaagcatattatctctttgatggatatgcgcatctttcttctggcttggcttgtggtcttgctgggctttcagctggaatggctattggaattgttggcgatgctggtgtcagagcaaatgcacaacaaccaaagcttttcgttggtatgattctcatcctcatctttgctgaggctttggctctttatggactgattgttggcatcatcctttcttcccgtgctggtcaatccagagctgattaaacaagtaaggtctttcatcttcttacttgtgtagaggtgagtcatgctagccatgaggcgcgctatcttgtggttatacattttatttctttactctatttattagtggttttatgcctgcttgtaaatctagagaaaccttttcctcgaataaaaatattggtttcgctggttttgctttttattctcattgctgtacttttccagtgagaaaaaggaaactgtttatggtaattagtgccactgtaataggattatattctgttaatttcttattgtatctaaacttatttatgtgctatggaagaatgagttggaagctcattgaaaaattgttgctgtatggaaaaggttactctttatatcttagcaggttggtgatattgtctatagtttgtagaagtaacttacctttctttattgtcgaattactatctctaattaattttcgttacggttacgtactaatgttggggaaaccgaaacttgtacaacccttaccttgttttttcctttcggtaagttttagttttgttacggtccgttcgtttagtttgttgggttgggcgaccaacgttagttctttttttcctttgtaggtcttgtattggttagtcttctacctagttaaaaggaaagtgttgggagttaggtttaaggtaatagaggtaattttagttaatgcaacgtacccaaaactaactaaccttccaattcccttcctatttttttgtttggttattcttttagtaaggcttgg

SEQ ID NO: 1268 - DNA, 911 bp, Citrullus lanatus
atttcagagagtcatagcgaggcgacaaaggattgggcatatttgaagaagaggaagaagagagagacagagagcgggtcgagatctgatctaatcggagaccttcttcatcttcaccgttgaacccagaaaagatgtcgtcaactttcagcggcgatgaaacggcacccttcttcggcttcctcggcgccgctgcagccctcgtcttctcctgtatgggagctgcttatgggacggcgaagagcggggtgggagttgcgtctatgggagtaatgaggcctgaactggtgatgaagtcaattgttccggtggttatggctggagttttgggtatttatggtcttattattgctgtaattattagtacaggaattaacccgaaggccaaatcttattacctcttcgatggttacgcacatctctcctctggccttgcttgtgggcttgccggtctgtccgctggcatggctatcgggatcgtcggtgatgctggtgttagagccaatgcgcagcagcctaagcttttcgttgggatgattcttattttaatttttgccgaagctttggcactctatggacttattgttggcattattctctcttcccgagctggtcagtcaagagctgattaagtggatgctttgtgtgtggactggagtttgtgtagtatgtctcctctttttgtcaagaattggttttgtactcttgagtaaatgggttattattatggtttaagcctactctctcaaattgttcttgtgaggtgtgattgctgtaccacacggatcgtgtagtagttatatatgaatttggaattaattattcttctcaataaaatattaaactttgttacctttaacattgctttaagtttgctgaagcttccctttaaattgtgtgtttgtgaaaaa

SEQ ID NO: 1269 - DNA, 916 bp, Citrullus lanatus
tattccagataacgtggagagattttatagaatcaaaagacataaagaaaaggcgaaaaacaaaaacgttgggtatctgaagaaaaacgcaaaatcagagagagagagagagagagagcgaaaaagcttcagatctgatcggagatcttcatcttctttgtccgaccggtaaaaatgtcgtcaacgttcagcggtgatgaaacggcacccttctttggctttctcggtgccgctgcggcccttgttttctcttgtatgggagccgcttacgggacggcaaagagcggggttggtgtggcgtcaatgggagttatgaggccggaattggtgatgaagtcgattgttccggtggttatggcaggagttttgggtatttatggtttgattattgctgtgattattagtacgggaattaaccctaaggctaaatcttattacctcttcgatggctacgcccatctctcctctggtcttgcttgcggcctcgccggtctctctgctggcatggctattggcatcgtcggcgatgcgggcgttagggccaatgcacaacaacctaagctttttgttgggatgattctcattctaattttcgccgaagcacttgctctttatggacttattgttggtattattctctcttctcgagctggtcagtcaagagctgattaagtgaatgttttgcgcttggaatttgtgtattatgtctcttttttcctttctttctctcatgaattgtttttgtagttctctaattagaaatggtcatgactaagttttactttctcaaatattcttgtgttgtgtgatttctgtaccacacggattctgtactcataatcaattattctctcaataaacacaaaacattgtttccttgcctgtttattgtgctgaatgttgctcttgaatttgt

SEQ ID NO: 1270 - DNA, 644 bp, Triticum aestivum
ctctgactcctccgggctccggcggccggcgagagagatcccaccctcaccgacggcgagcgaccaccatgtcctcctccaccttcagcggcgatgagaccgcccctttcttcggcttcctcggcgccgcctccgccctcgtattctcctgcatgggcgccgcctacggcaccgccaagagcggcgtgggcgtggcgtccatgggggtgatgcgcccggaactggtgatgaagtccatcgtccccgtcgtcatggccggagtgctcggtatctacggcctcatcatcgccgtcatcatctccaccggcatcaaccccaaggccaagccctacttcctcttcgacggttacgcccacctctcctccggtctcgcctgcggcctcgccggtctcgccgccggcatggccatcggcatcgtcggcgacgccggagtcagggccaatgcgcagcagccaaagttgttcgtgggcatgatcctcatccttatctttgcagaagctcttgctctgtatggcctgattgttggtatcatcctctcgtctcgtgcgggccaatctcgagcggattagagggttttggaagaacaagacacggttcaccattgtattctattccaagtgttaatttcttcttatagactgctt

SEQ ID NO: 1271 - DNA, 1591 bp, Ambrosia trifida
taaatggtgttgcctcttccaattggagcccttcctccttcttcacccctaaatctttgcctttttctacgcaatgggtacacaagcaagctaaatccaaatcatccagaattctacaatccatccatgtatctgatggaaatgatctgttacaagatgctgaatcagctaaaattaacagaaggaaagggttggtgacctctgtggggttattagcagtgacattgggacataattttgttgatggagttgctatggcttctaattttgctgacatgccagccttaaaagggaaggattatggaaaatcaaagatgaagtatccagattatgccgagacaagctcaggactccagtataaggacctgcgatcaggaaatggtataatgccaaataagggggacattgtagtggttgattgggatggctacacaattggatattatgggcgaatatttgaagctagaaacaagaccaaaggtggttcttttgagggagatgataagtccttttacagattccgattaggtgaccatgaggtgataccagcttttgaggaagctgttgcaggcatgtctttgggtggcattagaaggatcatcgtgcccccggatcttggatacccagaaaatgattacaacaagagtggtccaaaacctacaacattttcgggtcaaagggcactggattttgttctgaagaaccaaggattgatcgacaaaacacttttgtttgacatcgagcttttaaacattatacccaacaactgaagaaccctggtttcgtttatacaagtgtgatgtattacattataaagatcacaacgttttacctctgtttatctgttttcaaaaaagaaaaataatgacagcaaaaacaattttattgagggtgggaactagaatctaggctacaagtagaacaaaccacaactctaatgagaggatatagaaaaatgcttactttatcggaataaacatgacccacaagcaattcttctaatccgctctggattgacccgctcgagaagaaaggatgatgccaacaataagaccatacagggccagagcttcggcaaaaatgagaatcaagatcattccaacaaaaagctttggttgttgtgcattagccctgacaccagcatcacccacaattccaatagccataccagcagatagaccagcaagaccacaagccagaccagaagaaagatgagcatatccatcaaacagataataagacttagccttagggttaatcccggtactaataatcacagcaataatcagaccgtaaatccccaacactccagccataaccactggcacaatcgacttcatcaccaactcgggcctcatcacccccatcgaagccactccgactccactcttcgccgtcccatatgccgcccccatacaggagaagacgagtgcagcagcagcaccaaggaagccaaaaaacggagcagtttcgtcgccggagaacgtagaagacatgatcggttgatctagggtttggatctgaacagatattgattggattttagggatttttgtcagatattttatacgatatccagacagacagagcc

SEQ ID NO: 1272 - DNA, 535 bp, Aquilegia formosa
cgattcgatttctttcgaaaatgtctacaacattcagtggtgatgaaactgctcctttcttcggctttcttggtgccgctgctgctctcgttttctcatgtatgggagcagcatatggaacagcaaaaagtggagtaggagtagcatcaatgggtgtaatgagacctgaacttgttatgaaatcaattgttcctgttgttatggctggtgttttgggtatttatggtttgattattgctgttattataagtactggaattaatccaaaagccaaatcttattacttgtttgatggatatgctcatttatcatctggtcttgcttgtggtcttgctggtctttctgctggtatggctattggaattgttggtgatgctggtgttagggccaatgcacagcaaccaaagttgtttgtgggaatgattttgatcctcatttttgctgaagcacttgctctgtatggtctcattgtgggaatcatcctctcgtcccgagcaggccaatctcgagcagactgaaagaagaccatgctggg

SEQ ID NO: 1273 - DNA, 1037 bp, Phaseolus coccineus
cagtgtacggtaacagagatcggaacgtggaacttctctgtgctgcggaaaccggaatatccaacttctcagatcggatctattcgacttcgttgcagtgattatggcttctttcagcggcgatgagacggcaccgtttttcggcttccttggagccgctgctgcgctcgtcttctcctgtatgggagctgcctatggcacagcaaagagtggtgtgggcgtggcttcgatgggtgtgatgagaccggagctggtgatgaagtctattgttcctgttgttatggctggagttttgggtatttatggtcttattattgctgttattatcagtactggcattaatcccaaggccaaatcttattacctctttgatggttatgcacatctctcctctggtcttgcctgtgggctggctgggctctctgctggcatggctattggcattgttggtgatgctggtgttagagccaacgcacagcagccaaagctttttgttggaatgattctcatcctcatctttgctgaagctcttgccctgtatggtctcattgttggtattatcctgtcctctcgtgctggtcagtctagagctgattaagaaagatgtgctgcaaaatattctttgatctcccttctgttttaaccttcttattttgagggcgagggggtaaattgttgattgtggaggttagtgatgttgggacggcactttcaggatttaacacaaacttatgtgaaagcagttgctgcaccagtcatttttgtgtctgtataagtgtagtatttatttgcttaataaagcttcttaagcttctttttccctgtgccatataatcttagtattaaattttttgtgctactgccattgtaatttatttgtattaatgagtctttaatattggatgctagtgtggctaaatgttgccttgtgttttgatcagttagttgtataaatccacatggatgttttcaataaaagaacattttgagcattctaatattattttgaatacttttattgtcggagcaggtacgaa

SEQ ID NO: 1274 - DNA, 883 bp, Vaccinium corymbosum
tttggacgaaacacggaaaaggagtacaattctcagatctgatcaattcttctccaagtcgaaaccctaggaaccaggaaaacgatgtctgcaaccttcagcggcgatgaaacggcaccgttcttcggcttcctcggcgctgcagctgccctagtcttctcctgtatgggggcagcgtatgggacagcaaagagcggcgtcggagtggcgtcaatgggtgtgatgaggccggagctggtgatgaagtcgattgttccagtggttatggctggtgttttgggtatttacggattgatcatagctgtgattattagtacgggaattaaccctaaggctaagtcttattacctctttgatgggtatgctcatctttcgtctggtcttgcttgtggccttgctggtttgtctgctggcatggctattggtatcgttggcgatgccggtgttagagccaatgctcagcagccaaaactttttgttgggatgatcctcattctcatctttgccgaagcacttgccctatacggccttattgtcggcattatcctctcatctcgagctggtcagtcaagagcagactaaagcaggattctgtctggtgggtgtggtttgttgcaatttatgaaggattattttttatgttctctatggttgagggtaattcacttgaggaagtatcttatgctccaaaattcttgtaattggtggcctagtacctggtctgcgggattgtttggttgctatgtgtcgatggcagactttagattagttcttacacctgttccaaaataatgttgtgtatttgtttcgtgttaaggatgatgatgatgtgtttcatgaacattagtttgcatgtgttaataattattccagtattgcttct

SEQ ID NO: 1275 - DNA, 843 bp, Vaccinium corymbosum
gttccttcgcaagaaaaatccaatatgtctgcggcgttcagcggggatgaaactgcgcctttcttcggcttcctcggcgccgctgctgccctcgtcttctcatgtatgggagctgcctatgggacggcaaagagtggtgtcggagtggcgtcaatgggggtgatgaggccagaactggtaatgaaatcaattgttccggttgttatggctggtgttttgggcatttatggattgatcattgctgttataatcagtactggtattaaccccaaggccaagtcgtattacctctttgatggttatgcccacctttcatctggtctcgcttgtggcctcgctgggctttcagctggaatggcgattgggatcgtgggtgatgccggtgttagagctaacgcgcagcagccgaaacttttcgtcggaatgatcctcattctcatctttgccgaagccctggcactctatggcctcattgttggtatcatattgtcctcgcgagctggtcaatccagagcagactgagtagtgttgtttgaaagaagttccaaatcttctcagatagaacagcattcacagggttcatcaaattcttcagcttaagagaaatttaaacctagcacatttagtttgtggctgctgagcatgctgtttgtagttaatcttgactttatctgtggaataaaagctcatgaaacttcctgtatggcttcatctttgcatgtaatctgccattacgcccggtacaactttcagacctatatagagacatcaatttggaactattgttgtttttggaaatttggaccgagtatcattcgttacttataagctataggttccgct

SEQ ID NO: 1276 - DNA, 883 bp, Olea europaea
ttggaattctttaaatccgatctccgcagatcccctccagggaaaatgtcatcaaatttcagcggcgaagaaacggcgccgttcttcggcttccttggtgccgcggctgctctagttttctcctgtatgggtgcggcgtacggcacggcaaagagtggcgttggtgtggcgtcgatgggcgtgatgcgaccggagctggtgatgaagtcgatagttccggtggtcatggctggagttttgggtatttatggattgattattgctgtgatcatcagtactggaatcaaccctaaggcaaagtcatactacttgtttgatggctatgctcacctttcttccggtctcgcttgtggcctcgctggcctttctgctggtatggccattggaattgttggggatgctggtgttagagccaatgcacaacaaccaaagctctttgtagggatgattcttattcttatttttgctgaagcgctggctctttatggccttatcgttggcatcatcctctcttctcgtgctggtcagtctagagcagactagaagaaacggttgatttgtgctgatggtaggtagtagttcaggactttggttttccctaaataaggttctctattaatttatatgttctgcatgcttgaattgtgtaaaactaatttgcttgtatcattttgtggaaacatcattctttttatcgattttctgcgaaacacttcagggattttttttctgtaacatcttcctacgattgggatggaaaaaaaaaaaaaaaaaaaagccttgttttcttgttcaagctgggaattagaaaaacgcattgattatctttttgttgcagcgaggtggtcaataataaaaaaaaaaaattcatgttttgccctcc

SEQ ID NO: 1277 - DNA, 821 bp, Zostera marina
aacaaacaaaatcatattcacctttcctcctcgcattcttcaatcctccgatcttaacaatcaccacagatctacagttttctccgatcgaagagaaatatgtcgtctactttcagcggcgatgagactgctccgttcttcggcttccttggagccgcctctgccctcgttttctcctgtatgggagcagcctatggaacggcgaagagtggagtcggtgtggcgtcgatgggagtgatgcgaccggagcttgtgatgaaatccatcgtccccgttgtcatggcgggagtgcttgggatttacggtcttatcatcgctgtgatcatcagtaccggaatcaatcccaaggccaaatcctactatttgtttgacggctatgcacatctttcttcaggtctggcttgcggtctcgctggtttatccgccggaatggcgatcgggatcgttggcgatgccggtgttagagcaaatgcacagcagccaaagctctttgttggaatgatcctcattcttatttttgctgaggctctagctctctatggccttattgtcggcatcatcctctcatcccgcgctggtcaatctcgagctgattaaacaatcaaacctgaattgatctgcgacagagatttccagatttcaggttcgttcttgtttttaattaatccacgattttgttgatcgagtgagaaaaatgactgcgcgtcttcccattctgctgctgcttcatctatctattgttttcaatctgcgcgaattttttgtagattgttctgtgtacgtacttatttgcaacaacaatgataataattaataatgat

SEQ ID NO: 1278 - DNA, 896 bp, Amsonia hubrichtii
acgcagaggaaaggccaggttcaactcgaactaaatctactattctctccgccgaggcgtgaaatctcccagatccattctgttcaaccttctctctccgcagatccaatctcaaaatgtcgtcgaccttcagcggcgatgagacggcaccgttcttcggcttcctaggcgccgctgctgccttagtcttctcctgtatgggagcagcatacgggacagctaagagtggcgttggagtggcatctatgggtgtgatgaggcctgagctggtgatgaagtcgattgtcccagttgttatggctggtgttttgggtatttatggactaattattgctgtgattatcagtactggaatcaaccctaagaccaaggcttactatctctttgatggttatgctcacctctcctccggtcttgcttgtggtctcgctggtctttctgctggtatggcaattggaatcgtcggagatgctggtgttagggccaatgcacaacaacccaagctttttgttggtatgattcttattcttatttttgctgaagctctggcactttatggccttattgttggcatcatcctctcttctcgagctggacaatcaagagcagattaggaaggagcatattttagtgctattttgtcaatgatcaagaactataattgtgttcctcctggttagagatggttccaagctttgatacgtgcgacgccatcaattcaaagaattgttctgattttagcgtgtagatttagaatttcattttttccctgaataaattctgtgttatttgatttggtccagcatgttgagaatgccatattaaaccatgtacaacttttgtctaaactggatgctttatttattttttctcctttcgaaaatgcaactctagta

SEQ ID NO: 1279 - DNA, 1103 bp, Amsonia hubrichtii
ccacacaacagagagagacgcagcgtcgagagagatctaattatacttcgttatcccaactccatatctctctccgtagggtaataattcagatacaaatctcagatccaattcggaacaatgtcttcaaccttcagtggcgatgaaactgctcctttcttcggctttctcggggctgctgctgccctcgtcttctcctgtatgggagcagcgtatggaacggcgaagagtggagttggagtggcgtctatgggagtgatgaggccagagcttgtgatgaagtcgattgttccagtggttatggctggtgtgttgggtatttacggtcttattatagctgttataatcagtaccggaattaaccccaagacgaagtcgtattacctctttgatggctacgcacatctctcctccggtcttgcttgtggtctcgcagggctttctgctggtatggccattgggatcgttggtgacgctggtgttagggccaatgcacagcagccaaagctttttgttggaatgatccttattcttatttttgctgaagctttggccctttatggccttatcgtgggaattattttatcttcacgagctggccagtcgagagcagactaagaaagaaaaaactactgatgttattctattatgttgccccaatggtaaggtatcacctgggtaaactgaaatttggtcttatttgtttagcatggctctctaggttctcccttgatgttcacttggaaagcaaatgctcaaccacatttaatttggtggcgcttagtgctgtttctagaagtagtgatgaggttttttcagctaataaagctttttggagctttttttctcgagtttaaactgtccttattttgaaatatcctgcaactatgtagtaattatgacttggattggtgcatttgtgatataatatggtcctcctttgttgacaagaagtgatgtattattctataaatgcctagcacacaccccactcggtttaatcctaatctttacctgttaggatccctaggatgcatataatgttgtactggattctttactcgctcgttagtgcttgggaggagttctgctgtaattttttt

SEQ ID NO: 1280 - DNA, 816 bp, Antirrhinum majus
  misc_feature (679)..(679): n is a, c, g, or t
  misc_feature (746)..(746): n is a, c, g, or t
gtcgccgaagactgagaagattacaaattacaatacaatacgcctaagatagatcagatcagatcagatccgatctctttctctgcatctagattttaagatgtcgtcaaccttcagtggcgatgaaacggcaccgttcttcgggttcctgggcgcggcggccgccctcgtcttctcctgtatgggagcggcgtacggaacggccaagagtggagtgggagtggcgtcgatgggtgtgatgaggccggagcttgtcatgaagtcgatcgtgcccgtggtcatggctggtgtcttgggtatctatggactcatcattgccgtcatcatcagtactggtattaaccccaaggccaagtcttactacctctttgatggatatgctcacctctcctctggactctcttgtggtctcgctggtctcgctgccggtatggccatcggaatcgtcggagatgctggtgttagagccaatgcacaacaaccgaagctcttcgtcgggatgattcttatccttatttttgctgaagccttggctctatacggtctcatcgttggcatcatcctctcttctcgtgctggtcagtccagagctgagtagaggactgcgtcttgcttaacgattactacggtttcttgttatcaagtaaggatcgtatttatgttcttcccaattatcgtngtagtttgggtgtgaattatttttagtcaagcatctgcgagtggcgacttggtcagaggaattgagnggttaatgtgttgtggtggtagattgtagacgagaaagtttgatttttccccaaataattctctgaattg

SEQ ID NO: 1281 - DNA, 654 bp, Antirrhinum majus
  misc_feature (1)..(1): n is a, c, g, or t
nagagatctaaaatcaaaatcccacaaaaaactttcaactctccataaaaatttattccgatccaaaaaataaaaaaagaaaaattaaaaattatgtcttcaaccttcagcggcgatgaaactgctcccttcttcggcttcctcggcgcagctgctgctctcgtcttcagctgtatgggcgcagcttatggaacggcgaagagtggtgttggtgtggcgtcgatgggggtgatgaggccggagctggtgatgaagtcgattgtgccggtggtcatggctggtgttttgggtatttacggtttgatcattgctgtgattatcagtactggtattaacccgaaagccaaatcttattaccttttcgatggctatgctcatctctcttcggggcttgcgtgtggcctcgcgggtcttgctgctggaatggctattggaattgtgggagatgctggtgttagggctaatgcacaacagccaaagcttcttgttggcatgatcctcattctcatttttgccgaagctttggcactctatggtcttatcgttggaatcattttgtcttcacgagctggccagtccagagccgagtaagagccagagacagaattcataaatcataagcctatgatatatccaggaaaaagagggggagaa

SEQ ID NO: 1282 - DNA, 680 bp, Malus domestica
gatcgaaagtcgaaacacacacgcttaaaggcattcaaggagaagagaaggaaaccaaatccatcagaagccagatccgatcaaagaatatctgtccgttgatcgagcagaatgtcttctacaaccttcagcggcgatgaaacggcaccgttcttcgggttcctcggcgccgccgcggccctcgtcttctcctgcatgggagctgcgtacgggacggcgaagagcggagtaggagtggcgtcgatgggtgtgatgaggccggagctggtgatgaagtcgatcgtgccggtggttatggcgggagtgttgggtatttacggacttatcatcgccgttatcatcagtaccggtatcaatcccaaggccaaaccctattaccttttcgatggctatgctcatctttcctctggtctagcttgtggccttgctggtctctctgccggtatggctatcggcattgtcggtgatgccggtgttagagccaatgcacaacagccaaagcttttcgttgggatgatcctcattctcatttttgctgaagcgcttgctctgtacggtctgattgttggtatcattctctcttcccgatcggggcagtcaagagctgactagaaggtgtgcttggcggcgtttgcggttgctgctattcatcgagaactactttactgttggttaaactt

SEQ ID NO: 1283 - DNA, 816 bp, Aristolochia fimbriata
tgctcccgtcgccgatccaaaagccaatacgccaggcattgccgaagaagaaagagcaataaggagcagaaatttggagttctgaaatttctctcttcctccggaagaagcaaaaagaaaagaacatgtctgacactttcgccggcgatgtaactgctcctttcttcggattcctcggtgccgcagcggcactcgttttctcctgtatgggggcagcttatggcactgcgaagagtggcgtcggagttgcatctatgggtgtgatgcggccggagctggttatgaaatcgatcgtcccggttgttatggctggagttctcggaatttacggcttgatcattgctgtcattattagtactggaattaaccctaaggcaaagccttactatttgttcgacggttacgcgcatttgtcttccgggcttgcctgtggtctcgctgggcttgccgctggaatggcaatcgggattgttggagatgctggagtcagggctaatgcgcaacaacccaaactttttgttggcatgattctgattcttatctttgctgaagctcttgcactttatggccttatcgtggggatcattttgtcctctcgagctggccagtctcgagcagattgagtctagtgttggtttactcgaaaccattgtgttcaaatagaaatagaaccatactggaactaaggttcatgtttaatttttcaattctatttatcatttgatcgagtctttcatgttgtattgaggaagtgtggatggccgtgtttgtattccgacaaatggattctgggaggtctgtagatgtgatgccctt

SEQ ID NO: 1284 - DNA, 891 bp, Arnica chamissonis
tttctcatagatccaatcgataaaatcctcttgtaaagttgtcctctcgtgatccaaaagggcaggtgttcaacaactaacacacagaagaagagatctaaaactccttttcttttcaccttctccgatcaaaatccgatcgatttcaatcgagaaccggtcaataatgtcttcagtttcaggattcagcggtgatgaaacagccccgttctttggtttcctcggagcagccgctgcccttgtcttctcctgtatgggagcagcatacgggactgctaagagcggtgtaggtgtggcgtcgatgggtgtgatgagacctgagctggtgatgaagtcgattgttccagttgttatggctggtgtgcttggtatatatggtttgattattgctgtcatcattagtaccgggattaaccctaaggcaaaatcatattatctgtttgatggctatgcacatctttcctctggtttggcttgtggtcttgctggtctgtctgctggaatggcgatcggaattgttggtgatgctggtgttagagcgaacgcacaacaaccaaagctttttgtgggtatgattcttattctcatctttgctgaagctctggccctatacgggcttattgttggtatcatcttatcgtcccgtgctggacaatcgagagcagattaaggtgacccgacaacgaacttggacttgcttctatatatgtttgttgtttgttctgataaatcaagatcatgtttttttcttttgctttatttctatttcgcatatcttgaacttcaattattgcattaccataaattttcttgatggaatactttgtggtgatattattattagtgtttatgatgttactacagaataaggccatagtcttggtctaagtc

SEQ ID NO: 1285 - DNA, 1043 bp, Phaseolus coccineus
cctcctcagtgtacggtaacagagatcggaacgtggaacttctctgtgctgcggaaaccggaatatccaacttctcagatcggatctattcgacttcgttgcagtgattatggcttctttcagcggcgatgagacggcaccgtttttcggcttccttggagccgctgctgcgctcgtcttctcctgtatgggagctgcctatggcacagcaaagagtggtgtgggcgtggcttcgatgggtgtgatgagaccggagctggtgatgaagtctattgttcctgttgttatggctggagttttgggtatttatggtcttattattgctgttattatcagtactggcattaatcccaaggccaaatcttattacctctttgatggttatgcacatctctcctctggtcttgcctgtgggctggctgggctctctgctggcatggctattggcattgttggtgatgctggtgttagagccaacgcacagcagccaaagctttttgttggaatgattctcatcctcatctttgctgaagctcttgccctgtatggtctcattgttggtattatcctgtcctctcgtgctggtcagtctagagctgattaagaaagatgtgctgcaaaatattctttgatctcccttctgttttaaccttcttattttgagggcgagggggtaaattgttgattgtggaggttagtgatgttgggacggcactttcaggatttaacacaaacttatgtgaaagcagttgctgcaccagtcatttttgtgtctgtataagtgtagtatttatttgcttaataaagcttcttaagcttctttttccctgtgccatataatcttagtattaaattttttgtgctactgccattgtaatttatttgtattaatgagtctttaatattggatgctagtgtggctaaatgttgccttgtgttttgatcagttagttgtataaatccacatggatgttttcaataaaagaacattttgagcattctaatattattttgaatacttttattgtcggagcaggtacgaa

SEQ ID NO: 1286 - DNA, 878 bp, Fagus grandifolia
gagagagagatccgaaactctcagatccgaacgacgtcgttgcagatccaccgatcgagaaaatgtcttcttcagtattcagcggcgatgaaacggcaccgttcttcggattcctcggcgccgctgcagcactcgttttctcctgtatgggagctgcctatgggacagcaaagagtggcgttggtgtggcatcgatgggtgtgatgaggcctgagttggtgatgaagtccattgttcctgttgttatggctggagtgttgggtatttatggccttattattgctgttatcattagtactgggattaacccaaaggccaagtcatattacctttttgatggttatgcacatctctcgtctggtcttgcttgtggtcttgcggggctctctgctggtatggcgattggtattgttggtgatgctggtgttagagctaacgcacaacagccaaaactttttgtgggaatgatccttattctcatcttcgctgaagcacttgcactctatgggcttattgttggcattatcttgtcttctcgagctggccagtccagagctgactaagaatattgctctgttgccaaatattctttcactacttgtgtaattttggtggaattttttaattgttcacaagttagtaatggctggatagtacttgaggatttctcgaaaactattgatgttgaaagtaactgctctttcagccattatgtggtctagtgtttgtagtagtagtaggattgagtttcgctgcctaataaaagcttgtaaagctgtacttgcatttggtttttttctattgatgtatttttccatcagaacttcaaactggtataggatttatcatcattaaattggtgaatgtattattattat

SEQ ID NO: 1287 - DNA, 959 bp, Fagus grandifolia
ctggaccttggctgtcactcagttaaaaaaaaaacagagagagaaagagagagatccgaaactctcagatccgaacgacgtcgttgcagatccaccgatcgagaaaatgtcttcttcagtattcagcggcgatgaaacggcaccgttcttcggcttcctcggcgccgcagcagcactcgttttctcatgtatgggagctgcctatgggacagcaaagagtggcgttggtgtggcatcgatgggtgtgatgaggcctgagttggtgatgaagtccattgttcctgttgttatggctggagtgttgggtatttatggccttattattgctgttatcattagtactgggattaacccaaaggccaagtcatattacctttttgatggttatgcacatctctcgtctggtcttgcttgtggtcttgcggggctctctgctggtatggcgattggtattgttggtgatgccggtgttagagctaacgcacaacagccaaaactttttgtgggaatgatccttattctcatcttcgctgaagcacttgcactctatgggcttattgttggcattatcttgtcttctcgagctggccagtccagagctgactaagaatattgctctgttgccaaatattcttttactacttgtgtaattttggtggaaatttttaattgttcacaggttagtaatggctggatagtactgaggatttctcgaaaactattgacgttgaaagtaactgctcttccagccattaggtggtcttgtgtttgtagtagtaggattgagtttcgctgcctaataaaagcttgtaaagctgtacttgtcgtttggttttttctattgatgtatttttccatcagaacttcaaactggtataggatttatcatcattaaattggtgaatgtattattattattttactaaatttagcttaccatctgtcgtttttcaatttcg

SEQ ID NO: 1288 - DNA, 1006 bp, Beta vulgaris
aataaaagaaaagataagtataaacaaaagaaatttgtcttctctacatccgcatatttcatccacgctctcttcttcctctcctctcatctcctttttcaattcccagatcggatcaagcaattcatcgaacaccttccgatcatcaccatcaaaaaaaatgtcaacagtctttaacggcgatgaaacggcgccgttcttcggctttctgggtgctgctgcagccctagttttctcatgtatgggagcagcatatgggacagcaaaaagtggggtgggagtagcatcaatgggagtaatgaggccagaacttgtaatgaagtcaatagtaccagttgttatggctggagttttgggtatttatggtttgattattgctgtgattattagtactggaattaacccaaaagctaaatcttattacttatttgatggttatgcccatctttcatctggacttgcttgtggtcttgctggtttatctgctggtatggctattggtattgttggtgatgctggtgttagagccaatgcacagcagccaaagcttttcgtcgggatgatccttattctcatctttgctgaagcacttgctctctacggtctcattgtcggcatcatcttgtcctctagagctggacagtcaagagctgattaagtacagtactggacttcttgttcagtcatgctgtgtattgttgaatgcggagtgaagcaacgttgccctttcgccttgcttttctcttccatttttcccctgcagtgaagggcagagatattcaggtttaaatatattgctgttaggttaagtgtggtgagactctggtttaatgtttttcttgaaatacattatggtggaagataataatttctactgtattcaatttatactctgctgctatttttagcactaggctcttgcataataaaattgcttgtgaagttcttttctactgtatgtgctgttgccgtatgttattggataatcttgttaggttatggtctc

SEQ ID NO: 1289 - DNA, 1191 bp, Beta vulgaris
agaaaaaatcccgataaattattgatctctattcactcacctctcttttctctctcctcacaagcagagaaaaacaaaaaaaactctcaaataatcacgttgaaatcgccattgttgtacctcttctttcagatctaatcacacttttttctctgcaaaaacaatcattcaatcatgtctactgtcttcaatggcgatgaaactgctcccttcttcggcttccttggtgccgctgccgctctcgtcttctcctgtatgggagcagcatacggaacagcgaagagtggagtaggagtggcgtctatgggagtgatgagaccagaattggtgatgaaatcaattgttccagttgttatggctggagttttgggtatttatggattgattattgctgtgattattagtactggtattaaccctaaggctaaatcgtactatctttttgatggatatgctcatctctcttctggtctcgcttgtggtcttgctggtctctctgctggcatggccatcggtattgtcggcgatgccggtgtcagagcaaacgcccagcagcccaagcttttcgttggaatgatcctcattctcattttcgctgaagctttggctttgtacggtcttattgttggtatcatcctctcttcccgtgctggtcaatcaagagccgattagaagaggttcacctcttgatctacatttgtttttccattgccaccgctggagatgtaattttttcttactcgggcagtgagaggggtcacttggcattcaaagtggcttctctcgaaggattgattatggtcttattgtttttgagttgtgattggtgggttcttctgcatggagaatgttaaaaccagattgtagagtttgatagtttagtgtttcctccaaataaaagtgatgctgtatcattattattgttttccatctttgctctcctggatatggagattcagtttggacatcctgtaacagtatgttagatgccaaatattcttttgagccttttcattcttggtttcaacaatatacataatttaagattctattatgttatgggttagcctcacttgaggatcaataaattaaatgtgttgatgaatcttttagactacatatatcatatatgttcttgcagttgcttttggtttgactgtggtagagcttcatttggatcccttggtttgc

SEQ ID NO: 1290 - DNA, 925 bp, Bupleurum chinense
gatctgagaagttgaaaaaatctcaatttttttgatcaaatcttgtcggagttaaattaatctcaccggaaaaaatgtcgacggcgttcagtggagatgaaacagcgccgttcttcggctttcttggcgccgctgctgctctcgttttttcatgtatgggagctgcttatggcacagcaaaaagtggtgtaggagtggcctcaatgggagtgatgaggccagagctagttatgaagtcaattgtgccagttgttatggctggtgtgttgggtatctacggtttgattattgcggttattatcagtaccggaattaatccaaaggcaaaatcctactacttgtttgatggctatgctcatctttcatccggtcttgcttgtggtcttgctgggctttctgctggaatggcaattggaattgttggtgatgctggtgttagagctaatgctcaacagccaaagcttttcgttggaatgattttaattctcatctttgccgaagctcttgcgctgtatggtctcattgttggtatcatcttgtcttcacgagctggtcaatccagagccgattaagaatagagctgctcgtacaaatatttttctattgttttatgttgctgctttggaaagtcttgataaaagagggaaagaagttaattcttgttacaagaacatcatatgtaaggttacataatcttatcttggaaaatcatctcttctcgactctgatattatcattgtcagagggtgtttgtagtagttgtagtcagtttttgcacaataagggtctgttgcttatctatttgacttgatctgcatgtatttttacatcattgtttaaattgtgttgaaacacctgtctgcatatgataacattaatgattttatagttttcagtggtgagtataataagattgcaatccttt

SEQ ID NO: 1291 - DNA, 1125 bp, Theobroma cacao
ttggtgcccgaatgggccgaatctcattcacttaaaaatcagcgagggcattatggtaaatcgagccactccaatcaatcatcatcctcaccagtcaccaccgtccttccccgatcccatcctcccatttactttagacattaaagagagaaaaatctgcaatccaatcaaagaattatcctatcttcgcaaccaaacaagtagaagaaagaaagatgtcctccactttcagcggcgatgaaaccgctcctttcttcggcttcctcggagccgccgctgctctcgtcttctcttgcatgggagcggcatacgggacggcaaagagtggggtgggagtggcctcaatgggagtgatgaggccagagcttgtgatgaaatctatagttccagtggttatggctggagttttgggtatttatggattgattatagctgttattattagtacggggatcaacccgaaagcgaaatcttattatttgtttgatgggtatgcacacttgtcatctggtcttgcttgtggccttgctggcctttctgctggaatggccattgggattgttggggatgctggagtcagggctaatgcacaacagcctaagctttttgtcggtatgattcttatcctcatttttgcggaagcacttgctctctacggactcattgtggggatcatcctttcatcccgagctggtcaatctcgtgcagaataaacaatgccaaactttaaagctgttatttttttaatgttattttatatggtttaaagttggaaatgtataatcagaaattgactgagaatacgccgaggttttcccccattttagttctgttccgtgtgatgaactctctgtctgtgttgggtctctgatcaagattatggaactgtactcttttccaaagagcatcatgctctgtggcgctggactggattacctgaatgtattatgaggctgattgcactttctcagatagatataattgttgaatttttaaaaattctggattgatgttcttgctttgtttacttgctccttgatcctgattccttggaacaactgctccatgaacaggtcttcttgccagttgatggtaccggttccaaaatcaaaatgctcacctttg

SEQ ID NO: 1292 - DNA, 1170 bp, Theobroma cacao
aagcattagcattgatatattgcatatcattatgtacactagtttgaggaacataccgcacaatactagctgctgtcacattttatagactctatatgctgaacatctccttttcatttcttggatatcatttcattgctaacacctctttctggaatgccaggttggcaaaatgttgtggttctgatcaatgagagttaaattgggttggggtacggcccaaattgatttttggaaactactacctttccaagcctgcttgatggcccaatgaaagaagcccaagttttacttattagtggcggtccttgtttcgctactttttccaggggaaaggggaagaagactcgagtaattcgtagttctctccaaatataatttaaaaaagaaattattacatttacaggagcagcagatccgatccattactatcttcggaaagatgtcttcgacattcagtggcgatgaaactgctcctttcttcggcttcctgggggccgcagctgcccttgttttctcctgtatgggagccgcttatgggaccgcgaagagtggggttggtgtagcgtcgatgggggtgatgaggccggagctggtgatgaagtcgatcgttcccgtagttatggctggtgtgctcggtatttatggcttgattattgctgttattattagtaccggaattaatcccaaggctaagtcttattaccttttcgatggatacgcgcatctgtcctctggtctcgcttgtggcctcgctggtctttccgctggtatggctattgggatcgttggtgatgctggcgttagagctaatgcacagcagccaaagcttttcgttggtatgatcctcattctcatctttgctgaggcattggcactatatggtttgattgtcggcattattctctcttccagagctggtcaatcaagagccgagtgaaagaaggcctagctagtgactgcatggttggttgtggttcctgcggaattgtttcatatatttttcttttctgtcgctgttaagaagcatattggttttgctcaggtgtcgagtgtttctacagattgagaaatttgcagtggctgatgatagattagagatttaaattagttgtctcaataaaggttgtcaactttgtttcattattaaattatgtacttttggatcca

SEQ ID NO: 1293 - DNA, 1155 bp, Theobroma cacao
aaaaagaattcctaccattttcccaacccaaaggaaagagaagtggtgtttaacattatcatcgagctttcttggtccaagatactaagcaaatgagccccggaacaacagtaggattgtcatcttcagcccaaaactggcacaagatacgtcccagcgtatgagcccatgaagtaaatacctgtcttctgcagctcaaaacaggcccaaaacgcgttttactttttttttttttcttttatggtaatggcaatggcacgatcacgttggtccacttagaaatttcgtagttccttctccatctctctcttcctctgctcactgaagaaatccaccgatcaaagtttcccaaatcccttcaattcgttggtgaatatttttggcgaacgaaaatgtcgtccacgttcagcggcgatgaaactgcacccttcttcggcttcctcggcgctgctgctgccctcgttttctcctgtatgggagctgcgtacgggacggcgaagagcggtgttggagtggcgtcgatgggagtgatgaggccagagctggtaatgaaatcgatcgtccccgttgttatggctggagttttaggtatttatgggttgattattgcggttattataagcactgggattaacccgaaggccaaatcttactaccttttcgatggctatgctcatctttcctctggtctcgcttgtggcctcgctggtctctctgcgggcatggccatcggaatcgtcggcgatgctggcgtcagggccaacgcccaacagccaaagcttttcgtaggaatgattctaattctcatttttgccgaggctttggctctgtatggactcattgtcggtatcatcctctcttcccgagctggtcagtcccgagcagaatagagtgcgaggttctgagactaagggttgttgctagttggcatcacttggttgtctccgattcatgccacgagcatatgcagtgtgaaacaatttgtcaagttgttatcttgaactcattcatgaatttatcgataagcagttctatgctgtttgtataagtagaagatagatttaatttgaaataaatcttgttttaacattttttcgtatctattgctgtactctacatgtaagttcaatgaaatgcaaagaccatgtttatgat

SEQ ID NO: 1294 - DNA, 1873 bp, Theobroma cacao
aaatacttttgattatcttttatattaacaaaggaactatttttttagttttcaaagataagttgttttctaattttttatttttaactatttttagtaaagagaactattttttaataaaattatccttaatgaaaactctttatatttcgtgtgaaaaaatattgtttcaattacaagaatttatgttgtagtgaattacaaacaagttaaacatcatgtttaataacaaaaaaaataaataaacactgcaattataagcagatgttatacattaaaactttagtagcagacgttatacaccaaggataaagtgttagtactagatgttatacgataagaccaaagtttcaacatcaaatgttacatgttaaagtcaaagctttagcatcaaatattacatgccaaaactttctttttctttctaatggcacacaccaagtcataaattactttattacacgtaaagacatattctaccatatttgaatcattgaaaaactaaacatcaataagcccaataacatattgttattcaccatgttatactttttgatttataaatcgatgatgatatgacaagatgtaagtttaattttaacatattggattaaaataaataaaatattcactaagtagattcaaattaatacaaatataattaaatatctcctcacatagatttagatctagaatatttagaggattgctttacaaaatcaaggtgcatgtcagaaactgttcgttttcctatggatttgtcgaacttgccgaagcttggcaaataaaattaaagaaaaagacaataaaaagggcttggatcagaaatgggcccactgagctaagttggtccagtaagaaagcccattacccgacaaaaaccggagtggcgaagcccgtttgtgtataaaaatttggtggctcatattttttccaacacggtaacagaaaaaaccagagggagatcaaaaactctctccagcacaacacaaagcactttctgactccttttcctcagatctaaacgacattgtctcagatccactgactccacgatgtcttctactttcagcggcgatgaaacggcaccgttcttcggcttcctcggtgccgctgctgctctcgtcttctcctgtatgggagctgcgtatgggacagctaagagtggtgttggtgtggcatcgatgggtgtgatgaggcctgagttggttatgaaatctattgtaccagttgttatggctggtgttttgggtatttatggattgattattgctgttattattagtactgggatcaatcctaaggccaaatcatattaccttttcgatggttacgctcacctttcctctggtcttgcttgtggccttgctgggctttctgctggaatggcaattggaattgtcggtgatgctggtgtcagagcgaatgcacaacagccaaaactttttgttggaatgatccttatcctcatttttgctgaagctttggctctttatggacttatcgtaggcatcatcttgtcttcacgagctggccaatccagagcagaataggatgctcatcgagctgcttagtattctttgattgcttatctgtagcattgtacgggaaagagtattgattatgctcagggtaaattgtgattggacagcatgtgcaggtttcccatattgatgaaagcaactactcgggcagttatttggtgttggttgctctttcctcattgtagaagtagaattgagtttctcttaataaaatgttggtgaagcttttccctgtttgatctctatttgtcagtgtatcttgcagaaattcaaactattaatggaagtttaattttggagatattaatgcaatgttgaattcagttgca

SEQ ID NO: 1295 - DNA, 1445 bp, Cannabis sativa
gcccaataaggctataagtatcttcattaaaatgaattataaagcagttgggttcaattcgtaagtaaggacaaccacagagtttagagagagagagagatcgaaactcgaagctccacaaactctctctgaagatccagacgaagtcctctcagatccgattaacacaatgtcttcaaccttcagcggcgatgaaacggcaccgttcttcggattcctcggcgctgccgcggctctagttttctcctgtatgggagctgcctatggcacagcaaagagtggtgttggtgtggcatctatgggagtgatgagacccgagttggtcatgaagtccattgttccagttgttatggctggagttttgggtatttatggtcttattattgctgttatcatcagtacagggattaacccaaaggcaaaatcatactacctttttgatggttatgctcatctttcctctggtcttgcttgtggtcttgctggtctttcagctggaatggccattggtattgttggtgatgctggtgttagagccaatgcacagcagccaaaacttttcgttggtatgattcttatcctcatctttgctgaggctcttgccctgtacggtcttatcgtcggcattatcttgtcttctcgtgctggccagtccagagcagaatgagaagcggccattgcagccaaatattcttttatcgcttattatgttacttcaaggttgggcagaagcatttaattttttttcttgccattatcggttagtgaagatgataatagctggataaacgttgcaggatcccttaaaattatatatttgtggtagtaactgcccttccagtcacatggtgttgttttgctattagaagtaaagatctgagtttcttgaccgaataaaaagcttttgaagctgaaacccctttcgattctatattttgtcttttgtgtatttttgttcttagacacctttgaacgggtatagtatttataattatggaggtaagtagtgcatgtaccatgttatattcattgaatacttttatcaaatctcaaactctgcattatgtgcttatctcaactttctttttagtttagtcattgaggatgccattgtttttctttcctggtttttgacaacgtgccaacaagtatgtgttggcattgtgatcaagcccagtttgtaggttgcatgattagcttaaatgatttgatcttattcatatatatcaaattgactttaggtacaactagggacaagcatgtcaattgacctatttaaagtacaccacatcatcgttatttcttttcttttttgagttgaaattgaatttaattcaagaagctaatagcctaaccttgaattatcaggtttaaaaacctttacaaagaaattcgatatcagccaaaactaactttgtttcgacccaatcttgggcaagctttca

SEQ ID NO: 1296 - DNA, 1219 bp, Cannabis sativa
aattaaagcacaacacaaaaatttggagtatcggctgagactgagatcaagtctgacaagaaaaagcatatcttctcaacgaaaatgtcctccaccttcagcggtgatgaaacagctcccttctttggcttcctcggcgccgccgctgccctcgttttctcctgtatgggagctgcctatggaaccgccaagagtggtgttggagttgcatcgatgggggttatgaggccggagctggtcatgaagtcgatcgtcccagtggttatggcgggagttttgggtatttacggtctcatcatagcagttattatcagtactggtattaatcccaaggctaaatcctattatctctttgatggctatgcccatctctcttctggtctcgcttgtggccttgctggcctctctgctggtatggctattggaattgtcggtgatgctggtgttagggctaatgcacaacagccaaaactttttgttggtatgattctaattctcatttttgctgaagcccttgctctatatggtctcattgttggtatcatcctctcatctcgagcgggtcagtcaagagctgaataagaaatatttccttctggttgctatattcatcattgctgtatatctagagctacttgttatcctttaaaaaagaaagctcagtgaagtgttctataagatcttgtttgcggtgtaattagaaattctatgaaattgtttgttaaagtttttagtttgggtgctgaattgctgatggtaggatatatatagaattggaaattagtttcactatctaatagcaacattttgtgcagactcattgcctgtattatagattgcgagttagctagctctctggatttgcattactattgccattttcattatccacacttctctacgttgtatttggattttaaatgttaatctttctcctgatttgtttctcagaaaagatttgtaaatgttctgatagacagtgttgacgaaattatcagtaccacttaatttgttgcataaatctataggttagtacaattagtaatgaaagtgtggaaaaaaaatcatagtaaagttcatcagaagagaatgacgcgacacttaggcatggcaaacatcaattcgaatacgaggatttgtgacaattatattgccacagtttattaggttacctgattttacagaggatgtagattcaacatgatgctcaaattttaga

SEQ ID NO: 1297 - DNA, 882 bp, Manihot esculenta
gatgaacgaataatcaatcacgttaatcatgtcacgcttcgctgatccgatctttgctactgtgtgaaaaccagatatagaaactggacaacgaagatcgagcataggattagagctgttgttctctcgtctccgttaccaaatacccaatccaataatgtcttcgggtttcagcggcgatgagactgctccttttttcggcttcctcggagccgccgcagctctcgtcttttcttgcatgggtgcggcttatgggactgcaaagagtggggtgggtgtggcttccatgggagtgatgcgacccgagctcgtaatgaagtcgatagttccagtagttatggctggagttttggggatttacggtttaattatagctgttattattagtactggtattaatcccaaggctaaatcttattatctttttgatgggtatgctcacttgtcctctggtcttgcttgtgggcttgctggtttatctgccggtatggcaattgggatcgtcggtgatgctggagtccgggctaatgcacagcaaccgaagctgttcgtaggaatgattctcatccttatctttgctgaagcacttgctctctacggtcttattgttggaatcattctctcatctcgagctggccaatctcgtgcagagtagaaatgattggtgtgtgattcttaatatcacctattcagttaagcatttgaatttgtagcatgggatgactagaagctgttgggattctgctttagattgttctactccatttgcttaaatagctcagctcttgtatatgtaggatcgatccagagtattatggaaatattctatttaagacgatgactcttaatggaacatatgatggttcatgttgtgtctgttta

SEQ ID NO: 1298 - DNA, 673 bp, Manihot esculenta
ggtggctttgggatttataaaaataacagaacctttctcctccgagaagttcctttcactaccgaaatataaaaacaaaatatcagaatgagatcgatgctctagacctctgcgatctcagatcttaacgacaccgtttttacatctgttaatccaccatgtcttctgggttcagcggcgatgaaactgctcctttctttggcttcctcggcgccgctgccgcgcttgtcttctcttgtatgggagcggcatatggaacagctaagagtggtgttggtgtggcatcaatgggagtgatgaggcctgaacttgtgatgaaatcaattgtaccagttgttatggctggtgtgttaggtatatatgggttaattattgcagttattatcagtactggaatcaaccccaaggccaagtcatattacctttttgatgggtatgcccatctctcatctggtcttgcttgtggccttgctgggctgtctgctggaatggccattggcattgtcggtgatgctggtgtcagagctaatgctcaacaaccaaaactttttgttggaatgattttgatcctcatttttgctgaagcattagcattgtacggactcattgttggcattatcttgtcttcccgagctggccagtctagggcagaataagcaatgagattattctt

SEQ ID NO: 1299 - DNA, 2596 bp, Ricinus communis
gcccataagaatttcactctcgaagtctaaccccccaggagtgaggctgaattaaaaatttaaattatgacatttatttataaacgaccgatggatcgtcaatacgacatgtttaggactgtcataaaacgattcgtcgttctcacttcagttcagcaaaaaacagcgtcaaatcatcgaagcaattaacaaataaacaaacgggtatcatcgtaaaatgaccaaataattaaaacacgtcacgtgaattatatgatctctctctacctccctttcttcttctccgatccgatcttctcctctgttttttgtttgttttaatttttttttttttacataataacaaagatcaagaacagagacagagttctgtttaaaacaagaattaaactgtccctgatatctgcataaccaaacacacacgaaaaaatggaaagaaatatgtcatcaggtttcagcggcgacgaaactgctccttttttcggcttccttggagccgcagctgctctcgtattctcttgtatgggagcagcatatggaacagcaaagagtggagtaggagtggcatcaatgggagtgatgagaccagagctagtaatgaagtcaatagtaccagtcgttatggctggtgttttaggaatttatggtttaattatagctgttattattagtactggtattaatcctaaggctaaatcttattatctttttgatggttatgctcatttgtcttctggtcttgcttgtggtcttgctggtttatctgctggtatggccattgggattgttggtgatgctggtgttagggccaacgcccagcaaccaaagctgtttgttgggatgattcttatcctcatctttgctgaagcacttgctctgtatggtcttattgtgggaatcattctctcatcccgagcaggccagtcacgtgcagaataagaaaaggattaatagtttcgcacataatggccttcattaatctagttaaaaaaaattgaattgtatgttatgactggaagttgcccatattctgcttaaattgtttgattttatttgctttaatagctaggctcttgtaaattaggaaactgggtattctgcagtctatactacttatgatgattattttggaatgattctacatgctgatcaattgttttagaatgattctgtatattgatctatatattattttgtttctatttgtgttgctcttcattgttctgagccagcttccccgcgtcaattttcttatgagatgttttagcagtccagtagtctttgatagaggaggtttataagttttaaccaaatgataacctaagaaatgtttatgtgtaatatattccaggaagaaactcttcatcaacactttggttctgctgcttttggtgataaattcaaaaaaaaacaaaacaaggaaaagccattggctgcctgattctaattctcagcatctagcaggtagagagacatgtacgtacagggaataaacttgcaatacttgaagcaaagtggctaaactcgctaatcatagaaccattcttttgaatgctggatttcttggttctggtggacatcaatgggcgatgatttaatgtaaaaattgaatttctagagcaaaaacctaaaagatgaaaatgtataccaaccataaacatgtaaattctctactaataatctttcagctcaggcattcgcatgtgcgcttgtgtgcattacctgtttttgacttgacgagaattgcaaattgccagtgtaggaaaaattgactagcctaatcgacggttcaagttgagtcacccacaagttgaggtaagtccactcgtgagggtcgaccagcatcttttttagcctttaaataacagttaaaacatgcagaccgatacagaagataaggactaggtgaaaaagaagatggcaacaacatgggcaacaccagcagcagcagccgaggcaccaaaaattgtgtggaagcagaacaatagcaggtttgaaacagaggacaaggaggcataccttgaatacgtgctcagaaatgacgggaaagtgatggacatattacacacttatgtccctcgttcgaagagaggattgggtttggcttctcatctttgtgttgcagctttcaatcatgctaagtcccactccatgtctgtcattccctcctgctcttacgtttctgacacctttcttccacggaatgaatcatggaattctgtcgtgttttcagaagatatcaaatcaaatatatgaccaacttcagctgaatgaatgaagtgctttgactgaaaaattattacaagattattaccacttttaacttcttatataataaagtttctgtgttatttccaggtactttttacctatcaacacaggaattcttctctatttttcttctagtatttgctacttttttttttacccgcatcaatctgatacttctggaaatgttgacaataaatggcacgaatgatgtatttaaaagatgtatagcaagagtctcattgcccaattgattctctcagttgggcacaagtgcagtttctaattcacggattacagcaccgatgagtctttttgtccattgttg

SEQ ID NO: 1300 - DNA, 1193 bp, Ricinus communis
acacgttccttccgtcattatttcacgacaacaaaacaaaagaaccaggcagagagatcaaaactccaaaaatctctcgctctgccaaatctcagatctaaaacgacaccgtctcggatcagatcaaacaatcatcatgtcttctggatttagcggcgatgaaactgctcctttcttcggcttcctgggcgccgctgccgctctcgtcttctcttgtatgggagctgcatatggaacggccaagagtggtgttggagtggcatcaatgggagtgatgaggcctgagcttgtgatgaagtcgattgtaccagttgttatggctggtgtgttgggtatatatggcttgattattgctgttattattagtactggaattaaccccaaggctaagtcatattacctttttgatggttatgctcatctctcctccggtcttgcttgtggccttgctgggctttctgctggtatggctatcggaattgttggtgatgctggtgtcagagctaatgcacaacaaccaaaactttttgttggtatgatcctgatcctcatttttgctgaagctttggcattgtatgggcttattgttggcatcatcttgtcttcccgggctggccagtctagggctgaataagcagggagatcactatctgtcattattcttttatgggttaaggttgtgagtgcagggaaagtttaatgattgttcaaagattattgatgattgcgacgcacttgcaggattttgaaaaattcttgttatggaagtgtctgctctgccaggcatttagtggtttctttgtattgtttgcggaagtaggattaaatttatctgcagaataaaagtttgtgaagctgttatatgtttggtttttatgtatcaatgtattttgcggaaacccattatagaaactttaatttcagggctaattcgtctaaggtggtgttatttattgaacctgacctttaataatttcaattgtctcgtcttcatgacaattttatttctgttgatgatacctaaatctctggcccataataccactgttaagtcatttgcgcggttcgttgaagtcttgtttatcagtatcactgattctttttctttttttttttcttttcctttttcctgaaaaccaatctatattctcataaatttgaaaggccaagtattcgagattagcgcattaagt

SEQ ID NO: 1301 - DNA, 1158 bp, Ricinus communis
tatattattattaatttccttcttggtttattaaaactgacccgaatattagtagcccaataatatgatccgttcagactggtctagcaacccaggcccagttcgcatttattgatgtcggtttaatccccctggcccaccaggaagcttcgtgtccccgatctgactgtctctctgtctcaatcgacggtacatctctcagccagatacaaacatcatctccaaaccttgccacagcacagacattcactgatccgatcgaaatttccttaatttccagaaatgtcaagtggattcagcggcgatgaaacggcaccgttctttggtttcctcggtgctgctgctgctctcgttttctcctgcatgggagctgcgtacggaacagcgaagagcggtgtaggagtagcgtcaatgggagtaatgagaccggaattagtaatgaaatcgatagtaccagtagttatggcaggagtgcttggtatttatggtttgattattgctgttattattagtactggtattaaccctaaagccaaatcttattaccttttcgatggttatgcgcatctttcttctggtcttgcttgtggccttgccggactttctgctggtatggctatcggtattgttggcgatgctggcgttagagctaatgcacagcagccaaagctttttgttggaatgattctcattctcatctttgctgaggcactggctctctatggactcattgttggcatcatcctttcttctcgtgctggtcaatctagagctgagtagaatactttgttattggcatcactgcaggtcggtgaggctagtaaaaagtgtgcaggtcttttatcaagttatttttcatgtatgtgaaatctttcaactattatcattagttggcccttgaaataaagttgttaactttctttacatttgttgtattctacatatatattagttttaaacttagaaagctagtgtgaaccttattttgttatctactaaaaaccacccttttgcttttggccgtcaaatagtttgctactatgattaaataattgtactctgctgatggcctctctctctgcgtctttcatgccctttgtgaattgtaactacatatataatgacttcatagtcgtgcaatttactgttcattctgca

SEQ ID NO: 1302 - DNA, 1208 bp, Ricinus communis
tatattattattaatttccttcttggtttattaaaactgacccgaatattagtagcccaataatatgatccgttcagactggtctagcaacccaggcccagttcgcatttattgatgtcggtttaatccccctggcccaccaggaagcttcgtgtccccgatctgactgtctctctgtctcaatcgacggtacatctctcagccagatacaaacatcatctccaaaccttgccacagcacagacattcactgatccgatcgaaatttccttaatttccagaaatgtcaagtggattcagcggcgatgaaacggcaccgttctttggtttcctcggtgctgctgctgctctcgttttctcctgcatgggagctgcgtacggaacagcgaagagcggtgtaggagtagcgtcaatgggagtaatgagaccggaattagtaatgaaatcgatagtaccagtagttatggcaggagtgcttggtatttatggtttgattattgctgttattattagtactggtattaaccctaaagccaaatcttattaccttttcgatggttatgcgcatctttcttctggtcttgcttgtggccttgccggactttctgctggtatggctatcggtattgttggcgatgctggcgttagagctaatgcacagcagccaaagctttttgttggaatgattctcattctcatctttgctgaggcactggctctctatggactcattgttggcatcatcctttcttctcgtgctggtcaatctagagctgagtagaatactttgttattggcatcactgcaggtcggtgaggctagtaaaaagtgtgcaggtcttttatcaagttatttttcatgtatgtgaaatctttcaactattatcattagttggcccttgaaataaagttgttaactttctttacatttgttgtattctacatatatattagttttaaacttagaaagctagtgtgaaccttattttgttatctactaaaaaccacccttttgcttttggccgtcaaatagtttgctactatgattaaataattgtactctgctgatggcctctctctctgcgtctttcatgccctttgtgaattgtaactacatatataatgacttcatagtcgtgcaatttactgttcattctgcatttgatcattaccaacataatgcagtgttagctttggcttgaggttgagt

SEQ ID NO: 1303 - DNA, 1051 bp, Catharanthus roseus
aaaagtaaacgggttaatcagagtcggagcgaaggaacgtgtgatcaggagcgacacaacccagctgagaggagtcaaacatctttgcgcgaaggattgattgagagaattttccccaaatatcttgttaatccagagagctctgctatcaattttttgatcgatcgatcggtcaaattccgaattgacaagggagaaaagattagatcctgtagatcagaagatgtcgtcgattttcagtggcgatgaaactgctccgttctttggattccttggcgctgctgctgctctcgttttctcatgtatgggagctgcatatgggaccgctaagagtggggttggagttgcttcgatgggagtgatgcggccggaactggtcatgaaatctattgttccagttgttatggctggtgtgttgggtatttacggtttgattattgctgtgattataagtactggaattaatcccaagaccaaagcatattatctttttgatggatatgcacatctttcttctggcttggcttgtggtcttgctgggctttcagctggaatggctattgggattgttggcgatgctggtgtcagagcaaatgcacaacagccaaagctttttgttggtatgattctcatcctcatctttgctgaggctctggctctctatggactaattgtcggcatcatcctttcttcccgtgctggtcaatccagagccgactaatcaagtaagacattccatcttcttacttgtttagaggtaattcatgctagtcatgaggtgtactcttgcttgtggttacacattttatttctcactctattatttagtggtcttatgctgcttgtaaatctggagaaaccttctccctcgaataaagatttgtaatgctggttttgctctttattttcattgctgtacttttcccagtgatagaggaaactgctctttggttattacggccaatgttataggattttttgttacttttttgttgtaaactgggaagaattgtaactaaaacttatgtgatgtggaagactgagttggata

SEQ ID NO: 1304 - DNA, 987 bp, Catharanthus roseus
aaaggcccggtttttctcgaagttaatataactactctcttcaccaccagagcagtgaaatctctttcagatccatcctgctctcatctctctctctctgtccgcagatccgatctcaaaatgtcgtcaaccttcagcggcgatgagacggcaccgttcttcggcttcctcggcgctgctgccgccctagtcttctcctgcatgggagcagcatacggtaccgctaagagtggcgtaggagtggcatctatgggtgttatgaggcccgagctggtgatgaagtcaattgtaccagtggttatggctggtgtgctgggtatttacggattaattatcgctgtgatcatcagtactggaatcaaccccaagaccaaggcttattatctctttgatggttatgctcacctctcttctggccttgcttgtggtctcgctggtctttctgctggtatggctattggaatcgtcggagatgctggtgttagggccaacgcacagcagcccaagctttttgttggtatgattcttattcttatttttgccgaagctctggctctttatggccttattgttggcatcatcctctcctcgcgtgctggacaatcaagagcagattagaggagcatatttattgctattttgtcgatgattcattgtgttctttgttagttatggttttccatttgcagaagtttatcgctccaagcccttcgtgcaatgccatcaactcaaagaattgttctggttttagcatgtagattagaatttctttttatggctgaataagatttaatggtgcagcatcttgagaaaaccatattaaaccgtgtagaacttttgtctagactggatacgttaaattttttttaattttattattattcctctccaaaatgggactctgttattcttgtttgtttgtgtctaataacctttcaaggctctttcttcatagttcatttttaattcagttacatgcatattgtt

SEQ ID NO: 1305 - DNA, 870 bp, Centaurea maculosa
  misc_feature (241)..(241): n is a, c, g, or t
  misc_feature (644)..(644): n is a, c, g, or t
  misc_feature (818)..(818): n is a, c, g, or t
  misc_feature (820)..(820): n is a, c, g, or t
  misc_feature (832)..(832): n is a, c, g, or t
  misc_feature (851)..(851): n is a, c, g, or t
aatcctcctcagatccgatcgatcgatcaatttcaccgtcgatctattcaaccaccatgtcttcaacgttctccggcgatgaaacggctcccttcttcggctttctcggtgctgcggccgccctagtcttctcctgtatgggggcggcgtatgggacggcgaagagcggtgttggagtggcgtcgatgggagtgatgaggccggagttggtgatgaagtcgattgtgccggtggttatggntggagttttaggtatttacggattgattattgcggttattatcagtaccgggattaaccctaaggccaaatcttattatctctttgatggatacgctcatctttcctctggtcttgcttgtggccttgctggtctttctgctggtatggctatcggaatcgttggtgatgccggtgttagagccaatgcacaacaaccaaaactctttgttgggatgatcctgatcctcattttcgctgaagcacttgctctgtatggtcttattgttggcatcattctttcttctcgagctggtcagtcgagagcggactagaaggagatgaggtggtgtatcttactgctattaattaagcatatgattattatcctctttgtggttgctgttgttgttggttgagctgcngacatgatcatgatgataccttggcctgatggattggctggctgatgactatgctcctacagtaggttgtagaccaaattctatctctctgctataataataaaattctgtcttttttacgtaaattgtttttggacatgctatatgccggataattttgccagatttgttctncnattgttgttggntactcttttatgttagtcnagaatttcatatttgattt

SEQ ID NO: 1306 - DNA, 985 bp, Cichorium intybus
accggacacgactaaacagggccatacaattcaaccaacatataacgtcatctccccttctctctttctctctctctctctctctcgatctacagatccgatcaatttctctgcaaatttaaaccctaacttcatcttaatcgaccgatcatgtcttcaacattctccggcgatgaaacggctccgttcttcggctttctcggggccgctgccgccccagtcttctcctgcatgggcgcagcgtatgggacagccaagagcggcgttggagtggcgtctatgggagtgatgaggccggagttggtgatgaagtctattgtgccagttgttatggctggagtgttgggtatttacggtttgattatcgctgtgattatcagcaccggaattaaccctaaggcaaagtcctattaccttttcgatgggtatgctcatctttcttccggtcttgcttgtggccttgctggtctttctgccggtatggctattggaatcgtcggtgatgccggtgttagagcaaatgcacaacaaccaaagctattcgttgggatgattctgattctgattttcgctgaagcacttgccctgtacggtcttattgttggcatcattctttcttctcgtgctggtcaatccagagcagactagaaggtattcatccggtgccatactggtgtgttctacagctataacttatgcattttttgatctgtcgttttggggagagttgaagctgtgggtgtgtcgtttttttcttcttcataatttgtgggtggtaaatggtgatgatatgtgttttgagggggtaggtttgtagggtagattgtgggttttcattataataaagatgtctctgtactcgtattatttatttatttgcaaagaacctgttgggatatgttttgatgtatatggtttgcttgattgagcaagagatgttgataacgttctggtattatatcagttacaagacccaattgatgtt

SEQ ID NO: 1307 - DNA, 827 bp, Cichorium intybus
ggcgggggatcaaaggacaggtgttgaaaacaaacaccgatacagatctaaaactcttcctgtttccactttcccgatcgatttcaatcgaaaatcgattaacaatgtcttcagtttcaggattcagtggtgatgaaactgcccctttcttcggtttcctcggagcagctgctgctcttgtcttctcctgtatgggagcggcatatggaacggctaagagtggtgttggtgtggcgtcgatgggtgtcatgcggcctgaactagtgatgaagtcgattgttccggtggttatggctggtgtgctcggtatctacgggttgattattgccgtcatcatcagtaccggaattaaccctaaggcaaaatcgtattatctgtttgatggctacgcacatctttcctctggtctagcttgtggtcttgctggtctgtctgcaggaatggccattggaatcgttggtgatgctggtgttagagcgaatgcacagcaaccaaagctttttgtgggaatgattcttattctcatttttgctgaagctcttgctctatacggtctcattgttggcatcattttatcttcacgtgctggtcaatcaagagcagattaagaagattggagttgttttttttatgtgtttgttgtttgtcatcataaatcaagatcatgttttttcttttctttatttcataattttccagcttttggactccaattattgcattactctaaattttcttgtttgtggactcgttattactagtgattgtggtgttattgcagaataggagttttgctatttttgtggactttctaaaagctgcttgaa

SEQ ID NO: 1308 - DNA, 928 bp, Citrus clementina
cacaccggaaacttccttgtgctatcactgcgtccatctctctccctcgaatccaattaaccttcaaaattcccaaattcctgtaaaccgatcggttctttttaggaggaattgaaatgtcatccgcgttcattggcgatgaaacggcgccttttttcggcttcctcggcgccgctgccgcccttgttttctcctgcatgggagcagcgtatgggacggcgaagagtggagtgggcgtagcatcgatgggagtgatgaggccagagcttgtaatgaaatcgattgtgccagttgtgatggcgggagtgttaggtatttatggtttaattattgctgttattattagtactggcattaacccaaaggccaaatcatattatctattcgatggctacgctcatttgtcttcgggtctcgcttgcggcctcgctggtctctctgctggtatggctattggcatcgttggtgatgctggtgtcagagctaatgcacagcaaccaaagctttttgttggaatgattctcattctcatttttgctgaggcattggcgttgtatggtctcattgttggcattattctctcttcccgagctggccaatccagagcagattaggaggcgtgattcagaactgaggtttctcaaaattatttggtcatgctcacttagatgatgctaggacaccatgtgaaatgttgaggtgtttgtcaatatcccactagattattaagtagctccattctgcctgtaccattaagggcaagattttccccttaaaataatgctcgagttctcgacgtgtattgttgtatttttactgtgaaatcagacgtatgaaagaaccatccttacacattatggtttgtgttatttgttggcttttggggtttacaaatttctgtgctcaaattgattgtgtggttatgtct

SEQ ID NO: 1309 - DNA, 1281 bp, Citrus clementina
agctccgagaccccgatcgatctcatcttcgcgcatttccacatctctcacgagagacaaagtaatcaaagctaatcgggagcagaattctgtgctatccgggaattacttaaaacttgcgattacgactactcagatcttcgtagcaaacaggcaaaatcatcatcgccatgtcatcgactttctccggcgacgaaactgctcccttcttcggcttccttggagcagcggccgctctcgtcttctcctgtatgggtgctgcctatgggacagcaaagagtggggttggagtggcttcaatgggtgtcatgaggccggagcttgttatgaaatcgattgttccagtggttatggctggagttttgggtatttatgggttgattattgctgttattattagtactgggatcaaccctaaagctaagtcttattatttgtttgatgggtatgcacatttgtcttcggggcttgcttgtggtcttgctggactctctgctgggatggctattggaattgttggtgatgcgggagttagggctaacgcacagcagcctaagttgtttgtgggaatgattcttattctcatctttgccgaagctctcgctctttatggtctcatcgtgggaatcatcctctcatctcgagcaggccaatctcgggcagaataaaagaaaaggcttggttttcctttggattagtgaaagcagaatatacatttcaaatgatgtctacgcactacacagtgaagcattaagcatagacccacaggtttgtattgaaaaagagcagatcagctgctcagattgcagcttctctgacatcagtaatgtccataaaatgcatttacctcacattcttttgttcaaaagggcaattgttcagtcagtatgaagagatatgatgcaacttgagtagctacagagtcaaaaggaatatccattccaatgaagtactgattttgttaataatgatacatggaccatcgaccttttgcatgtgaggaatgttaagagtcgctgtgttgttgaaaattgaaagcgcctcaaactcactaatgatttgagtatttgttgcacttggagctttgatgtaaatgatcccggtcggtactgtgtagcctttttaaataagtgccagttgtattaagctttctccgccattctggtaacgatgattgttaattcttaaatctacgacacaaggacataaacttcacatatgctacatattgtgcagttataaattccgaatacagtatcacaatcttacatttgcattcat

SEQ ID NO: 1310 - DNA, 1140 bp, Citrus clementina
aatctcgatacggaaaagagtcgaggggtaattaatttttagaagtcattagtctcctcttgagagaaagagcacggaacaaataacgaaaacaaaacacacgctcaagtctcagatccagtccgcatctcccaagatgtcttcaacattattcagtggcgatgaaaccgctccattcttcggctttctcggcgccgctgccgccctagtcttttcctgtatgggagctgcgtacggaacggcgaagagtggcgtcggtgtggcgtcgatgggagtgatgaggccggagcttgtgatgaaatcgatcgtgcccgttgttatggcgggagttttgggtatttacggtttgattattgctgttattattagtaccggaattaaccctaaggccaaatcttattaccttttcgatggctacgcgcatctctcttctggcctcgcttgtggccttgctggtctctccgctggtatggcaattgggatcgtcggtgatgctggtgtcagagccaatgctcaacagccgaagcttttcgttgggatgatcctcattctgatctttgccgaagcgctggcactttatggacttattgttggtatcattctttcttctcgtgctggtcagtcaagagcagactagaagaggatgctttgcttggtggttatttggcctgttgtgttccattaagaagaattcagttcatattgcatgtgacgggaggtggtagtctgcgttgggtagtgtttttctttttcgacttaaaaaattattgtctgtggtgtgattgttcaaccagattgattcgatttttaatggtatggagaatgtagaattaggaattagtttctcccattaataaagtcatgctgtcattgtttagtttaatgttaaaatgctgtattttttgggatccatttataggttgttgataccctaataatcgcttgtaatgttttctgagactctctttacttgatctccagttttgtaaagccaaaattgtgttgtgggtcaataagtcagaatctgttttctgtttggcagtccaggctaaaaaacgagttgtggtgacaaaatgtaagcagtgatttataatatttgtattgggaggtttatattaataattaagcctattatttgga

SEQ ID NO: 1311 - DNA, 1065 bp, Citrus clementina
aaaaaaaacaaaacaaaacaaaaacaaaaccagagagatcgaaactctgtgtcccaaaaaagatcacagatccaagaaacagttcaacgccgatctaaagcgacaccgtttcagatctacaatccacaatgccttcaacattcagcggcgatgaaacggcaccgttcttcggcttcctcggcgctgccgccgcccttgtcttctcctgtatgggagctgcatatggaacagccaagagtggtgttggtgtggcgtcaatgggtgttatgaggcctgagctggtgatgaagtcgattgtgccagttgttatggctggtgttttgggtatatatggtttgattattgctgttattatcagtactgggattaaccccaaggccaagtcatattacctttttgatggctatgctcatctctcctccggtttggcttgtggtcttgccgggctttctgctggaatggctattggaatcgttggtgacgctggtgtcagagccaatgcacagcagccaaaactctttgttgggatgatccttatcctcattttcgctgaagcccttgcactgtatggccttattgttggtatcatcttgtcttcacgtgctggtcagtccagagcagattaagaagggaatttgtattgctaagtattcttttataacttgtcactctgggggagcgagattttttttaaattattctcaggttcaagtggatagcacttgctcaaaatttcttgtggaagttgccgttctgcgagtcatttgtatgttactccatgtttctggtagtaggattgagtttcttcaaacaataaagtttgcaaagctgtccatgcacttttgcagaactttaaactgtcagaaaggaattttattcggtaatctagtgcatgtattatcttattatctattcaacgtttttgtcttctccacatagtaccctaagtttaatgatggttgctgccatcaacatttgtctgcaaatttctgtgttatctttgtttattttgatgggtatttggaatttatttttcttgtttgatatcaaatgattgttatttgt

SEQ ID NO: 1312 - DNA, 743 bp, Cleome spinosa
tcttcatcgagtcgtttctcggatccgatcaagcttggaagaaaaaacagagatcatatccaggccaaggataacgttattccatcaccgtttcgaatatcctcgcatccaaacaaggagttacaagcgccatggcttcggttttcagcggcgacgagactgctcctttcttcggcttcctcggagcagccgccgctctcgtcttctcatgcatgggtgctgcatatggcacggctaagagtggggttggtgtggcatccatgggtgtgatgaggcccgagcttgtcatgaaatcgatcgttccagtggttatggctggagttttggggatttacgggttgattatagccgttatcatcagtaccgggatcaacccgaaagccaaatcatactatctctttgacggttatgcacacttgtcgtcaggtcttgcttgtggactcgctggcctttctgccggaatggctattgggatcgttggtgatgctggtgtcagggcaaatgctcagcaaccaaagctctttgtgggaatgattctcattctgatctttgccgaggctcttgctctatacggcctcatcattggtatcatcctctcatcccgagctgggcagtcccgagctgactgatgagccaatcagtttgtctatcgcattccctgtcgtccagacatgttgttttaccaccagaatttgttcgtgttcggcttgttactcttttcaagtcaagttcgaggaataaac

SEQ ID NO: 1313 - DNA, 742 bp, Cleome spinosa
agagatcctaatccaggcgaaggataccgttattcggatcaccgcaccgtgtagcctcgcatccaaacaaggagttgcaagcgccatggcttcgggtttcagcggcgacgagactgctcctttcttcggtttccttggagcagcggccgccctcgtcttctcatgcatgggtgctgcatatgggacagcaaagagtggggttggggtggcatccatgggtgtgatgaggccggagcttgtcatgaagtccatagttccagtggttatggctggagttttggggatatatgggttaattatagctgttatcatcagtactggaatcaacccgaaagccaagtcatactatctctttgatggttatgcccatttatcatcgggtcttgcttgtggactcgctggcctttctgctgggatggccattgggatcgtcggcgatgctggtgtcagggcaaacgctcagcaaccgaagctctttgtgggaatgattcttatcctgatctttgccgaagctcttgccctctacggtctcatcgtcggtatcatcctctcatcccgagctggacaatcccgtgccgactgatgaatcaaatctatttgcttattgtcgcattcctgatcatccaagcatttgttttccaccggaatttgttcatgttttggcgtactcattgtattttatgtatcttttacccttttggagttgaggtttgatgaataaacagaaagaaaccattgttag

SEQ ID NO: 1314 - DNA, 789 bp, Cleome spinosa
atatcattgaatttttatcatatcctcagatcgtctctccgcttcagatctcatcgtcgccacaaccatacagaagaagagcaacaacaatggcttcaggttttagcggcgatgaaaccgctcctttcttcggcttcctcggcgccgccgccgcgctcgtattctcctgtatgggagcggcatacgggacggcgaagagtggcgtcggagtggcgtcgatgggggtgatgaggccggagctggtgatgaagtccattgttccggtggtcatggccggtgttttgggtatttatggtctgatcatcgccgtcataatcagtacaggaattaaccctaaggccaagtcttattacctcttcgatggctacgcgcacctctcctccggtctcgcttgtggcctcgccggtctctctgccggtatggctatcggaatcgtcggcgatgccggtgttagagcaaatgcccagcaaccgaagctgtttgtgggaatgattctgattctcatcttcgcggaggcacttgctctgtatggacttattgtcggtataatcctctcttctcgagctggccagtctagagccgactgaaacaaggtatcaatcgagcgagatctatcattatcatgctttggaatctgcatcccgattagaactagtaaattttctgatcatatgttccatcgtaatattccttctgtgcaataatatgatttttttgcaatttgatataattgtaatgtacaatgtttgttccatcagtacatatgggagttcttgcagtttttctgcc

SEQ ID NO: 1315 - DNA, 1029 bp, Coffea canephora
accaatcggatcgctgcaacagagagagacagagagaaagagagagagagaacccccaattccggaaagctccttcgatcgaatttccgatcaaatttctagtttctaacctaaaagcgatcttaatctgaagaaaaatgtcatcaactttcagcggcgatgaaactgctccttttttcggcttcctcggcgcggctgccgccctcgtcttctcctgcatgggagctgcttatgggacagccaagagtggggtgggagtggcatcaatgggggtgatgcggccggagcttgtgatgaagtcgatcgtcccggtcgttatggctggtgtgctgggtatctacggtttgattattgctgtcatcatcagtactggaattaatcctaagaccaaagcttattacctctttgatggctatgcacatctttcttctggcttggcttgcggtctcgctggcctttccgccggaatggccattggaattgtcggtgatgctggtgtcagagcaaatgcacaacagccaaagctttttgttgggatgattcttatcctcatttttgctgaggcattggcactgtatggactgattgttgggattatcctttcttcccgagcaggccaatccagagctgattaagaatttgtattccggtttaacttataagctggaatatttttgcttgtccacgtgtggggagttatgctagtcatggagtggattctttttctcttatatttacttgtgtttcttattcatcatctcatttagtagttttatgctgcttgtaaatctggagagcacctccctccctagaataaagatttgtaagggattgtcccattattgctctgctgtactttacagggagctaaaggaaactatattgtggaactagtgccagtgtagtaggattcttcttattgttgttaatccagaattataatactcaaatgcagtgtcaaccttaactcctactggtgtgtggtactccagaatggatgttgtcattagaggaatggttggttctatg

SEQ ID NO: 1316 - DNA, 1062 bp, Coffea canephora
agctaggcgcttaacaggaaggagcgaaggggccgtgatggtgagattgagacaacatcaggaacagcgttgaacatatcaagccagattagcctacgtcgctggaaagacccccagatccaatctctcatcctccttggaccctcctgccagatctaatcccaagaaaatgtcttcgactttcagtggcgatgagaccgcacccttctttggctttctcggcgctgctgctgccctagtcttttcatgtatgggagcagcttatgggacggccaagagtggcgtaggagtggcgtcgatgggagtgatgaggccggagctggtgatgaagtctatagttccggtggtcatggctggtgtgcttggtatctacggattgattattgccgtgattataagtaccggaatcaaccctaagactaaagcgtactatctcttcgatggttacgctcacctttcttctggtcttgcttgtggcctcgctggtctttctgctggtatggctatcggaatcgtcggtgatgccggcgtcagagccaatgctcaacagccgaagctttttgtgggtatgattcttattcttatttttgccgaagccttggctctttatggccttattgttggcatcatcctctcttctcgagctggtcaatcaagagcagattagaagaggaacttattttagtggagactttctggtgtttatcctcgattaaggactatgtttatgttttccccatttagggatggtcacccagttggataaaagtccaagtctctctaagattatatacatgcaaggccattgctcaatctgaattgttgttttattaggttggggaaattggatttagactttttggtttgaataacatctgtattgtgttacttagtgcctcattatctgtaagttggattggattgtgtaacactatcatcttaattagtctgttgagtcttaaatctttcactagttgagtctctgtttgcaacagtaaatctgggaatcttgtgtatactcctgtggaaggcagttgattgcgccaaaaaaaaaaaaaaaaa

SEQ ID NO: 1317 - DNA, 944 bp, Coffea canephora
tctccatctcagatccaaccctctttttctactcttctctccgtctcttcctctctgattagatccaatccactcagaaaacatgtcttcgaccttcagcggcgatgaaacggcaccgttcttcggcttcctgggggctgccgctgctttagtcttctcctgtatgggagcggcgtatgggacggcgaagagtggagtaggggtggcgtcgatgggtgtgatgaggccggagctggtgatgaagtccattgttcccgtggttatggctggtgtgcttggtatttacgggcttattattgctgtgattattagcacgggcatcaaccctaagaccaaggcttactatctctttgatggttatgctcatctctcttctggtcttgcttgtggcctcgctggcctttctgctggtatggcaattggaattgttggtgatgccggtgttagagccaatgcgcaacaacctaagcttttcgtgggtatgattctcatccttatttttgctgaagccctggctctctacggtctgattgttggcatcatcctctcttctcgagctggtcaatcaagagcagattagaactggattatagttagctgacactttgtggtgctagtaattgataaagggctatattacgttctcgggttagaggtggttatcctgttgcgggagttacttttgctctaaaagcttttatacgtgcaaatccattgctcaacctcaagaattgttgtggtcttcgcatgtagattttgggtttaaaattctttcttgaataaagcctctgtactgttgtttggtgctgcaccttgtcaaaactggattgaattgtgtaacgctaccatctagtattatctacattagctatttgaggacctaaacgtttcgccatattatctttaacccccaaatggtgatttcggcatatactctctttgtt

SEQ ID NO: 1318 - DNA, 893 bp, Gossypium hirsutum
aaaaaaatttctctggaagcaaagcaactatcaactacgtttacctcagatctaaaacccctcgtctcagatccactaaattcaccatgtcttctactttcagcggcgatgaaacggctcccttcttcggcttcctcggcgccgccgccgctctcgtcttctcctgtatgggagctgcatatgggacggctaagagcggtgtgggtgtggcttcaatgggtgtgatgaggcctgagttggtgatgaaatccattgttccagttgttatggctggtgttttgggtatttatgggttgattattgctgttattattagtactggcatcaatccaaaggccaaatcgtattatctttttgatggctatgctcatctttcctctggtcttgcttgtggacttgctgggctttcagctggaatggcaattggaattgttggtgatgctggtgtcagagctaatgcacagcagccaaaactttttgttggaatgatcctgatcctcatctttgctgaagctttggctctttacggccttatcgtgggcatcatcttgtcttctcgggctggccaatctagagcagagtaaggcgctggtagagctgttttagtagtattcttttattgcttatcgtgtttattatgattggacgtcaagtggtgggtttgatgagcagtgtctctttcctctttgtagaagtagaattgagttctctctctaataaattgtatggttattgtttgataagtgtatttgcagtgtgtggaacacttttaattttggagagataatatatgtatgtatttaatccatagcttttagatggttggtggatgtatttatttttggtacgtatcaatattgatgtatcaaaacaatatcacactacttgttaaa

SEQ ID NO: 1319 - DNA, 815 bp, Gossypium hirsutum
tctctcctctgatcggtgaaaagaaaatttagaaaaaaaaaatccatcaccgatctaagttccccaaattctattcaaatcgccggcgaaattttgatctggaaatctaaaaatgtcgtccacattcagcggcgatgaaactgctcctttttttggcttcctcggtgccgctgctgccctcgttttctcctgtatgggagctgcgtatgggacggctaagagcggtgttggtgtggcgtcgatgggagtgatgaggccggagctggtgatgaaatcgatcgttcccgttgttatggctggtgttttgggtatttatggtttgattattgcggttattatcagtactgggattaacccaaaggctaaatcttattaccttttcgatggctatgctcatctttcctctggccttgcttgtggtcttgctggtctctccgccggcatggctattgggatcgtcggcgatgctggcgttagagccaatgcccaacagccaaagctttttgttggaatgattcttatcctcatttttgctgaggctttggctctgtatgggctcatcgtcggtatcatcctctcttctcgtgccggtcaatcccgagctgaatagagtgcaatattccaagactcgggattttgtatccgttcattcattttcatttgctgtttgtaagattagaacatagattcgattcgaaataattcgttttttacattgtttgtattctctatttctggaatcaaatagttcagtgtactgtaaagaccattatgttgatatttttcactcaattctgcaattggcattgcaataa

SEQ ID NO: 1320 - DNA, 899 bp, Gossypium hirsutum
aaaataatatcagaatagattgagataaaagatcaaacaaagctatccactcctttttctcagatccgaaacgccgtcgtcttagtcggaaccacttcgatccacaatgtcttctactttcagcggcgatgaaacggcaccgttcttcggcttcctcggcgccgctgctgctctcgtcttctcctgtatgggagctgcatatgggacggctaagagtggtgttggtgtggcttcaatgggtgtgatgaggcctgaattggtgatgaaatctattgtaccagttgttatggctggtgttttgggtatttatggcttgattatcgctgtcattattagtactgggatcaatcctaaggccaaatcgtattaccttttcgatggttacgcccatctttcttctggtcttgcttgtggccttgctgggctttctgctggaatggcaattggaattgtcggcgatgctggtgtcagagctaacgcacagcagccaaagctttttgttggaatgatccttatcctcatctttgctgaagctttggctctttatggtcttattgtcggcattatcttgtcatctcgggctggacaatcccgagcagaataagataactcaagtgctgcatagtattctcttattgattttatctgtagcactagaccgaaaaccatttcgatcaatatcaggttagttatggttggacagcaagtgccgcgttcgcacataaatattgatgaacaattttttttggtggatgctcttttcctctttgtagtagtagaaattgagtttcttttaactcttaataaaatgttttggagctttcccttgtttgattctttttcagcaatgtatctttttataagttgaaactaactaatgggttaatttgacgggtcaa

SEQ ID NO: 1321 - DNA, 825 bp, Gossypium hirsutum
ctctctcctctgatcggtgaaaagaaaattagaggaaaaaaatccatcaccgatctaagttccccaaattctgttcaaatcgccggcgaaattttgatctgaaaatctaaaaatgtcgtccacattcagcggcgatgaaactgctcctttttttggcttcctcggtgccgctgctgccctcgttttctcctgtatgggagctgcgtatgggacggctaagagcggtgttggtgtggcgtcgatgggagtgatgaggccggagctggtgatgaaatcgatcgttcccgttgttatggctggtgttttgggtatttatggtttgattattgcggttattatcagtactgggattaacccaaaggctaaatcttattaccttttcgatggctatgctcatctttcctctggccttgcttgtggtcttgctggtctctccgccggcatggctattgggatcgtcggcgatgctggcgttagagccaatgcccaacagccaaagctttttgttggaatgattcttatcctcatttttgctgaggctttggctctgtacggactcatcgtcggtatcatcctctcttctcgtgccggtcaatcccgagctgaatagagtgcaatattccaagactcgggattttgtatccgttcattcattttcatttgctgtttgtaagattagaacatagattcgattcgaaataaatcgttttttacattgtttctattctctatttctggaatcaaatagttcagtgtactgtaaagaccattatgttgatatttttcactcaattctgctattggcattgcaataatgaagttcta

SEQ ID NO: 1322 - DNA, 1018 bp, Vigna unguiculata
gacactgtacggtaacagagatcggaacgtggaacttctctgtggggaaatcggaatatctcacttctcagatcagatctattcgacgtcgttgcagtgattatggcttccttcagcggcgatgagacagcaccgtttttcggcttccttggggccgcagctgctctcgtcttctcctgtatgggagctgcctatggcacagcaaagagtggtgtgggcgtggcttcgatgggtgtgatgagaccggagctggtgatgaagtctattgttcctgttgttatggctggagttttgggtatttatggtcttattattgctgttatcatcagtactggcattaatcccaaggccaaatcttattacctctttgatggttatgcacatctctcctctggtcttgcctgtgggctggctgggctctctgctggcatggctattggtattgttggtgatgctggtgttagagccaatgcacagcagccaaagcttttcgttggaatgattctcatcctcatttttgctgaagctcttgccctgtatggtctcattgttggtatcatcttgtcttctcgtgctggtcagtctagagctgattaagaaagatgtgctgcaaaatattctttgatctcccttctctgctttaaccttcttattatgagggcgagggggtaaattgttaattgtggaggttagtgatgttggaacggcactttcaggatttaccacatacttatgtgaaagcagtagctgcaccagtcatttttgtgtttgtataagtgtagtcttctttgcttaataaagcttcttaagcttcttttttccctgtgccatataatcttagtattaaattttttgtgctactgccattgtaatttatttgtattaatgagtcttttaatatcggatgctagtgtgtctaaacgttgccttgtgttttgatcaattagttgtataatctgaatccacatggatgttctcaataaacgaccattttgagcactctaaaaaaaaaaaaaaa

SEQ ID NO: 1323 - DNA, 1013 bp, Vigna unguiculata
ggacactgtacggtaacagagatcggaacgtggaacttctctgtggggaaatcggaatatctcacttctcagatcagatctattcgacgtcgttgcagtgattatggcttccttcagcggcgatgagacagcaccgtttttcggcttccttggggccgcagctgctctcgtcttctcctgtatgggagctgcctatggcacagcaaagagtggtgtgggcgtggcttcgatgggtgtgatgagaccggagctggtgatgaagtctattgttcctgttgttatggctggagttttgggtatttatggtcttattattgctgttatcatcagtactggcattaatcccaaggccaaatcttattacctctttgatggttatgcacatctctcctctggtcttgcctgtgggctggctgggctctctgctggcatggctattggtattgttggtgatgctggtgttagagccaatgcacagcagccaaagcttttcgttggaatgattctcatcctcatttttgctgaagctcttgccctgtatggtctcattgttggtatcatcttgtcttctcgtgctggtcagtctagagctgattaagaaagatgtgctgcaaaatattctttgatctcccttctctgctttaaccttcttattatgagggcgagggggtaaattgttaattgtggaggttagtgatgttggaacggcactttcaggatttaccacatacttatgtgaaagcagtagctgcaccagtcatttttgtgtttgtataagtgtagtcttctttgcttaataaagcttcttaagcttcttttttccctgtgccatataatcttagtattaaattttttgtgctactgccattgtaatttatttgtattaatgagtcttttaatatcggatgctagtgtgtctaaacgttgccttgtgttttgatcaattagttgtataatctgaatccacatggatgttctcaataaacgaccattttgagcactctaaaaaaaaa

SEQ ID NO: 1324 - DNA, 863 bp, Cucumis sativus
gattattcgaagataacgtggagagattttagacaataaaagggttgaaagagcgaaatacataaaatttgagtatccgaaggaaaaacccaaaatcagagagaaaagaaaaggaaagaaaaaaaaaaacttcagatctgatctgatcagagatcttcttcttctctccatcggaaaaaatgtcgtcagcgttcagcggtgatgaaacggcacccttctttggctttctcggcgctgctgcggcccttgttttctcctgtatgggagctgcttacggtaccgcaaagagcggtgttggtgtggcgtcaatgggagtgatgaggccagaattggtaatgaagtctattgttccggtggttatggctggagttttgggtatttatggtttgattattgctgtgattattagtacgggaattaaccccaaggctaaatcttattaccttttcgatggttacgctcatctctcctctgggcttgcttgtggtcttgctggtctgtccgctggcatggctatcggaatcgtcggggatgcgggcgtcagggccaacgcacaacaacctaagctttttgttgggatgattctcattctaattttcgccgaagcacttgctctttatggacttattgttggtattattctctcctctcgagctggtcagtcaagagctgaataagtgatgaaatgttttgagcttgaaatttgtgtattgatctttctttttcctttcttttatctcatgaattgttttttgtagttctatgattagaaatggtcatgactaagttttttactttctcaaatattcttgttgtcgtgtgatttctgtaccacatatatattctgtactcataaggatttg

SEQ ID NO: 1325 - DNA, 821 bp, Cucurbita pepo
ttaccggagtcttgagatcggaagctatattggttgctctgatccgatggcgtctactttcagtggcgatgaaactgctcctttcttcggcttcctcggggccgctgcagctcttgtgttctcatgcatgggtgctgcttatgggactgcaaagagtggagttggagtggcctccatgggagttatgaggccagagcttgtcatgaaatctatagttcctgttgttatggctggagtgttgggtatttatggattgatcattgctgttattattagtaccggaataaacccgaaagcgaaatcgtactatttgtttgatggttatgctcatctgtcttctggacttgcttgtggacttgctggtctctctgctggaatggcaattgggattgttggtgatgctggtgttcgggccaatgcacaacaacctaagctctttgttggaatgattctcatcctcatcttcgccgaagctctcgccctctacggtctcattgttggtatcattctttcctctcgagcaggccaatcccgtgcagattaaagtacgtaaagtcgatccaccgtctttgaatttgtgattcaaatgttttaaggagattttggtactgtgttacttctgttgatgtcaaactgaacctattgtattgtattgagttatggtaatgagcaggttttatgacaaacctccatgctcttctggttgttttgtgtgatattctttctaaatttagtcggtgtggacattacctttggatgcagattcctttagaaaattaacccaaatattctcaaataaaataccttccttactatgttat

SEQ ID NO: 1326 - DNA, 836 bp, Cucurbita pepo
cctagaaaagcttgccggagcgttgagaaccgggatcggattccgaagctaatatcggttgttaatccaatggcgtctacttttagcggcgatgaaactgctccgttcttcggcttccttggggccgctgctgctcttgttttctcctgcatgggtgctgcttatgggactgcaaagagtggagttggagtggcctccatgggagttatgaggcctgagctcgtcatgaaatctattgttcctgttgtcatggcaggagtgttgggtatttatgggttgatcatcgctgttattattagtactggaataaacccaaaagcaaagtcatactatttgtttgatgggtatgctcatctttcttctggacttgcttgtggtcttgctggtctctctgcaggaatggcaattgggattgttggcgatgccggtgttcgggccaatgcacaacaacctaagctctttgttggaatgattctcatcctcatctttgctgaagctcttgccctctacggtcttattgttggtatcattctctcttctcgggcgggtcaatctcgtgcggattgaacgacgagcgacgccaagttcatccttcatctttgaatttgttatccaaatgtttcaaggagattttgttactatgtttcttctgttcatgtcaaacctgaacctatgtattttattgagtgatggtaatgagcaggttttatgacaaacctccatgctcatctcctcatttgtgtgatattctttccagttttagtcagtacacttgagttgtggactgattctatgtggtcgttaccttatgatgcagattccgttgagaataaaaa

SEQ ID NO: 1327 - DNA, 840 bp, Taraxacum officinale
aacgtgaggtaggagattgtacgcgtgctctatttatctattcattattcatactccggcgagcaattcaccggcctacgaaatccattacgatctctcccacaaatcaacagctgtaaataatgccgtctactttcagcggcgatgaaactgctccgttcttcggcttcctaggagccgcagcagccctcgttttctcatgtatgggagcggcgtatgggacggcgaagagtggcgttggtgttgcatcgatgggagtcatgaggccggagctggttatgaagtcgattgtgccggttgttatggctggagtgttaggtatttatggattgattattgctgttattattagtaccggaatcaatccaaaggcgaaatcgtattacttgtttgacggttacgcgcatctgtcatctggtcttgcttgtggtctcgctggactttccgctgggatggccattggaatcgtcggcgatgccggtgttagggcaaatgcacagcagccaaagctttttgttggaatgattttgatccttatttttgctgaagcacttgcattatacggtctcattgttggcatcattctctcttcgcgtgctggtcagtccagggccgattaagtcattttacaggttttcatccttcctttataaaggttagtttcaccagttcagaaggatttataatcgtgcttttatatttgtgttgtttaattgtttgttagttattaaaccggatgacacttttgcccttgaataaagcctcaatgctagcattgtttatttgcctattttgtatcataaatatgtgaaggtgaaacagtggatgattattattaag

SEQ ID NO: 1328 - DNA, 887 bp, Epimedium sagittatum
gcaaaaccggcaccggaacatgtcgacgacattcagcggcgatgagactgctcctttcttcggtttccttggcgctgcagctgccctagttttctcctgtatgggagctgcttatggaacggcgaagagcggtgttggtgtcgcctcgatgggcgtgatgaggccagaattagtgatgaaatcgattgttccagttgttatggctggagttttgggtatttacgggttgatcatcgctgttattataagtactggtattaaccctaaggcgaagtcgtattacttgtttgatgggtatgctcacctttcgtctggtcttgcttgtggtcttgctgggctttctgctggaatggctattggtattgtcggtgatgctggtgttagagccaatgctcagcagcccaagctctttgttggtatgatcctcatcctcatcttcgctgaagcgctggctctatatggtctcattgttggaatcattttgtcgtcccgtgctggtcaatcaagagccgactagagatgcaactcattctgtaatgctatatatgttggtggtcttcccaggtttgtgatatcagctcagtgcccatggcagtataaatatctttatcctgaatgcagctactccgcccacctgtggtggtttgtaggattaggacccagtgttcaaaataaagcttatgacgccgtttcagttatctatagtttctgtattcatggacatcacgtaagtatggacttttgtagaacctcccattattttttgttcgccagtccctgtttatccagttacgtgttcttttgtccggctacaataccttttcattattaggcttgaaaattttctcagcaatggaaaaggcgaataaatggtttggttgtgaacg

SEQ ID NO: 1329 - DNA, 885 bp, Euonymus alatus
gctttttatcagatccaaacgacacagctccagatctagttgatcgacaatggcctcggactttagcggcgatgaaacggcacctttcttcggcttcctgggagcggctgctgccctcgtcttctcttgtatgggagctgcatatggaacagctaagagtggtgttggtgtggcgtcaatgggagtgatgaggcccgagctggtgatgaagtcaattgttcctgttgttatggctggtgtgttgggtatatacggcttaattattgctgtcattatcagtactggaattaaccccaaggccaagtcatactacctttttgatggatatgcacatctctcatctggtcttgcttgtggacttgctgggctctctgctggaatggcgattggaattgttggtgatgcaggtgtcagagctaatgcccagcagccgaaactttttgttggaatgatcctcatccttatctttgctgaggcattggccctttacgggcttattgttggaatcatcttgtcctctagagctggtcaatccagggcagattaaaaagggaactgttatccatgttacacctgcaagatttttatttattctcaggttggctgatgttagacggctcttgtgctattagttgaagtatttagtttctctgcacaataaaaagttgtgaagttttccatgtgtggttttctctatcagtatattttgtacacatttcaaactatcataggaacttaggtttctggaaccagcatgtctggtccatattatttatggatactttactcatctagtaagttcccagtaccattaagcctctagataactgctttgctaaattattgtttctgaaagctaagcgtgatggatcatttgtttgaagt

SEQ ID NO: 1330 - DNA, 950 bp, Euonymus alatus
cggccggggcatttcatcttgcccggacaacaaaaaagccatagagagagaatcagggagatcaaaaaaaatctctggaagaataaacaattcacgaagagacttgctaccagatctaaacgacaccgctccagatctacttgatcgacaatggcctcgactttcagtggcgatgaaactgcacctttcttcggcttccttggggcggctgcggcactcgttttctcctgtatgggagccgcgtatggaacagctaaaagtggtgttggtgttgcctcaatgggagtgatgagaccagagctggtgatgaagtcaattgttcctgttgttatggctggtgtcttgggtatctatggcttaattattgctgttattatcagtactggaattaaccccaaggccaagtcatactacctttttgatggatatgcacatctctcatctggtcttgcttgtggccttgccgggctctctgctggaatggcaattggaattgttggtgatgctggtgtcagagctaatgcccagcagccaaaactttttgttggaatgatccttatcctcatctttgctgaggcgttggccctttatgggcttattgttggaatcatcttgtcctcaagagctggccaatccagggcagattaaaagggaactgcagcgacattttattcttttgcttatccgtattactccaggaagatttctatttattctcaggttggctgatgtttgacagcccttgccggggctgcaaaatttcattgtttagctgttttttcaagcatcgcgatggttgtctgtgctattagtagaagtccttagtttctctgcgcaataaaaagttgtgaagctgttcatgttttctttttctcgatcaaatgtattttgcagtcgtttcaaactatcataggtactaaattcctggaaccagattgtctggtccttat

SEQ ID NO: 1331 - DNA, 920 bp, Euonymus alatus
tttcatcttgcccggacaacaaaaagccatagagagagaatcagggagatcaaaaaaatctctggaagaataaacaattcacgaagagacttactaccagatctaaacgacaccgctccagatctacttgatcgacaatggcctcgactttcagtggcgatgaaactgcacctttcttcggcttccttggggcggctgcggcactcgttttctcctgtatgggagccgcgtatggaacagctaaaagtggtgttggtgttgcctcaatgggagttatgagaccagagctggtgatgaagtcaattgttcctgttgttatggctggtgtcttgggtatctatggcttaattattgctgttattatcagtactggaattaaccccaaggccaagtcatactacctttttgatggatatgcacatctctcatctggtcttgcttgtggccttgccgggctctctgctggaatggcaattggaattgttggtgatgctggtgtcagagctaatgcccagcagccaaaactttttgttggaatgatccttatcctcatctttgctgaggcgttggccctttatgggcttattgttggaatcatcttgtcctctagagctggccaatccagggcagattaaaagggaactgttatccatgttacaccagcaagatttttgtttattcttgggttggctgatgtttgacggctcttgtgctattagtcgaagtatttagtttctctgcacaataaaaagttgtgaagttttccatgtgtggttttctctatcagtatattttgtacacatttcaaactatcataggaacttaggtttctggaaccagcatgtctggtccatattatttaaggatactttactcaattgattgcatctagtaagttccccgtaccggtaaaaaaaaaa

SEQ ID NO: 1332 - DNA, 872 bp, Flaveria ramosissima
aaacacaaaccctcagatccgatcaatttctctgcagatccacaatcatctcatcatgtcttcaacattctccggcgatgagacggctccgttcttcggctttctcggtgccgctgccgcccttgttttctcatgtatgggggcggcatatgggacggcaaagagcggtgttggagtggcgtcgatgggagtgatgaggccggagttggtgatgaagtcaatagtgccggtggttatggcgggagtgttgggtatctatgggttgattatagctgtgattattagtacggggattaaccctaaggctaaatcttattatctgtttgatgggtatgctcatctttcttctggtcttgcttgtggtcttgctggtctttctgctggtatggctattggaattgttggcgatgttggtgttagagccaatgcacaacaaccaaagctatttgttgggatgatcttgattctcatttttgctgaagctctggctctctatggtctgattgttggtatcatcctctcttctcgcgctggtcagtccagagctgactagacaggcagcggccttggtggattatcttctctctgtggttgtggtggtggtggttgaggtgcagacctgatcaattctttggtggtgatggtatattggactatggctatgctcatacagtaggttttaaaccaaactctagctctcttgagtctcttctataataatgtttcatctcctttttgttagataaactttgcacatttgtcccacatttgttggtaactatttattttatgatgaaaattcagtttcttattatgtatcaaacccaacaagaacaacttggcgtggctatttggttctcgtgtttgaattt

SEQ ID NO: 1333 - DNA, 752 bp, Flaveria ramosissima
tcgatatcgatcatcagatccgagcaaccgatcatgtcttcaacgttctccggcgacgaaacggcaccattcttcggctttctcggagccgctgccgccctagtcttctcctgtatgggggctgcttacgggacggcgaagagcggcgttggagtggcgtcgatgggcgtcatgaggccggagttggtgatgaagtctattgtccccgttgttatggctggagttttggggatttatgggttgattattgctgtgattattagcacggggattaaccctaaggcgaaatcgtattatctgtttgatgggtatgcgcatttgtcttctggtcttgcttgtggtcttgctggtctttctgctggtatggctattggaatcgttggtgatgctggtgttagagccaatgcacaacaaccaaaactttttgtggggatgatcctgatcctcatcttcgctgaagctcttgctctctacggtcttattgttggcatcattctttcttctcgagctggtcagtcgagagcagagtagaaggttcgcgactgatggatgatcctgtactcgctcgtgtgttttacagctatcacttgaaggatgttttggttgtctcttttggtggtgctgaagctgtgttgttttttccataatttgtgggtggtaaatggtgatgatatgtgttgagggttggttgtagactagagtgtagtttctgctataataagggtgtccctgctactggtattatttatatt

SEQ ID NO: 1334 - DNA, 953 bp, Linum usitatissimum
atcaatcatttcaatcatcgcaacaccggcaaatttttttgttccttcttcctaagatccggtgaagagagacattaaaaatggcttcaacattcagcggcgacgagactgcccctttcttcggcttcctcggggccgcagctgccctcgtcttctcctgcatgggagctgcctatggaaccgcgaagagcggtgttggagtggcatccatgggcgtgatgaggcccgagctggtgatgaaatctatcgttccggtggttatggctggtgtcttgggtatctacggtttgattattgctgtcatcatcagtactgggattaacccaaaggccaaatcttactacttgttcgatgggtatgctcatctttcctctggactcgcctgtggtcttgctggtctctctgctggcatggccatcggaatcgttggtgatgctggtgttagggctaacgcacagcagcctaagctttttgtgggaatgatcctcatcctcatttttgccgaagcacttgctctgtatggccttatcgttggcatcatcctttcatcccgagctggacagtcgagagccgactgaacagcaataccgaggaggtccctattgggttgggttggttgcttgtatgttcttatttattgagagaatcatttgatgttttaattaagactgatttggagccttttttggttagcattatgtactgccagatagacgagtattatttctatataggtcccttcaacctatcatggtaaaaaagcactactagatatgtgctccttggttttataacaagtctgtggtcgtcttgctgcattctttgatttactaaactgattttgcattttggcctcccgaatgtatccgattttgtcattttgttttctttttgtgtgtggaaccctgagagtccatctagagcttgattttgcagtatgctcaaattccaac

SEQ ID NO: 1335 - DNA, 837 bp, Linum usitatissimum
ccacgcgtccgctctgcaaatctctcgacaccgtttgttgatcctctgttcatctttccaagaaggattattgcgtgatcagaatatctcagtcggagaagaaagatggcatctacgttcagcggcgatgaaactgcacccttcttcggcttccttggagccgcagcggccctcgtcttctcctgtatgggagctgcttacgggacggccaagagcggtgtcggagtggcttcgatgggggtgatgaggccggagcttgttatgaagtcgattgttccagttgttatggctggagtcctcggtatctatggtttgattatcgctgtgatcatcagcactgggattaaccctaaagccaaatcgtattaccttttcgacggatacgctcatctctcctccgggttggcctgtgggcttgccggactctctgctgggatggccatcggcatcgtcggagacgccggcgtcagggctaatgcacagcagccaaagctgttcgtgggaatgattctgattcttatctttgctgaggcgttggcattgtatggtctcattgtcggcatcatcctctcgtctcgagcaggtcaatccagggccgattaaaaattgagtctttcttcgtggtcacttgatatttatcaggttagatgatgattctgcctgaggtgtgtaggttgttgtgtaaagttattcctctttacacgttccaaaaaaagacatcgaaagtctattgcattactggttttgtaccggagttaggtttctcctttgaactgctgtggttttcgtttgatgtattctgtacggtacatttattgaaataagtggtgtttgttc

SEQ ID NO: 1336 - DNA, 973 bp, Linum usitatissimum
gagccgaagaaagaaggaagcattcatcccaactctactatcaatcatttcaatcatcgcaacaccggcgaattttgttgttgcttcttcctcagatccggtgaagagagacattaaaaaatggcttcaacattcagcggcgacgagactgcccctttcttcggcttcctcggggccgctgcagccctcgtcttctcctgcatgggagctgcctatggaacggcgaagagcggtgttggagtggcgtcgatgggagtgatgaggcccgagctggtgatgaaatctatcgttccggtggttatggctggtgtcttgggtatttacggtttgattattgctgtcatcatcagtactgggattaacccaaaggccaaatcttactacttgttcgatgggtatgctcatctttcctctggactcgcctgtggtcttgctggtctctctgctggcatggccatcggaatcgttggtgatgctggtgttagggctaacgcacagcagcctaagcttttcgtgggaatgatcctcatcctcatttttgccgaagcacttgctctgtatggccttattgttggcatcatcctttcatcccgagctggacagtcgagagccgactgaacagaaataccgaggaggtccctattcgcttggttttggttgcttgtatgttcttatttattgagagaatcatttgatgtttttattagactgttttggagccttttttggttagctttatgtacttaaactatttctatataggtcccttctacctatcatggtaaaaaagcactactagatatgtgctccttggtttcataacaaggtcattctcttctgtttggtgaccaacgcatttcatctttctccgctgatattatttattgtatcaagtctgtcatgattggggttgattttccttattttaccatttctactaataatccaaaggactatcgtcggccgtttctac

SEQ ID NO: 1337 - DNA, 2036 bp, Linum usitatissimum
gcatcgtccaatgtgctgaagagcccgctgctgccggggatgatgagccgcgagtttagcctcgagccttccattttccgctgagtttcctcttcccctaaggtcttgttcgccgccgtgatttggccggcgatcgcgtctttcaacgatcggaactgcctcgagatggtctgcaaagccagcgccgtgtaggtcctcgccgatcccgtccccgccgcttgctcgaacgccgatatcaccgcctgcatctggtgattgtactgcctgtacctctgctccacctgtcagaacacacccaaaaaaaacaacaaattcgccgtcatatatcaatttcatcgggtgggaaataaataacaaaatgaaaatccagttctcgtatacctcatcaagcatgttgatgagcttgcctttcctcatctgaacctcctgcctctccgcagtcgtaagctccggcgatatcttcccatcgccggacgcagctgactccgcctccttactgacggcgttattagtattccctttctttgacgcttcggtcttgccattaatggctcctccgttaacgttgacgttaacgacttcgtcgatcaattcctgagcagctttcaagtacttggagctcaacagcacgccaggagcggtggggaccacgccggcagcacaattctcggtcactccaccagaactcgacgaaacctgctggtgctgctgacggtgctgctggtgggaggagagagtcaaagagagagcctgctggtggtggtggtggtggtgggaggcgcgtggggaagcacgcgtctccgaggaggagagatcgacagggctgtaaaggctgttgtagtggtgggggtctagagggatgccgacgaactgctgctgttgctggtggtggtggtggtggccggaggagaagtggtgaggcggaggaggaggggtgacgtcgtcgtggtcggagtagtggtggacgtaggtagggttcataaggaggagggtatgaagaccttcagtttggatttcagcagggttgccgccatggaagtatgtcgtcatcaacgtactgctgggatggatcgaagagcgatggagctgtttgattagtgatcagtgattggacacctccatatattgatattctctcacacagcagtagtgctaatatctttttaaattcattttgacactactagagagagagagagagatggttcatcgttccaagaaggattatcgcgtgatctgaatatcccagtcggagaagaaagatggcatctacgttcagcggcgatgaaactgcacccttcttcggcttccttggagccgcagcggccctcgtcttctcatgtatgggagctgcttacgggacggccaagagcggtgtaggagtcgcttcgatgggggtgatgaggccggagcttgttatgaagtcgatcgttccagttgttatggctggagtgctcggtatctatggtttgattatcgctgtgatcatcagcactgggatcaaccctaaagccaaatcgtattaccttttcgacggctacgctcatctctcctccgggttggcctgtggccttgccggactttctgctggcatggccatcggcatcgtgggagacgccggcgtcagagctaatgctcagcagccaaagctgttcgtgggaatgattctgattctcatctttgctgaggcgttggcattgtatggtctcattgtcggcatcatcctctcttctcgagcaggtcaatccagggccgattaaaaaattaagtctttcttcgtggtcacttgatatttatcagggtagatgatgattctgcctgagaggtgtaggtcgttgtgtaaagttacttctctttacacgttccaaaaaaaagacatcaaaagtctattgcattactggttttgtgaccggagttagttctcatttcgactgctgtggttttcgtttgatgtattctgcacggtacgttatttgaaataaatgttgtttgttctccgtccatcttcccgatactctttgcatctatctgctatc

SEQ ID NO: 1338 - DNA, 997 bp, Linum usitatissimum
tcgcttgtgaaccaatcatatagcgcctcgttaactaagtagatctccctccacatctctctctctctctctctctctctctctgcatctcagccgagtagaacttcaacttagcgctctattcatctacggatcgccagagtagcaaaaagcaatcgcccacgatcagatccgcggcttaaaatggtgtcaacgtttagtggcgacgagactgctcctttcttcggcttcctcggagctgctgccgccctcgtcttctcctgcatgggagctgcctatggaactgccaagagcggtgtcggagtggcgtccatgggagtgatgaggcccgagctggtgatgaaatctatcgttccggtggttatggctggtgtgttgggtatctacgggttgattattgctgtcatcatcagtactgggattaaccctaaggccaaatcttactacctgttcgatggttatgctcatctctcctccggccttgcctgtggtcttgctggtctttctgctggtatggccattggcatcgttggcgatgctggtgttagggcgaatgcgcagcagccaaagctttttgttgggatgatcctcatcctcatttttgcagaagctcttgcactgtacgggctcattgttggcatcatcctttcatcaagagctggacaatcaagagccgactgaaaaactaaaagagagtgccgaccccttcttcctcgggtgattgtgtagatttgttttttgattcataaatcgttccatatttagactcctgagttgtttccttttgtttatctttcagtctgtgtactagatatgttagctggtttctaataagtttcccctgcttctcctcttcatactggtcacagaattgtctgtacaatttcttctatgttgagcgatgctctacaggacatttaagctgaagttgtatgatgaataagatccactgtgaaatcttgcggtcctagctgtgaaatatttgcttgattctgcc

SEQ ID NO: 1339 - DNA, 821 bp, Linum usitatissimum
cggggagagagagagagtcgtcattcatctaccgatcgccaggagttaaccagggacaagcaatagcccacgatcagaaccgcggctaaaaatggcgtcaacgtttagtggcgacgagactgctcccttcttcggcttcctcggagctgctgccgccctcgtcttctcatgcatgggagctgcctacggaacggcgaagagcggtgttggagtggcgtccatgggagtgatgaggcccgagctggttatgaaatccattgttccggtggttatggctggtgtgttgggtatctacggtttgattattgctgtcatcatcagtactgggattaaccctaaggccaaatcttactacctgttcgatggttatgctcatctttcctccgggcttgcctgtggtcttgctggtctttctgccggtatggccattggcatagttggcgatgctggtgttagggctaacgcacagcagccaaagctttttgtgggaatgatcctcatcctcatttttgccgaagcacttgctctgtacggccttatcgttggcatcatcctttcatcccgagctggtcagtcgagagccgactgaacagaaatactgaggaggaccctattgattggtttggttgattgttactgttgatactgtttttgaggcctttttggttagctttatgtactgccagatagacgagtattatttcttctatctatcatggtaaaaattgtactactagatatgttctgcttggtctcataacaagtatgtggtcgtcttgctctatttcttggatttacttgaactgaatgtgtttatttcc

SEQ ID NO: 1340 - DNA, 1146 bp, Setaria italica
gtcctgcccttccccggtcgcaggggcaaaaccgtccagctcagaaaacaccccatcagcgccgtggccctctcgtcttcttcccccgccccccctcccacgcgctcctcagatcagatcggcgaggccaaatcccaagcggaggagcgaaatctcgagcgctcgtgccggcgactccgactgcggcacgagagcttcccagggttccgtttatcttcgcagcatcagcggcagcggcagaaggaaggaagatggttgcgttcagcggcgatgagaccgcccccttcttcggcttcctcggcgccgccgcggcgctcgtcttctcatgcatgggggcggcgtacgggacggccaagagtggcgtcggagtggcgtccatgggtgtcatgcgcccggagctcgtcatgaagtccatcgtgcccgtggtcatggctggtgtgctcggtatctacgggctcatcattgctgtcatcatcagtactgggatcaaccccaaggccaagccgtactacctctttgatggatatgctcacctgtcatctggccttgcctgtggtcttgctgggcttgccgctggcatggccattggcattgtcggtgatgctggtgtcagggcaaacgctcagcaaccgaagctgttcgtgggcatgatcctcatcctcatctttgccgaggcgctcgcgctctacggtctcatcgtcggcatcatcctttcatcccgcgctggccagtcgcgtgcagactaggcgccatccaggtctcagataccatgcctgccatggctgggccttgttttatattcatgagacaagaagctggagctcttttagcgggatattcttattattctgtctagttttcgatcttctgtttgggtccgagaaaaaaaaacatgcgcagccaagggaggactttgcccttgtggtgccgatgccattctttctccgtcgtggtgggttgtggtcgatgcttatttatgcacagtttttgttgggggatatggctggacggcgttgtaatttggtgaataagaataagcaaggacatgcaatgcaacgagtgttgaggacaacttactgttcatcagctgttcttgggcgaattatgcgtaagtggtactaatcccgttttattgttagatctttg

SEQ ID NO: 1341 - DNA, 957 bp, Fraxinus spp
ctagatctgttcatcggaaacccccaaatcagctatcgctgtaactgttaattcaacgtaaatttacagatccattagcaatttttttgaatcccaacaaaaatgtcttctgtcttcaacggcgatgagactgctccctttttcggcttcctcggcgccgcttctgccctcgtcttctcctgtatgggtgcggcgtatggaacggcgaagagtggtgtaggtgtcgcttcgatgggagtgatgaggccggagctggtgatgaagtcgatcgtgccagtggttatggctggagtgttgggtatttacgggttgattattgctgtgattatcagcactgggattaaccctaaggcaaagggttattatcttttcgatggctatgcgcatctctcctcgggcctcgcttgtggccttgctgggctctcagctggaatggcaattgggattgttggcgatgctggcgtcagggctaatgcacagcagccgaagcttttcgttgggatgatcctcattctcatcttcgctgaagctttagccctttatggtctaatcgttggaattattttgtcttcacgagctggccaatctagagctgactgagaaattggcttttaacaagttcgactgcaatgtttgatgttatgttgaaacttgattcttgacaggcttcataaactctttcatacgctccctatttatcaccatgaatgttatccatgtttccatggcattcattccatggtagctgcgtgatgtttgtagaactattagaagtgtttttttctacccctgctgaataaaagcttatatggctatcgcttttgggttaagtgaatttgtttcccgttttttgtttttggcagttatgagtactgtagaaataaatttcttcgaaactagtgcctatagcgtgcttaatgtattagatatgcagagatatcgtgcttctatgaactg

SEQ ID NO: 1342 - DNA, 857 bp, Gerbera hybrid cultivar
gagagaactagattgtgttctctgcggaatttggatagggtgtctgaacaattaatcttcagatccattcaatttctgtgcaaatctaaaccctaccgattgatcatgtcttcaacattctccggcgatgaaacggcaccgttcttcggcttcctcggcgccgctgccgccctagtcttctcctgtatgggggcggcgtatgggacggcgaagagcggtgttggagtggcttcgatgggagtgatgaggccggagttggtgatgaagtcgattgtgccggtggttatggctggagtgttaggtatttacggtttgattattgctgtgattattagtaccgggattaaccctaaggccaagtctcattacctctttgatggatacgctcatctttcttctggtcttgcttgtggccttgctggtctttctgctggtatggccattggaatcgtcggtgatgctggtgttagggccaatgcacaacaaccgaaactttttgttgggatgatcttgattctgattttcgcggaagctctggctctctatggtcttattgttggtatcattctttcttctcgagctggtcagtccagagcagactagaagaatggcataatcgtgcgcgtttgactgctttaaagtgagcattattcttaatctctttgattagtgttattaatcaagctgcaaatgtgtcgtttgttccaaaatcttggtgggtaagatagatgtgtgccgagggttaggttgtagactagattctagttctccctttcaataaagtcgtttctgtttttgttatttgttgctatattttttgtttccaaaaacctatttgaacatggtattcgtgtata

SEQ ID NO: 1343 - DNA, 981 bp, Gossypium raimondii
tttcgtaaaagtttttatgaaagcaaatagtgaggccttttgtaaagataatgcaatgaaagcccataaaaatttagcccaaatcaaggccgagactcgtttaatggtatccactaagaaaatttcccaattctctctcctctgatcggtgaaaagaaaatttgaagaaaaaaaatccatcaccgatctaagttccccaaattctgttcaaatcgccggcgaaattttgatctgaaaatctaaaaatgtcgtccacattcagcggcgatgaaactgctcctttttttggcttcctcggtgccgctgctgccctcgttttctcctgtatgggagctgcgtatgggacggctaagagcggtgttggtgtggcgtcgatgggagtgatgaggccggagctggtgatgaaatcgatcgttcccgttgttatggctggtgttttgggtatttatggtttgattattgcggttattatcagtactgggattaacccaaaggctaaatcttattaccttttcgatggctatgctcatctttcctctggccttgcttgtggtcttgctggtctctccgccggcatggctattgggatcgtcggcgatgctggcgttagagccaatgcccaacagccaaagctttttgttggaatgattcttatcctcatttttgctgaggctttggctctgtacgggctcatcgtcggtatcatcctctcttctcgtgccggtcaatcccgagctgaatagagtgcaatattccaagactcgggattttgtatccgttcattcattttcatttgctgtttgtaagattagaacatagattcgattcgaaataaatcgttttttacattgtttctattctctatttctggaatcaaatagttcagtgtactgtaaagaccattatgttgatatttttcactcaattctgctattggcattgcaataatgaagttctactatcagcttccccacttctcta

SEQ ID NO: 1344 - DNA, 1085 bp, Gossypium raimondii
tgggggctctttcattggcaacaaaaataatatcagaatagattgagataaaagatcaaacaaagctatccactcctttttctcagatccgaaacgccgtcgtcttagtcggaaccacttcgatccacaatgtcttctactttcagcggcgatgaaacggcaccgttcttcggcttcctcggcgccgctgctgctctcgtcttctcctgtatgggagctgcatatgggacggctaagagtggtgttggtgtggcttcaatgggtgtgatgaggcctgaattggtgatgaaatctattgtaccagttgttatggctggtgttttgggtatttatggcttgattatcgctgtcattattagtactgggatcaatcctaaggccaaatcgtattaccttttcgatggttacgcccatctttcttctggtcttgcttgtggccttgctgggctttctgctggaatggcaattggaattgtcggcgatgctggtgtcagagctaacgcacagcagccaaagctttttgttggaatgatccttatcctcatctttgctgaagctttggctctttatggtcttattgtcggcattatcttgtcatctcgggctggacaatcccgagcagaataagataactcaagtgctgcatagtattctcttattgattttatctgtagcactagaccgaaaaccatttcgatcaatatcaggttagttatggttggacagcaagtgccgcgttcgcacataaatattgatgaacaattttttttgggtggatgctcttttcctctttgtagtagtagaaattgagtttctctttaactcttaataaaatgttttggagcttttccttgtttgattctttttcaacaatgtatcttttcataagttgaaactaactaatgggttaatttgacgggtcaagttggttttgatcaggttaggttaatgtgggttttaaaatttttgggttattttgagtatggattggtttcgagtttgggttgtttcggattcaacacattttgggtttaagtcattcagatttgtcaatcaagttttatagtggttattttgagtttaaa

SEQ ID NO: 1345 - DNA, 696 bp, Guizotia abyssinica
agagattggatatccggaaaactcaatcctcagttcagatccgatccgatccgatcaagctttctgcagatctacgatcgtcatgtcttcaacattctccggcgatgagacggctccgttcttcggctttctcggtgccgcggcagccctagttttctcctgcatgggggcggcgtatgggacggctaagagcggtgttggagtggcgtcagtgggagtgatgaggccggaattggtgatgaagtcgattgtgccggtggttatggctggagtgttaggtatttatggattgattatagcggtgattatcagtaccgggattaaccctaaggctaagtcttattatctgtttgatggatacgcacatctttcttcgggtcttgcttgtggccttgctggtctttctgctggtatggctattggaattgttggtgatgctggtgttagagccaacgcacaacaaccaaaactatttgttgggatgatcctgattctcattttcgctgaagctctggctctctatggtctgattgttggcatcatcctttcttctcgtgctggtcaatccagagctgactagaaggagacagccttggtggattattctgtctatggttgtggtggtgtttgttgagctgcagacatgatcaattctttggtggtgatgatacccttggctatggctatgttcctaca

SEQ ID NO: 1346 - DNA, 749 bp, Hevea brasiliensis
actaccagagagagatcaaggagggatcgatactccagacactctctgcgatctcagatccaaacgacaccgtttttttttttttacatcccttaattaaccatgtcttctggattcagcggcgatgaaactgctcctttctttggcttcctcggcgccgctgccgctcttgtcttctcctgtatgggagcagcatatggaacagctaagagtggtgttggcgtggcatcaatgggagtgatgaggcctgaacttgtgatgaagtcaattgttccagttgttatggctggtgtgttgggtatatatgggttgattattgcagttattatcagtactggaattaaccccaaggccaagtcatattacctttttgatgggtatgcacatctctcatctggtcttgcttgtggccttgctgggctttctgctggaatggccattggaattgttggtgatgctggtgtcagagctaatgcccaacaaccaaaactctttgttggaatgattctgatcctcatttttgctgaagcattggcgttgtatggactcattgttggcattatcctgtcttcccgtgctggtcagtctagggcggaataagcagtgggattagtaccttttgttattcttttatggcttagtggcgtgactgcagcggaaaaaaaaaatttaatgattttcactaattattcattagttaggaatcacgtgcaatgttttgaaatattcttatggaagtgtctgttctg

SEQ ID NO: 1347 - DNA, 1001 bp, Humulus lupulus
acaaccacagagtttagagagagatcgaaattcgtagctccacgaactctctgggaagatcgtaactcttgagatccagacgacatcgtcccagatccgaatacgacaatgtcttcaaccttcagcggcgatgaaacggcaccgttcttcggcttcctcggagccgctgcggccctcgttttctcctgtatgggagctgcctatggcacagcaaagagtggtgttggtgtggcatctatgggagtaatgaggcccgagctggtcatgaagtccattgttccagttgttatggctggagttttgggtatttatggtcttatcattgctgttatcatcagtacagggattaacccaaaggcaaaatcatactacctttttgatggttatgctcatctttcctctggtcttgcttgtggtcttgctgggctttcagctggaatggccattggtattgttggtgatgctggtgttagagctaatgcacagcagccaaaacttttcgttggtatgattctcattctcatctttgctgaagctcttgccctgtacggtcttatcgttggcattatcttgtcttcccgtgctggccagtccagagccgaatgagaagcggccattgcagctaaatattcttttatcgcttattatgttacttcaaggttgggtggaagcatttaatttttttcttgccattatcggttagtgaagatgataatcgctggataaacgttgcaggatcccctaaaattatatttgtggtagtaactgcccttccagtcacatggtgttgttttgcttttagaagtaagattgagtttcttgaccgaataaaaagcttttgaagctgaacccccttgcattatattatcagtctttgtgtatttttgttagacaccgttgaacaaccggtatagtatttataattatggaggtagtagtgcatgtaccatgttatattcattgaatacttttatcgaatcccaaactctgcattatgtgct

SEQ ID NO: 1348 - DNA, 946 bp, Humulus lupulus
caaaagcagacgcaatcgggaattttttttattatatataaaaacatgtatgatttatgaaattgatcaacaaacaagtcgacaaaaaaacgtatatcaaattctctattgaacaaaatgtcgtcaacgttcagcggtgatgaaactgctccattcttcggcttcctcggcgccgccgctgccctcgtcttctcctgtatgggagctgcctatggaacggccaagagtggtgttggagttgcatcgatgggggttatgaggcctgagctggtcatgaagtcgatcgtcccagtggttatggcgggagttttgggtatttacggtctcatcatagctgttatcatcagtactggtattaatcccaaggctaaatcctattatctctttgatggctatgctcatctctcgtctggtctcgcttgtggtcttgctggcctctctgctggtatggctattgggattgtgggtgatgctggtgttagggccaatgcacaacagccaaaacttttcgtcggtatgattctaattctcatttttgctgaagcccttgctctatatggtctcattgttggtatcatcctctcttctcgagcgggtcagtcaagagctgaataagaattctttctttctggtggctatattgatcgttgctgtttatctagaactactttgttatcctttaaagaaaaattactcagtgaaatgttctataagatcttgtttgcggtgtaattagaaattctatgaaattgttcgttaagtttttttttatgttctgatatagaattagcaattagtttcaccatttaatagcaatatttgtgcagactcattgcctgtattatattttgctagtaagctagcactctggatgtgctgttaatattgccattttctttatgttgtgttttggttttaaatgttagttttacttctgaatttgttt

SEQ ID NO: 1349 - DNA, 1041 bp, Humulus lupulus
gaaaaccttcctgccattgccagcaccacatctgtcctattcgaccttctctctctcaacgatctctgaagagagaaaaatccaatctttctgaactttctctctcactccctccattgattcaacctaatagacttccaaagagacctaatcgtattcgagatcaaatcgcttaatcaacaatgtcttctactttcagtggcgatgaaactgctcctttcttcggctttctcggtgccgcagctgccctagtcttctcatgtatgggagcggcttatggcacagcgaagagtggagtgggtgtggcgtccatgggtgtgatgaggcctgaacttgtgatgaaatccattgttcctgttgttatggctggagtgttaggtatttatgggttgattattgctgttattatcagtactgggattaaccctaaagccaaatcctattatctctttgatggttatgcccatctatcttctggtctcgcttgtggtttggctggtctttctgctggtatggctattggtatcgtcggtgatgccggtgttagagctaacgcacagcagccaaaactctttgttggtatgatcttgattctcatctttgctgaagctttggctttgtatggtcttattgttggtatcattctatcatcacgagctggccaatcaagagcagaatagaaaagcattcgttcaaatgttctagcctgaactttgttgaaattagattgcccctttaaggacctgaatactgacatcgaaaatggtggtgccattttttttttataaatttcgcataatcttgtgattgcttcatctaaaaagtcaaattcttctgctgggtgttgaatttagaatgagttgtcgttgaataaagcttgctaagctgtacatttaattactatttctgtatctacacataaattcaacgtagcgtagaagccattatcatggcatctccctgcatttttcaagcgattactgattcagtctttatatgtgagtgtttgtgtttgtgtcagttgcaggttatgcatttgtg

SEQ ID NO: 1350 - DNA, 788 bp, Jatropha curcas
ctgcgatctcagatctaaacggcaccgtaatcaaatcgactcgtcaaacatgtcttctgtattcagcggcgatgaaactgctcctttctttggctttctcggcgccgctgctgccctcgtcttctcctgtatgggagctgcatatggaacagccaagagtggcgttggtgtggcatcaatgggagttatgaggcctgagcttgtgatgaagtctattgtaccagttgttatggctggtgtgttgggtatatatggcttgattattgctgttattatcagtactggaattaaccccaaggctaagtcatattacctttttgatgggtatgcacatctctcatctggtcttgcctgtggccttgctgggctttctgctggaatggccattggaattgttggtgattcaggtgttagagctaatgcacaacagcccaaactttttgttggaatgatcctcatcctcatctttgctgaagcattggcattgtatgggcttattgttgggattatcttgtcttcgcgagctggccagtctagggcagaatgagccaggagattagtaccaattgttattctttaatgacttagcggtttgactgcagagaaaattttaatgattgtccacagattattgatggttgaagctcttgcaagattttgaaaaattcttgttatgaaaagtctgttctgccaggcatttagtggtttatttgtgctgtagtagagttttatctacagaataaaaatgcttgtgaatgaagctgttatatatgtttggtttcaaaaaa

SEQ ID NO: 1351 - DNA, 797 bp, Lactuca sativa
aaatcctcagatccgatcaatttttctgcagatctacacttcaaattcaatcaatcatgtcttcaacattcgccggcgatgaaacggctccgttcttcggcttcctcggtgctgcggcagccctggtcttctcctgcatgggggcggcatacgggacggcgaaaagcggcgttggtgtggcgtcgatgggagtgatgaggccggagttggtgatgaagtcgattgtgccggtggttatggctggagtgttgggtatttacggattgattattgcagtgattatcagtaccgggattaacccaaaggccaaatcttattatctctttgatggatacgctcatctttcttccggtcttgcttgtggccttgctggtctttccgctggtatggctatcggaattgttggtgatgccggtgttagggcgaatgcgcaacaaccaaaactatttgttgggatgattttgattttgattttcgctgaagcattggctctgtatggtcttattgttggcatcatcctttcttcccgagctggccaatcaagagcagactagagggatacactgagaggttgtgtgtctgtctttccattattattgattaaaaagcatatgattattatccgctctgtaattgttggttttgctacaaacaagacgaattctttggtggacgttgtaggttgtagaccaaattctagttctctcgttataataagattcgtctcttttgcgtattttatttttcgattttggacttgaaatagataattttggagatttatcccacctttgtaa

SEQ ID NO: 1352 - DNA, 885 bp, Liriodendron tulipifera
  misc_feature (874)..(874): n is a, c, g, or t
  misc_feature (876)..(876): n is a, c, g, or t
  misc_feature (878)..(878): n is a, c, g, or t
  misc_feature (883)..(883): n is a, c, g, or t
atcactcgctcggatctaatctctctctctctctctctcattcttctcctccaaacacccaaaaaccagaagcagcagtcgctgcagaaactgaaattctagggtttccaaaaaatctcttccgaaaatgtccaccactttcagcggtgacgaaactgcccctttcttcggcttcctcggcgctgcagcggccctcgtcttctcctgcatgggggccgcctacggcacggcgaagagtggcgtcggcgtcgcgtcgatgggcgtgatgcgaccggagcttgtgatgaaatcgatcgtgcccgttgttatggctggagttcttggaatctacggtctgatcattgccgtgatcataagcactgggatcaatcctaaagcgaagtcatattatctttttgatggatacgctcatctgtcgtccggccttgcctgtggcctcgctggattgtcagctgggatggcgatcgggatcgttggtgatgccggagtccgggccaatgcacagcagccgaagctgtttgtgggcatgattcttattctcatctttgccgaagcgcttgctctttatggtcttattgtgggcatcatcctctcatctcgagcaggccaatctcgagctgactaagaaatgcgaagtcatcaatcatccttctggaatctcgtggcatgcctctatatagaacattgagcacaattgaattaagtttatgtttacttctccgattctatttgtgattgaattgaagacttgtatgtgggggagtctgattctgtttgctatttcttccccttgatgacatttttctacgagtctgattttgtttgctagacattttctaagttctttctcgatagttaaggttgaaaattgccnantnctttntt

SEQ ID NO: 1353 - DNA, 1154 bp, Pinus pinaster
gtggggacagccactttactgacaactggccgttgtatattaccggcaacctgctgaatggctatcgtgcttaataggcatacgattccgtgatcacctcttctttaatgctctgagattgcatctggatcgggcaaggcacttgcaggttccagcttcgaggttcgatctctttggaggctctgaaactctgaaaaaccttcgaagttctagcgagaatctcgtcccagatctcagttaaaatggtggacgtattcagtggcgatgagactgctccattcttcggcttccttggggccgccgcagcgctcgtgttctcctgcatgggagctgcatatggaactgcgaagagtggcgtgggcgtggcctccatgggtgtgatgaggccggagcttgtgatgaaatcgattgttccagtcgtcatggctggagtgttgggtatttatggtttgattattgctgtgattatcagcacaggaattaaccccaaggcaaagtcctattatctatttgatggttacgcgcatctgtcatcgggactggcttgcgggctctcgggtcttgctgcgggaatggctattggtattgttggtgatgccggtgtcagagcaaatgcacagcagccaaagctctttgttggtatgatcctcatattgatctttgcagaagcacttgcactctatggccttatagttggtattatactttcttctcgagctggccagtcacgagcagattaaagaagttgcagttggtcttctgtttacttggttcatttgtcagttttttagcaagactgctgtcttctgcagtggaaatgtgattgttgtttccagtaggagataatattttgctcaagattcattattattctcttggtttggaattttagactaaagaatttagtgatcaatttgaaagctcattacaatgtggaaattgaaccagttaacaagtgcacgttactgctggtgtcatttggcacgttatgaatttgaaatcaaatcgtatgattctcctttttgagctactcgctgcagattactgtagatacctcccccttttggtctctgctgttgatatattgaaattagaacttactgtagatacctccccttttggtctctaagactgttgatatattgaaattagaa

SEQ ID NO: 1354 - DNA, 1049 bp, Pennisetum glaucum
cccacccagggctccgtttctccttcttcgcagcgtcagcgggcagtcggagtcgccggcacacgggcgctcctcagatcagatcggccaagcagcccaagcccaatccccgagcggaggagccaaatctcgagcacccgtgtgccggcgactccgactgcccgcacgagagcttcccacccagggctccgtttctccttcttcgcagcgtcagcgggcagcgcgcggcggaaaaagcaagcaagatggttgcgttcagcggcgacgagaccgcccccttcttcggcttcctcggcgccgccgccgcgctcgtcttctcatgcatgggcgccgcatacgggacggccaagagcggggtcggcgtcgcctccatgggagtcatgcgcccggagctcgtcatgaagtccatcgtccccgtcgtcatggctggagtcctcggtatatacggcctcatcatcgccgtcatcatctccaccgggatcaaccccaaggccaagccctactacctcttcgacggctacgcgcacctctcctccggactcgcctgtggcctcgccgggctcgccgctggaatggccatcggcatcgtcggagacgcgggtgtcagggcaaacgcacagcagccaaagttgtttgtgggcatgatcctcatcctcatcttcgcggaagctcttgctctgtacggtctcatcgtcggtatcatcctctcatctcgtgccggccaatctcgtgccgattagagaagggattagtgaaacgcacacgactcgcgcatcattgtattcaaagggtccctttcttggtgaaacattgtccaggatcatgttgaacctgttccacctttgtaatactattattattctgccgagacaaccctagctagcgcttgtagttcgtgctgttgtatttatttgaaataataggcagcaagccccggatgtgatgaataaataagcaagctggactagtttttcttgattcagttctttgtttgaattcattatccctgtgaccttcatgagttgaattcattatcactattgccatac

SEQ ID NO: 1355 - DNA, 989 bp, Pennisetum glaucum
cctcgcgacgccgtggccctctcgtcttcttccccctcccacctctcggccctcccccacgcgctcctcagatcagatcggccaagcagcccaagcccaatccccgagtggaggagccaaatctcgagcgcccgtgtgccggcgactccgactgcccgcacgagagcttcccacccagggctccgtttctccttcttcgcagcgtcagcgggcagcgcgcggcggaaaaagcaagcaagatggttgcgttcagcggcgatgagaccgcccccttcttcggcttcctcggcgccgccgcggcgctcgtcttctcatgcatgggggcggcgtacgggacggccaagagcggcgtcggcgtggcgtccatgggtgtcatgcgcccggagctcgtcatgaagtccatcgtgcccgtggtcatggctggtgtgctcggtatctacgggctcatcatcgccgtcatcatcagtaccgggatcaaccccaaggccaagccctactacctctttgacggatacgcccacctctcatctggccttgcctgtggtctcgctggtctcgctgctggcatggccattggcattgttggtgatgctggtgtcagggcaaacgcgcagcaacccaagctgttcgtgggcatgatcctcatcctcatcttcgccgaggcgctcgccctctacggcctcatcgtcggcatcatcctttcatcccgcgccggccagtcacgtgcggactagacgccatccagatctcgatgccatgctgcaggccctggcctgggccgtgttttatattcatgagacaagaaaccggagctcttttagcgggttatttttaattgttctgtctagtttttcaatcttctgtttgggtgagtaaaaggaaaacatgcgcaaccaaaagggggaggactttgcccttgtggtgccgatgccattctttctccgtcgttggtgtggccctgtggtcgatgcttatgtatgcacagtttt

SEQ ID NO: 1356 - DNA, 896 bp, Momordica charantia
gtttcccgaatcaccggtattggtatatcttcatctcgcaaataaaaaacctagaaaaagcttaccggagaggctcataccacgatcggattcggaatctgtattcccagttaatcaacaatggtttcttctttcagtggcgatgaaactgctcctttcttcggcttcctcggggccgctgcagctcttgtattttcctgcatgggtgctgcatatgggactgcaaagagtggagtcggagtggcctccatgggagttatgcggccagagcttgtcatgaaatctatagttcctgtagttatggctggagtgttgggtatttatgggttgatcatcgctgttattattagtaccggaattaacccaaaagcaaagtcttactatttgtttgatgggtatgcacatctgtcttctggacttgcttgtggacttgctggtctgtccgcaggtatggcaattgggatcgtcggtgatgctggtgttcgggccaatgcacaacaacctaagctctttgttggaatgattctcatcctcatctttgctgaggcacttgccctctacggtcttattgttggtatcatcctctcatctcgggcaggccaatctcgtgcagattaaaggatgccaagttgatcctctgtctttgaatttatcattcaaaatgtttcaaggagattttgtttctatgttacttctgtcattgtcaaactgaacccgtattgtattttattgagtgatggtaatgagcaggttttatgacaaacctccatgctcgcctcctgttgctgttgccctttgtgtgatattctttctaattctagtcagttactagagttgtggacaaaagctctccatgcacattccattgaaaatgacctatttctaaataaatactg

SEQ ID NO: 1357 - DNA, 1202 bp, Nuphar advena
  misc_feature (178)..(178): n is a, c, g, or t
  misc_feature (199)..(199): n is a, c, g, or t
  misc_feature (262)..(262): n is a, c, g, or t
  misc_feature (277)..(277): n is a, c, g, or t
  misc_feature (817)..(817): n is a, c, g, or t
caaaagaagaagaagaagaaggcgattaggaaaccaatccttgattttgccctcgttcttctcagatccgatcacccaatcgaaaaaaagggaaaaaagaagaaagaagatgtcgagcttcagcggcgacgagaccgccccattcttcggcttcctgggcgccgcggccgccctcgtnttctcctgcatgggagcggcntacgggacggcgaagagcggggtgggcgtggcgtcgatgggcgtgatgcggccggagctcgtnatgaagtcgatcgtncccgtcgtcatggccggagtgctcggtatctacggcctcatcatcgccgtcatcatcagcaccgggatcaaccctaaggccaagtcctactacctcttcgacggctacgcgcacctctcctccgggctctcctgcggccttgccggtctctccgccgggatggccatcggcatcgtcggcgacgccggcgtcagagccaatgcccagcagccaaagctgtttgttgggatgatcctcatccttatttttgctgaagctctggccttgtatggactcattgtgggcatcattctatcatcccgagcaggccaatccagagcagactaagcacgttcatgctatgattttgtcgtttgtcggttctccacgaaccataatttcttctgagatttattgacctgttatcctctgtattatgtttattttctgtttttcatgttaaaccagaccataaatttttagctgtagtctctacgttgtctgttagggcaattaagtttttgatggaaataacgcttgttttgccaagccgttgtattntaccgtacattcttttgttgaaagaacagagttttttttttgaaaggcagctggggttaggcagaccctcaccatttattattcaacataccactgggttttgaacctgcaccgtcccactacaaggagacgtgcactgacagctcctaccaaccacgtggagcacccgttggttgaaagaacagagtttaaatgttgagagaacagaaccttaagacatggttgtttttgtgctacctggagtaaatcattgcatttcatgaatgctcaaggtcatgtgcatggtttatggaaggatgagtgacttatattttaggcggaaacagaagggatgtttggattggaggctgggatggagtttgttatataagcatgtttctgtgtt

SEQ ID NO: 1358 - DNA, 995 bp, Elaeis guineensis
cggaaaaaataaaaagagcggcgtctccagatccgatcaccgcctctcaacccccgcgccttcgaagatgtctggtttcagcggtgacgagacagcgcccttcttcggcttccttggcgccgcggccgccctcgtcttctcctgtatgggggcggcgtacgggacggcgaagagtggagtgggggtggcctcgatgggggtgatgaggccggagctggtgatgaagtcgatcgtgccggtggtcatggcgggagttctggggatatacggcctcatcatcgcggtcatcatcagcaccggtatcaaccctaaggcgaagtcctactacctcttcgacggatatgcccacctttcatccggcctcgcctgcggtctcgccggcctctccgccggcatggccatcggcatcgtcggcgacgccggcgtcagagccaatgcacagcagcccaaactctttgttggaatgatcctcatcctcatctttgccgaagcactggccctgtatggcctcattgttggtatcattctgtcatctcgtgcaggccaatctagggcagactaggtcatcagtaaaaagaggacagagaatcatgcttggtaggcttgtttgacaagttagatccttatctgcctccgagtcatagaaggtttgcaattcttcatgtgcttgtattctcgtgaaattttggactggtcatattctatttagtgattagtcttttagcacaatggggatgaatatgtatgccaataaagataacatggctgttactttttgggctgcagcatttgaattagcgcttcagctattgtgaaaactaccaatgtaaacttggtccaattttttcgcttggtgacctaaatttctttattttgtttcatcgtcatgttatctcattttgttagcttcggtgctgattcatggtgttggtgttgtctgctcagaggtagaagtggggtctatgatacgcttgttgcattaggaaaaaaaaaaa

(The sequence listing continues in the following parts.)

What is claimed is:

1. A method of increasing root coverage of a plant, the method comprising:
    (a) expressing within the plant a heterologous polynucleotide comprising a nucleic acid sequence encoding a polypeptide comprising the amino acid sequence set forth in SEQ ID NO: 485 or an orthologue thereof comprising an amino acid sequence at least 99% identical to the polypeptide set forth by SEQ ID NO: 485 and having conservative amino acid substitutions with respect to SEQ ID NO: 485, and
    (b) selecting said plants resultant of step (a) for increased root coverage as compared to a non-transformed plant under the same conditions,
    thereby increasing the root coverage of the plant.

2. A method of increasing root coverage of a plant, the method comprising:
    (a) expressing within the plant a heterologous polynucleotide comprising a nucleic acid sequence encoding a polypeptide comprising the amino acid sequence selected from the group consisting of SEQ ID NOs: 485, 6349-6362 and 6363, and
    (b) selecting said plants resultant of step (a) for an increased root coverage as compared to a non-transformed plant under the same conditions,
    thereby increasing the root coverage of the plant.

3. The method of claim 2, wherein said polypeptide is expressed from a polynucleotide comprising a nucleic acid sequence selected from the group consisting of SEQ ID NOs: 272, 11, and 962-977.

4. The method of claim 1, wherein said polypeptide is expressed from a polynucleotide comprising the nucleic acid sequence selected from the group consisting of SEQ ID NOs: 272 and 11.

5. The method of claim 1, further comprising growing the plant expressing said heterologous polynucleotide under an abiotic stress which is selected from the group consisting of drought and nitrogen deficiency.

6. The method of claim 1, further comprising selecting said plants resultant of step (a) for reduced petiole relative area as compared to a non-transformed plant under the same conditions.

7. The method of claim 1, further comprising growing the plant expressing said heterologous polynucleotide under nitrogen-limiting conditions.

8. The method of claim 1, wherein said amino acid sequence is set forth by SEQ ID NO: 485.

9. A method of reducing petiole relative area of a plant, the method comprising:
    (a) expressing within the plant a heterologous polynucleotide comprising a nucleic acid sequence encoding a polypeptide comprising the amino acid sequence as set forth by SEQ ID NO: 485, 6349-6362 or 6363, and
    (b) selecting said plants resultant of step (a) for reduced petiole relative area as compared to a non-transformed plant under the same conditions,
    thereby reducing the petiole relative area of the plant.

10. The method of claim 1, further comprising selecting said plant resultant of step (a) for an increased growth rate, biomass, photosynthetic capacity, nitrogen use efficiency, and/or abiotic stress tolerance as compared to said non-transformed plant under the same conditions.

11. The method of claim 10, wherein said selecting is performed under non-stress conditions.

12. The method of claim 10, wherein said selecting is performed under an abiotic stress condition selected from the group consisting of drought and nitrogen deficiency.

13. A method of reducing petiole relative area of a plant, the method comprising:
    (a) expressing within the plant a heterologous polynucleotide comprising a nucleic acid sequence encoding a polypeptide comprising the amino acid sequence set forth in SEQ ID NO: 485 or an orthologue thereof comprising an amino acid sequence at least 99% identical to the polypeptide set forth by SEQ ID NO: 485 and having conservative amino acid substitutions with respect to SEQ ID NO: 485, and
    (b) selecting said plants resultant of step (a) for reduced petiole relative area as compared to a non-transformed plant under the same conditions,
    thereby reducing the petiole relative area of the plant.

14. The method of claim 13, further comprising selecting for increased root coverage of the plant as compared to a non-transformed plant under the same conditions.

15. The method of claim 1, further comprising selecting for increased yield and/or early flowering of the transformed plants as compared to a non-transformed plant under the same conditions.

16. The method of claim 13, further comprising selecting for increased yield and/or early flowering of the transformed plants as compared to a non-transformed plant under the same conditions.

* * * * *